United States Patent 11,098,302 (IDENTIFICATION OF POLYNUCLEOTIDES ASSOCIATED WITH A SAMPLE) - sequence listing, part 19

SEQ ID NO: 61999 - DNA, 421 bp, Homo sapiens
  misc_feature: GYAE6OF01ESXPA.15.1.A01.1.454.CMB.1.raw
  modified_base (417)..(421): a, c, t, g, unknown or other
  misc_feature (417)..(421): n is a, c, g, or t
tcagtctacgtagccacgaccggtgctcgatttagacgtctcatcaggggctagagtggctctcaatgatttacaccgatggggacggtgggaccacatactacgcagattccgtgaagggcagattcaccatctccagagacaatttggagaacaccgtgattcttaatatgaacagcctgagagccgatgacacggctgtgtatttctgtgcgagagacgggtataatagttactggtttggcgactggggccagggaaccctggtcatcgtctcgtcagcctccaccaagggcccatcggtcttccccctggaaccctcctccaagagcacctctgggggcacagcggccctgggctgcctggtcaaggactacttccgctacgtagactgagcgggctggcaaggcgcatagnnnnn

SEQ ID NO: 62000 - DNA, 540 bp, Homo sapiens
  misc_feature: GYAE6OF01B58ZM.15.1.A01.1.454.CMB.1.raw
  modified_base (229)..(229): a, c, t, g, unknown or other
  misc_feature (229)..(229): n is a, c, g, or t
  modified_base (297)..(297): a, c, t, g, unknown or other
  misc_feature (297)..(297): n is a, c, g, or t
  modified_base (375)..(375): a, c, t, g, unknown or other
  misc_feature (375)..(375): n is a, c, g, or t
  modified_base (384)..(384): a, c, t, g, unknown or other
  misc_feature (384)..(384): n is a, c, g, or t
tcagtctacgtagccacgaccggtgctcgatttagacgtctcatcagggcctgggctctgctgctcctcactctcctcactcaggacacagggtcctggcccagtctgccctgactcagcctgcctccgtgtctgggtctcctggacagtcgatcaccatctcctgcactggaaccagcagtgatggttggggtatcaccttgtctcctggtaccaacaccaccccggnagacgccccaaatcatgactttatgaggccactaagccgaaccctcgagggtctttcaatcgctttcnctggctccaagtctggcaacacgcctcctgacatctctgggctccgaggctagacgacgaggtactaaagttattacngctagctanatactgaagttataactacttaatactagttcggcggaaggaccaaggctgacctcgtgcgtcacgtccgaagtctccgcccctggtctacgtcgttcgttcccgccctcgtccgtctacggtgtaacgttcggacgcggggctgggcgtaacggg

SEQ ID NO: 62001 - DNA, 509 bp, Homo sapiens
  misc_feature: GYAE6OF01CR359.15.1.A01.1.454.CMB.1.raw
  modified_base (316)..(316): a, c, t, g, unknown or other
  misc_feature (316)..(316): n is a, c, g, or t
  modified_base (333)..(333): a, c, t, g, unknown or other
  misc_feature (333)..(333): n is a, c, g, or t
  modified_base (487)..(487): a, c, t, g, unknown or other
  misc_feature (487)..(487): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcaccttgtctcctggtaccaacaccaccccggcacgacgcccccaaatcatgatttatgaggccactaagccgaccctcagggctttctaatcgcttctctggctccaagtctgcaacncgcctcctgacaatctntggctccaggctgacgagagtctaattattactgctgctcatatgtaaagttataacactatactattcggcggaggacagctgaccgtcctgcgtcagcccaaggctcgccccctcggtcacctctcgtccccaccctcctcgcctacgtacncgtcgacgcggctggcgaacgg

SEQ ID NO: 62002 - DNA, 618 bp, Homo sapiens
  misc_feature: GYAE6OF01EL2D4.15.1.A01.1.454.CMB.1.raw
  modified_base (231)..(231): a, c, t, g, unknown or other
  misc_feature (231)..(231): n is a, c, g, or t
  modified_base (307)..(307): a, c, t, g, unknown or other
  misc_feature (307)..(307): n is a, c, g, or t
  modified_base (326)..(326): a, c, t, g, unknown or other
  misc_feature (326)..(326): n is a, c, g, or t
  modified_base (367)..(367): a, c, t, g, unknown or other
  misc_feature (367)..(367): n is a, c, g, or t
tcagtctacgtagccacgaccggtgctcgatttagacgtctcatcaagggaaggaaggggggggtctcaggaggcagcgctctcaggacatctccaccatggcctgggctctgctgctcctcaccctcctcactcagggcacagggtcctgggcccagtctgccctgactcagcctgcctccgtgtctgggtctcttggacagtcgatcaccatctcctgcactggaaccngcagtgacgttggtacttataactatgtctcctggtaccaacagaacccaggcaaagcccccaaatcatgatttangaggtcagtaatcggcctntagggtttctaatcgcttctctggctccaagtctggcaacntcggccccctgaccatctctcgggactccgaggtcctggaacggtacgacggtactggtaatttactttaccgtgtaccgaacgtcctaccgaattacttaaacgaacgtccaaggaccaacggcctaaccgtttcccgttgggggttccgttacggggaccggggtaacggggaacccaaagggtcctaacgggtaccccgttaccgttacgggttcaaccggtaccccgtaaagggccttacccccggg

SEQ ID NO: 62003 - DNA, 516 bp, Homo sapiens
  misc_feature: GYAE6OF01BX1UK.15.1.A01.1.454.CMB.1.raw
  modified_base (366)..(366): a, c, t, g, unknown or other
  misc_feature (366)..(366): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacacccaccccggcagacgcccccaaactcatgatttatgaggccactaagccgaccctcagggtctttctaatcgcttctctggctccaagtctggcaacacggcctcctgacatctctgggctccaggctgacgacgagctaattnttactgctgctcatatgaagttataacactatactattcggcggagggaccaagctgaccgtctgcgtcacgcccaaggcctcgcccctcggtccactcctcgttccccgccctcctcgtctacgtagacgtgacgcgggctggcacggg

SEQ ID NO: 62004 - DNA, 509 bp, Homo sapiens
  misc_feature: GYAE6OF01C27A9.15.1.A01.1.454.CMB.1.raw
  modified_base (469)..(469): a, c, t, g, unknown or other
  misc_feature (469)..(469): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcaccttgtctcctggtaccaacacccaccccggcagacgcccccaaaactcatgatttatgaggccactaagcgaccctcagggctttctaatcgctttctctggctccaagtctggcaacacggcctccctgacaatctctgggctcaggctgacgacgaggctaattattactgctgctcatatagaagttataacactatactatcggcggaggacaagctgaccgtctgcgtcagcccaagctcgcccctcggtccactctcgtcccnccctcctcgctacgtacgactcgacgcggctggcgaacgg

SEQ ID NO: 62005 - DNA, 505 bp, Homo sapiens
  misc_feature: GYAE6OF01C36GS.15.1.A01.1.454.CMB.1.raw
  modified_base (467)..(467): a, c, t, g, unknown or other
  misc_feature (467)..(467): n is a, c, g, or t
  modified_base (497)..(497): a, c, t, g, unknown or other
  misc_feature (497)..(497): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcaccttgtctcctggtaccaacaccaccccggcagacgcccccaaactcatgatttatgaggccactaagcgaccctcagggctttctaatcgcttctctggctccaagtctggcaacacggcctccctgacatctctggctccagctgacgacgagctaattatactgctgctcatatgaagttataacactatactatcggcggaggaccaagctgaccgtctgcgtcacgcccaagctcgccccctcggtccactcctcgttccccnccctccctcgctacgtagactgacgcggcnggcaacgg

SEQ ID NO: 62006 - DNA, 512 bp, Homo sapiens
  misc_feature: GYAE6OF01AU4S0.15.1.A01.1.454.CMB.1.raw
  modified_base (388)..(388): a, c, t, g, unknown or other
  misc_feature (388)..(388): n is a, c, g, or t
  modified_base (479)..(479): a, c, t, g, unknown or other
  misc_feature (479)..(479): n is a, c, g, or t
  modified_base (490)..(490): a, c, t, g, unknown or other
  misc_feature (490)..(490): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcaccttgtctcctggtaccaacacccaccccggcagacgcccccaaactcatgatttatgaggccactaagccgaccctcagggctttcaatcgctttctctggctccaagtctggcaacacggcctcctgacaatctctgggctcaggctgacgacgagctaattattactgctgctcatatgaagttanaacactatactagttcggcggaggaccagctgaccgtctgcgtcacgcccaaggcctcgcccctcggtccactcctcgttccccgccctcnctcctacgtanacgtgacgcggctcggcgacgg

SEQ ID NO: 62007 - DNA, 532 bp, Homo sapiens
  misc_feature: GYAE6OF01CI71C.15.1.A01.1.454.CMB.1.raw
  modified_base (472)..(472): a, c, t, g, unknown or other
  misc_feature (472)..(472): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcaccttgtctcctggtaccaacaccaccccggcacgacgcccccaaactcatgatttatgaggccactaagccgaccctcagggctttctaatcgctttctctggctccaagtctggcaacacggcctcctgacaatctctgggctccgaggctgacgacgaggcttaaattattactgctgctcatatagtaaggttaataacactatactagttcggcggagggaccaagctcgaccgtctgcgtcacgcccaaggcctcgccccctcgtccnctcctccgttcccaccctccctcgcttaccgtacgacgtcgacggcgggctggcgacggg

SEQ ID NO: 62008 - DNA, 515 bp, Homo sapiens
  misc_feature: GYAE6OF01DM82H.15.1.A01.1.454.CMB.1.raw
  modified_base (298)..(298): a, c, t, g, unknown or other
  misc_feature (298)..(298): n is a, c, g, or t
  modified_base (372)..(372): a, c, t, g, unknown or other
  misc_feature (372)..(372): n is a, c, g, or t
  modified_base (426)..(426): a, c, t, g, unknown or other
  misc_feature (426)..(426): n is a, c, g, or t
  modified_base (509)..(509): a, c, t, g, unknown or other
  misc_feature (509)..(509): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacacccaccccggcagacgcccccaaactcatgatttatgaggccactaagcgaccctcagggctttctaatcgctttcnctggctccaagtctggcaacacggcctccctgacaatctctgggctccaggctgacgacgagctaattattacngctgctcatatgtaaaggttataacactatactattcggcggaggaccaagctnaccgtctagcgtcagcccaaggcctcgcccctcggtcactctcgttctccgcccttcctccgctacgtagactaggagcgggntggacg

SEQ ID NO: 62009 - DNA, 749 bp, Homo sapiens
  misc_feature: GYAE6OF01DPAML.15.1.A01.1.454.CMB.1.raw
  modified_base (197)..(197): a, c, t, g, unknown or other
  misc_feature (197)..(197): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctcgtgtctgggtctcctggacagtcgatcaccatctcctgcactggaaccagcagtgagtggttggggtancaccttgtctcctaggtaaccaacacccgacccggcacgaccgacccccaaactcgatgtattttagtcggacggacccaagtaaacgcccgtaacccgtacgacgggtcctttactaagttccggtctttctcgtcggtcctcccgaagttccgtaggacctaaaccgaccgggtccccttcccgtaggtaacctaattccgttccgtacgggggccttaccggaagggtccgtacgggaaccggtacggaacggtacttaaatttacgttacacgtctacggaccttacgaattacgtaaggtaacggtttaaacaaacgttaactaattaacgtacgttcggggacggtaacgggtacccaaggtcctaggtacccgtcgtaccgggtacctaccgaaccgtacccgtaaggtcccgttacccggtacccccggtcgtccgtaaccttcccgttaacccggttaccccccgtacccgttaccttacccggtacgttacccggtaaggaccgttcgggaacggtcccgggactcgggaccggtaacccgg

SEQ ID NO: 62010 - DNA, 680 bp, Homo sapiens
  misc_feature: GYAE6OF01CQXW8.15.1.A01.1.454.CMB.1.raw
  modified_base (229)..(229): a, c, t, g, unknown or other
  misc_feature (229)..(229): n is a, c, g, or t
tcagtctacgtagccacgaccggtgctcgatttagacgtctcatcagggccttggggctctgctgctcctcactctcctcactcaggacacagggtcctggcccagtctgccctgactcagcctgcctccgtgtctgggtctcctggacagtcgatcaccatctcctgcactggaaccagcagtgatgttggggtatcaccttgtctcctggtaccaacaccacccggnacgacgcccccaaatcatgtatttatgaggaccaactaaacgccgaaccctcgaacgggtctttctaaatcgtcctttctcgtggccttaccaaggttcctggcaaccgtaccggccctccctgacctaatcctcgtcgggactcccgaaggctacggacgacgtaggccttaaagtttacttacgtgtctgtcctacgatagtagtaaaggttaactaaacgtaacttaattaacttacgttccgggacggaacgggtaccaacggtctagaacccgtactacggaccgttaccgaccgtacccgaacgggtcccaccggtcccccgttcggtaccctaccgtcccgtttccggttacccccgtccccgttcccgtaccggtcccgttaacccgtacggtaacccgttacgggaccggtccgggtaccgtcggggtcccgtaacccgggg

SEQ ID NO: 62011 - DNA, 511 bp, Homo sapiens
  misc_feature: GYAE6OF01DH7YJ.15.1.A01.1.454.CMB.1.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagacgcccccaaactcatgatttatgaggccactaagcgaccctcagggctttctaatcgctttctctggctccaagtctggcaacacggcctccctgacaatctctgggctccaggctgacgacgaggctaattattactgctgctcatatgaagttataacactatactatcggcggaggaccaagctgaccgtctgcgtcacgcccaaggcctcgccccctcggtccactcctcgttcccgccctcctcgctacgtagacgtgagcggctggcacgg

SEQ ID NO: 62012 - DNA, 526 bp, Homo sapiens
  misc_feature: GYAE6OF01CCFJH.15.1.A01.1.454.CMB.1.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcaccttgtctcctggtaccaacaccaccccggcagacgcccccaaactcatgatttatgaggccactaagcgacctcagggctttctaatcgcttctctggctccaagtctggcaacacggcctccctgacaatctctgggctccaggctgacgacgaggctaattattactgctgctcatatagaaggttataacactaatactattcggcggagggaccaagctgaccgtctgcgtcacgacccgaaggctcgccccctcggtcctacctctcgttccccacccttccctccgctacgtacgacgtgacggcgggctggcgaacggg

SEQ ID NO: 62013 - DNA, 529 bp, Homo sapiens
  misc_feature: GYAE6OF01CS2FC.15.1.A01.1.454.CMB.1.raw
  modified_base (507)..(507): a, c, t, g, unknown or other
  misc_feature (507)..(507): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcaccttgtctctggtaccaacaccacccggcagacgccccaaactcatgatttatgaggccaactaagccgaccctcgacgggtctttactaatccgtctttctctcggcctccaagtctggacaacacggcctccctagaccaatctcgtgggctccgaggctagacgacgaggactaattatactgactgctcatagtagaagttataacatatactagttcggacggaggacaagctagaccgtctgcgtcacgcccaagctccgcccctcggtctacgtcctccgtccccgcctctcgctacgtanacgtcgacggcggctggcacgg

SEQ ID NO: 62014 - DNA, 537 bp, Homo sapiens
  misc_feature: GYAE6OF01AHMLP.15.1.A01.1.454.CMB.1.raw
tcagtctacgtagccacgaccggtgctcgatttagacgtctcatcagggtcttcgtggctcacgtccaccaccacgcatgtgacctcaggggtccctgagactctcatgtgcaggctctggattcagcgtcaggaatagttacatgagttgggtccgccaggctccagggcaggggctagagtggctctcaatgatttacaccgatggggacggtgggaccacatactacgcagattccgtgaaggcagattcaccatctccagagacaatttggagaacaccgtgattcttaatatgaacagcctgagagccgatgacacggctgtgtatttctgtgcgagagacgggtataatagttactggtttggccacgtgggccagggaccctggtcatcgtctcgtcagcctccaccacggcccatcgtccttccccctcggccaccctcctccaacgacgccacctcgtcggggcacgacgccggcccgtgggcctcgcccgtggtacgaacggactaccttcccgtccgtacgtacgg

SEQ ID NO: 62015 - DNA, 511 bp, Homo sapiens
  misc_feature: GYAE6OF01CPANO.15.1.A01.1.454.CMB.1.raw
  modified_base (492)..(492): a, c, t, g, unknown or other
  misc_feature (492)..(492): n is a, c, g, or t
  modified_base (500)..(500): a, c, t, g, unknown or other
  misc_feature (500)..(500): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcaccttgtctcctggtaccaacaccaccccggcagagcccccaaaactcatgattttatgaggccactaagcgaccctcagggctttctaatcgctttctctggctccaagtctggcaacacggcctccctgacaatctctgggctccaggctgacgacaggctaaattatactgctgctcatatgaaggttataacactatactattcggcgagggaccaagctgaccgtctgcgtcagcccaaggctcgcccccgtcggtccactcctgttccccgccctctccgctacgtanactgacgnggctgcgaagg

SEQ ID NO: 62016 - DNA, 524 bp, Homo sapiens
  misc_feature: GYAE6OF01C9O8S.15.1.A01.1.454.CMB.1.raw
  modified_base (275)..(275): a, c, t, g, unknown or other
  misc_feature (275)..(275): n is a, c, g, or t
  modified_base (316)..(316): a, c, t, g, unknown or other
  misc_feature (316)..(316): n is a, c, g, or t
  modified_base (502)..(502): a, c, t, g, unknown or other
  misc_feature (502)..(502): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttggggttatcaccttgtctcctggtaccaacaccaccccggcagacgccccaaactcatgatttatgaggccactaagcgaccctnagggctttctaatcgcttctctggctccaagtctggcaacncggccctccctgacaatcctctgggctccgaggctagacgacgaggattaattattactgctgctcatatgaaggttataacactatactattcggcggagggaccaagctgaccgtctgcgtaccagtcccaaggtcctacgcccctcggtctacctctcgtccccaccctccctcgctacgtanacgtgagcgggctggcgaacgg

SEQ ID NO: 62017 - DNA, 534 bp, Homo sapiens
  misc_feature: GYAE6OF01B5DIU.15.1.A01.1.454.CMB.1.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcacttgtctcctggtaaccaacaccacccggcagacgccccaaatcatgatttatgagtccactaagccgacctgagggtctttcgtaatcgctttctctggctccaagtctggcaacacggcctcctgacatctcgtggctcgagctgacgacgagcttaattatactgctgctactatagtagtagtaataacactatactagttcggacggagacagctgaccgtctcgcgtacgacgcccgaagtcctccgcccctcgtcctacttccgttcgttccccgtccctacttcccgtcttacgtacgtaccgtggacgcgggtctggcgtaacggg

SEQ ID NO: 62018 - DNA, 532 bp, Homo sapiens
  misc_feature: GYAE6OF01B2A95.15.1.A01.1.454.CMB.1.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccaacattgacgttggtgattataacttttgtctcctggtaccaacaacacccaggcaaagcccccaaactcatcatttatgaagtctctaagcggccctcgagggtatctaatcgcttctctggctccaagtctggcaacacgcctccctgaccgtctctggcctccagactgaggacgagctgatttatactgccactcatatagagtagtactactctgttggttttcggcggaggaccagctacgacgtctagtcacgacccaaggcctcgcccctcggtccactccttcgtccccgtccctcctccgtctacgtacgccgtcgacggcgggtcgtggccgaagccgctaacg

SEQ ID NO: 62019 - DNA, 550 bp, Homo sapiens
  misc_feature: GYAE6OF01B5ROY.15.1.A01.1.454.CMB.1.raw
  modified_base (498)..(498): a, c, t, g, unknown or other
  misc_feature (498)..(498): n is a, c, g, or t
  modified_base (546)..(546): a, c, t, g, unknown or other
  misc_feature (546)..(546): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccaacattgacgttggtgattataactttgtctcctggtaccaacaacacccaggacaaacgccccaaatcatcatttatgaatctctaagccggcctcaggggtatctaatcgcttctctggctccaagtctggcaacgacgtccctccctcgtaccgtctctcggcctcacgactgaggacgaggctagtattattaactcgaccactacatagtaagtaagtattactactccgtaggttggtttcggacggacggacaagcgtgacccgtcgtacggcacgacccgaagcctccgcccctcggtcactcctcgttcccnccctcctccgcgttacgtcgactggacgcgggctaggaccgaaggcgntacg

SEQ ID NO: 62020 - DNA, 641 bp, Homo sapiens
  misc_feature: GYAE6OF01BJCLK.15.1.A01.1.454.CMB.1.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcacttgtctcctggtaccaacaccaccccggcacgacgccccaaactcatgtatttatgaggccaactaagccgacctcgaggtctttctaatcgtcttctctggcctaccgaagtcgtcggaccaacgaccggtcctcatagacaatctcgtgggctccgagtctcgaacgagacgtacttaaattacttactgactgctactatacgttagtaaagttaactaactacttaatacttagttaccgggacgggaacggaaccgtaagccgtaccgtacgtcctacggcgtaccgaccggtaccaacggtccctacccggtcccccgttacggtacccttaccgtacccgtttcccggttccccccttaacccccgttcccgtacgttaccccgttaacggtaccctacggtacggaacgggttcccggagttcgggaacccgg

SEQ ID NO: 62021 - DNA, 510 bp, Homo sapiens
  misc_feature: GYAE6OF01CR2GM.15.1.A01.1.454.CMB.1.raw
  modified_base (256)..(256): a, c, t, g, unknown or other
  misc_feature (256)..(256): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcaccttgtctcctggtaccaacaccaccccggcagacgcccccaaactcatgatttacngaggccactaagcgaccctcagggctttctaatcgctttctctggctccaagtctggcaacacgcctcctgacatctctggctcaggctgacgacgagctaattattactgctgctcatatgaagttataactactaatacttagtcggcggacggaccaagctcgaccgtctgcgtcacgcccagcctcgcccctcgtccactctcgttccccgccctcctcgcctacgtagactgacggcggctggcgacgg

SEQ ID NO: 62022 - DNA, 692 bp, Homo sapiens
  misc_feature: GYAE6OF01BO3MI.15.1.A01.1.454.CMB.1.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttggggttatcaccttgtctctgtaccaacaccacccgcacgacgaccccaaactcatgtatttagtgacggaccaactaacgccgaccctcgacgggtctttactaatcgtctttctcgtggcctaccgaagtcgtggaccaacgaccggccctccctagaactaactcgtcgtcgggcctccgaggctacggacggacggaggtacttaaatttacttactgtctcgtccttacaattagttaggtaaaggtttaactaaactaacttaattacgttacgttccgggacgggtaacgggaaccaagtcgtacggtacccgttcgtcggtccgtacgaccggtacccgaacggtcccgtccccggtcccccgttccggtacctacccgttccgttaccccgtttcccccctaacccccgtttcccgttacccggtcccgttaacccggtaacggtaccggttcgggacggggtcccgggtccggtacgggaccggtaacgggg

SEQ ID NO: 62023 - DNA, 615 bp, Homo sapiens
  misc_feature: GYAE6OF01CTKWG.15.1.A01.1.454.CMB.1.raw
  modified_base (605)..(605): a, c, t, g, unknown or other
  misc_feature (605)..(605): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttgggggttatcaccttgtctcctggtaccaaccacccaccccggcactacgcccccaaactcatgatttatgacggccaactaacgccgaccctcgaggtctttctaatcgtcttctcgtggctccaagtctggaccaacgccggccctccctagacaatcctcgtcgggcctccgaggctacggacggacgaaggtacttaaattacttactcgctgctacaattagtaggtaaagttaactaactaattatactacgttcgggacggtaaggaccaagtccgtacggtacccgtcgtcggcgtaccgacgcccgaggctccgccgtacctcggtaccaccttcccgtaccgttccccctaccccgttcccgtaccgtcgttaaccggtcgtaaccttcgggacgggtccggggntcgggaaccg

SEQ ID NO: 62024 - DNA, 523 bp, Homo sapiens
  misc_feature: GYAE6OF01CJ3NV.15.1.A01.1.454.CMB.1.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttgggggttatcaccttgtctcctggtaccaacaccaccccggcagacgcccccaaaactcatgatttatgaggccactaagcgaccctcagggctttctaatcgctttctctggctccaagtctggcaacacggcctccctgacaatctctgggctcagctgacgacgagctaaattattactgctgctcatatagaaggttaataacataatactattcggcggagggaccaagctgaccgtcctgcgtcagcccaaggctcgccccctcggtccactcctcgttccccaccctcctccgctaccgtagacctgaggcgggctggcgaacggg

SEQ ID NO: 62025 - DNA, 558 bp, Homo sapiens
  misc_feature: GYAE6OF01AJ9UX.15.1.A01.1.454.CMB.1.raw
  modified_base (280)..(280): a, c, t, g, unknown or other
  misc_feature (280)..(280): n is a, c, g, or t
  modified_base (385)..(385): a, c, t, g, unknown or other
  misc_feature (385)..(385): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcatggtaccaacaccaccccggcacgacgcccccaaactcatgatttatggacgccactaacgccgaccctnaggtctttactaatcgtcttctctgctcaagtctgacaacacgcctcctagactatctcgtggctccgagctgacgacgagtacttaattacttactgctgctanattatagtaagttataactactatactagttcggacggaacggactaagctacgaccgttccgagtcgtcgacgcccgtaagcctaccgccccgtcgtccaccgttctcccggttccccgcccttccctccgtacgttaccgtacgcgtaggacggccgggtcgtcggaccgg

SEQ ID NO: 62026 - DNA, 524 bp, Homo sapiens
  misc_feature: GYAE6OF01EEY0Z.15.1.A01.1.454.CMB.1.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcaccttgtctcctggtaccaacaccaccccggcagacgcccccaaactcatgatttatgaggccactaagcgaccctcaggctttcaatcgcttctctggctcaagtctggcaacacgcctcctgacaatctctggctccaggctgacgacgagctaattatactgctgctcatatagtaagttataactactatactagttcgggacggaagggaccaagctacgaccgtctgcgtcacgacccaaggcctcgcccccgtcggtcctactcctccgttccccgccctcccgtcgcctacgtacgactggacgcgggctggcgacgg

SEQ ID NO: 62027 - DNA, 520 bp, Homo sapiens
  misc_feature: GYAE6OF01A5I61.15.1.A01.1.454.CMB.1.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcaccttgtctcctggtacccaacaccaccccggcagagcccccaaactcatgatttatgaggccactaagcgaccctcagggctttctaatcgcttctctggctccaagtctggcaacacggcctccctgacaatctctgggcctccgaggctgacgacgaggctaattattactgctgctcatatgaagttataacactatactattcggcggagggaccaagctgaccgtcctgcgtcacgcccaaggcctcgcccctcggtcacctctcgttcccgcccctctccgctacgtacgacgttcgacggcggctggcgaacgg

SEQ ID NO: 62028 - DNA, 531 bp, Homo sapiens
  misc_feature: GYAE6OF01DPXZM.15.1.A01.1.454.CMB.1.raw
  modified_base (329)..(329): a, c, t, g, unknown or other
  misc_feature (329)..(329): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggtatcacttgtctcctggtaccaacaccaccccggcagacgcccccaaactcatgatttatgaggccaactaagccgaccctcagggtctttctaatcgtcttctctggctccgaagtctggcaacacggcctcccngacaatctctggctcaggctgacgacgagcttaattattactgctgctcatatagaagttataacactatacttagtcggacggacggacaagctcgaccgtctgcgtcacgccaagcctcgcccctcggtcctacgtccttccgtccccgtccctcccgtcgtccgtacgtacgacgtcggacggcggcgtggcgaacggg

SEQ ID NO: 62029 - DNA, 540 bp, Homo sapiens
  misc_feature: GYAE6OF01CPFW4.15.1.A01.1.454.CMB.1.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttgggggttatcaccttgtctcctggtaccaacaccaccccggcagacgcccccaaactcatgatttatgaggccactaagcgaccctcagggctttctaatcgctttctctggctccaagtctggcaacacggcctccctgacaatcctcgtgggctccaggctgacgacgaggcttaaagttattactgctgctcatatgaaggttaataacactatactattcggacggagggaccaagctgaccgtctgcgtcacgccaagcctcgccccctcggtccacttctcgttccccgcccctcctccgtcgtaccgtacgtaccgtgacggccgggcgtgggccgtaacggg

SEQ ID NO: 62030 - DNA, 603 bp, Homo sapiens
  misc_feature: GYAE6OF01B7MED.15.1.A01.1.454.CMB.1.raw
  modified_base (241)..(241): a, c, t, g, unknown or other
  misc_feature (241)..(241): n is a, c, g, or t
tcagtctacgtagccacgaccggtgctcgatttagacgtctcatcagggtcttcgtggctcacgtccaccaccacgcatgtgacctcaggggtccctgagactctcatgtgcaggctctggattcagcgtcaggaatagttacatgagttgggtccgccaggctccagggcaggggctagagtggctctcaatgatttacaccgatggggacggtgggaccacatactacgcagattccgngaagggcagattcaccatctccagagacaatttggagaacaccgtgatttcttaatatgaacagcctgagagccgatgacacggctgtgtatttctgtgcgagagtacggtataagtagttactgggtttcgccgtagtcggggccgaacgggacccgtggtctagtccgtcgtcgtccgacgtccctcccacccgaacgggccctacgttccggttcccttcccccgtcggccctacccctccctacccaacgaccgcctacccgtccggtcggggccacgaccggcccgggtccccgtgggcccgtcggtcccgtgggtaccgtaacggtaccttacccgttcccgtcgtaccggtacgg

SEQ ID NO: 62031 - DNA, 676 bp, Homo sapiens
  misc_feature: GYAE6OF01CM7AV.15.1.A01.1.454.CMB.1.raw
  modified_base (230)..(230): a, c, t, g, unknown or other
  misc_feature (230)..(230): n is a, c, g, or t
  modified_base (323)..(323): a, c, t, g, unknown or other
  misc_feature (323)..(323): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttggggttatcacttgtctcctggtaaccaacaccacccggnacgacgcccccaaactcatgtatttatgacggccaactaagccgaccctcgagggtctttctaatcgcttctctggcctcaagtctggcaacncggcctcctgacatctcgtggctccgaggctaggaccgacgaggtaccttaaatttacttacgtcgcttacgctactaattacgtaggtaaggtttaactaaactacttaacttacgttagttaccggggacgggtaacgggaaccctaaggtcctacggtacccgttccgtcggtaccgtacgaccgtaccccgaacggtcccgttacccggtaccccccgtcgggttccctaacccgtttcccgttcccggttaccccccgtccccgttcccgtacccggtaccccgttaaccggttaccgtaccggttacggaccgggtacccggggtcgttcggggaccgtaaccgggg

SEQ ID NO: 62032 - DNA, 576 bp, Homo sapiens
  misc_feature: GYAE6OF01CL9UC.15.1.A01.1.454.CMB.1.raw
  modified_base (258)..(258): a, c, t, g, unknown or other
  misc_feature (258)..(258): n is a, c, g, or t
  modified_base (280)..(280): a, c, t, g, unknown or other
  misc_feature (280)..(280): n is a, c, g, or t
  modified_base (380)..(380): a, c, t, g, unknown or other
  misc_feature (380)..(380): n is a, c, g, or t
tcagtctacgtagccacgaccggtgctcgatttagacgtctcatcagggcctgggctctgctgctcctcactctcctcactcgaggacacagggtcctgggcccagtctgccctgactcagcctgcctccgtgtctgggtctcctggacagtcgagtcaccatctcctgcactggaaccagcagtgatggttggggttatcaccttgtctcctggtaccaacacccaccccggcagacgcccccaaatcatgatttangacggccactaagccgaccctnagggtacttttcaatcgcttctctggctccaagtctggcaacaccggcctccctgaccatctcgtcgggctcgaggctgacgacgagctaaattattacngctgctacatatagaagttataacgataatactagtcgggacggtaggaccaagccgtagacccgtctcgccgtacgaccgcccgtaaggccctaccggccccctcggtaccaccgttcccgttcggttcccccgccccgttcgcccggtacttaccggtacgcgtaggacggtcgggactcgggacgaaccgggg

SEQ ID NO: 62033 - DNA, 700 bp, Homo sapiens
  misc_feature: GYAE6OF01EO62I.15.1.A01.1.454.CMB.1.raw
tcagtctacgtagccacgaccggtgctcgattttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgagtggtttggggttatcctactttgtctccgtacggtaaccaaccgacccgaccccggcacgaccgacccccaaactcatgtatttagcgacgtaccaacgtaagccgacctcgacgggtcctttactaactcgtcttctcgtacggtcctaccgtaacgtcgtacggaccaaaccgaccggtcccctacccgtagtaacaacttccgtcgtcgggccttcggacggtcgtacgaacgacggtaagtacttaaattaattacgtcgtactcgtctactaattagtaggttaaagttaactaaactaacttaagtaacttacggttacggacgggtaacggaaccgaacgtacggtacgtaccgtccgtggtacccgtacgaccgacccgaacgtccgtacccgtcccccgtcgtacctaccttaccgtacccgttaccccgtaccccgttcccgtaccgttacccgtaaccggtacgtaccggtcgggaccgtcgggaccgtggacggtaaccgg

SEQ ID NO: 62034 - DNA, 549 bp, Homo sapiens
  misc_feature: GYAE6OF01ALAWZ.15.1.A01.1.454.CMB.1.raw
  modified_base (539)..(539): a, c, t, g, unknown or other
  misc_feature (539)..(539): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttggggttatcaccttgtctcctggtaccaaccacccaccccggcacgacgacccccaaactcatgatttatgacggccaactaagccgaccctcagggtctttctaatcgtctttctctggcctaccaagtctggaccaacgaccggccctccctgacaactctcgtcgggctccgaggctggaacgacgaggacttaaattattactgctgctcatatagtaagttataactactatactagtcggcggacggacagctagaccgtctgcgtcacgccagctccgccccgtcgcctactcctccgtcccctaccctcctcgtctacgtacgacgtcggacggcggtcgnggcgaacggg

SEQ ID NO: 62035 - DNA, 526 bp, Homo sapiens
  misc_feature: GYAE6OF01CM1RL.15.1.A01.1.454.CMB.1.raw
  modified_base (256)..(256): a, c, t, g, unknown or other
  misc_feature (256)..(256): n is a, c, g, or t
  modified_base (278)..(278): a, c, t, g, unknown or other
  misc_feature (278)..(278): n is a, c, g, or t
  modified_base (511)..(511): a, c, t, g, unknown or other
  misc_feature (511)..(511): n is a, c, g, or t
  modified_base (520)..(520): a, c, t, g, unknown or other
  misc_feature (520)..(520): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaaactcatgatttangaggccaactaagcgaaccctnagggctttctaatcgcttctctggctccaagtctggcaacacggcctccctgacaatctctgggctccaggctgacgacgaggctaaattattactgctgctcatatgaaaggttaataaacaactaatactagttcggcggagggaccaagctgaccgtctgcgtcaagcccaaggctcgcccctcggtcctactcctgttccccaccctccctcgctacgtagactgaagngggactggnaaacgg

SEQ ID NO: 62036 - DNA, 758 bp, Homo sapiens
  misc_feature: GYAE6OF01ATJTT.15.1.A01.1.454.CMB.1.raw
  modified_base (179)..(179): a, c, t, g, unknown or other
  misc_feature (179)..(179): n is a, c, g, or t
  modified_base (275)..(275): a, c, t, g, unknown or other
  misc_feature (275)..(275): n is a, c, g, or t
  modified_base (445)..(445): a, c, t, g, unknown or other
  misc_feature (445)..(445): n is a, c, g, or t
  modified_base (641)..(641): a, c, t, g, unknown or other
  misc_feature (641)..(641): n is a, c, g, or t
tcagtctacgtagccacgaccggtgctcgatttagacgtctcatcagggccgtgggctctgctgctcctcactctcctcactcaggacacaggtcctgggcccagtctgccctgactcagcctgcctccgtgtcgtgggtctcctggacagtcgatcaccatctcctgcactggaaccngcagtgagttggttggggttatactaccgttgttcctcgtacggtaaccaaccacccgaccccggcacgaccgaccccaaactcatagtatttagngacggacctaactacgaccgaccctagacgggtaccttttataacgtccgtctttcctcgtcggcctacgtaacgttcgcgggaccaacgtccggtccctaccctagaactacttcgtacggtcgctaccgaggctggacgacggtacgtagttaactttattactcgtntacgtctactaattacgtagtaaacgttaactaacgtaacttaactacggttacgtacgggaccggtaacggaacctaacgtcgtaccggtcctacgtcgtaccgtaccgtaaccgaacccggtacgtcccgttacccggtacccccgttccggttacccgttacccgtttccttaacccccgggtttaccccccnccccgtttaccccgttaccccggtttaaccgttaacccgggttaaaccgttacccggttacggggtaaacccgggtccccggggttacggcccggggttaaccgggtaaacccgggg

SEQ ID NO: 62037 - DNA, 744 bp, Homo sapiens
  misc_feature: GYAE6OF01ESV46.15.1.A01.1.454.CMB.1.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcacgtcggaaccagcagtgagttggttgggggttactctaccttgttcctaccgtacggtacccaaccaccccgaccccggcacgaccgacccccaaactcctattagtactttatacggacggtaccctaacgtaacgcccgtacccgtaccggacgggttccttttacctaacgttccgttcctttccgttccgtacggtcctacccgtaaggtccgtacgggaacctaaccgacccggtccccttacccgtagtaacctaactccgtcggtcgggccttaccgacggtcgtacggacggtaacggtaacggttacttaaacgtttactacgtcgtctacgtactactaattagtacggttaaagtttacaaactacttataacgtaggtccgggaggtaacggaaccagtcgtaccgcccgtacgtcgtacctaccggaccgacccgtaacggtcccgtcccccgtcccgtaccggtacctaccgtttccgtccccgttacccccacccgtttcccgccgtacgtacccggtagcccgggttaggaccggcgggtacggtccggaacgtaccgg

SEQ ID NO: 62038 - DNA, 651 bp, Homo sapiens
  misc_feature: GYAE6OF01D3S78.15.1.A01.1.454.CMB.1.raw
  modified_base (233)..(233): a, c, t, g, unknown or other
  misc_feature (233)..(233): n is a, c, g, or t
  modified_base (386)..(386): a, c, t, g, unknown or other
  misc_feature (386)..(386): n is a, c, g, or t
tcagtctacgtagccacgaccggtgctcgatttagacgtctcatcaaggaagggaagggggggggtctcaggaggcagcgctctcaggacatctccaccatggcctgggctctgctgctcctcaccctcctcactcagggcacagggtcctgggcccagtctgccctgactcagcctgcctccgtgtctgggtctcttggacagtcgatcaccatctcctgccactggaaccngcaggtgacgttggtacttataactatgtctcctagtaccaacacgaacccaggaccaaacgcccccaaactcatgtatttagtgaggtcagtaacgtccggccctcgtagggtttctaagtccgtcttctctggctacaagtctggacaacngtcggtccctccctagaccactctcgtcgggtccgtccgacggtcgtaggacgggacggagggtacgtagtatttacgttacgtcgtacacgtctactaacgggggggttaactaacgtaacgacgacgacgacgtacctaccgttccgttcggggttacgggttaccggggtaccggggtaaccgggaaccggtaacggtaccgtaccggtaacccggttacccggttacgggtaccggtaaccggacccgaaccggtacccgg

SEQ ID NO: 62039 - DNA, 800 bp, Homo sapiens
  misc_feature: GYAE6OF01DHQQI.15.1.A01.1.454.CMB.1.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttggggtatcacttgtctctggtaccacacctacccggcagacgaccccaatcattcgtatttactgacggaccaataagccgaccctgaggtcctttactagtcgtcctttctccgtcggcctaccgtaacgtcgttcggaccaaaccgacccggtccccttaccccgtaggaacccttaagtcccgttcggtaccgggtccttcccgacggacccgttacggtaacccggaacggtacgggttaaacttttaaacgtttaccgttaaccgtggtacccgttacgtacccgttactaaacgttaacgttaacgggttaaacggtttaacttaaaaccttaaccgtttaaactttaaccggttaacgggtttaccggggaaccggggttaaacggaaacccggtaaacgtcccggttaacggtacccgttaccgttcggaccgttaccgacccggtacccgtaaacgggtcccttaccccggtacccccgttcggtacccgtaccgttcccgttaaccccgttcccccgtaccccgttcccgttaccggtacccttacgggttacggaacccgttcggggacgtcccgggacgggtccgtacgggaaccggg

SEQ ID NO: 62040 - DNA, 555 bp, Homo sapiens
  misc_feature: GYAE6OF01A3R3O.15.1.A01.1.454.CMB.1.raw
  modified_base (320)..(320): a, c, t, g, unknown or other
  misc_feature (320)..(320): n is a, c, g, or t
  modified_base (386)..(386): a, c, t, g, unknown or other
  misc_feature (386)..(386): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagacgcccccaaactcatgatttatgaggccactaagccgaccctcagggtctttctaactcgctttctctgctccaagtctggcaacnccggcctccctgacatctcgtgggctcaggctgaccgacgaggacttaatttacttactgctgctnatatagtaagttataactactatactagttcggacggaggaccacgcgtcgaccgtctgccgtcacgcccgaacgtcctccgtccccgtcgcctaccttccgtccggttcccccgccctccctccgccttaccgtacgtcgtacggacggcgggcgtgggcgtaacggg

SEQ ID NO: 62041 - DNA, 706 bp, Homo sapiens
  misc_feature: GYAE6OF01EGYE6.15.1.A01.1.454.CMB.1.raw
  modified_base (209)..(209): a, c, t, g, unknown or other
  misc_feature (209)..(209): n is a, c, g, or t
  modified_base (242)..(242): a, c, t, g, unknown or other
  misc_feature (242)..(242): n is a, c, g, or t
  modified_base (324)..(324): a, c, t, g, unknown or other
  misc_feature (324)..(324): n is a, c, g, or t
  modified_base (329)..(329): a, c, t, g, unknown or other
  misc_feature (329)..(329): n is a, c, g, or t
  modified_base (334)..(334): a, c, t, g, unknown or other
  misc_feature (334)..(334): n is a, c, g, or t
  modified_base (340)..(340): a, c, t, g, unknown or other
  misc_feature (340)..(340): n is a, c, g, or t
tcagtctacgtagccacgaccggtgctcgatttagacgtctcatcaagggaagggaagggggggggtctcaggaggcagcgctctcaggacatcctccaccatggcctgggctctgctgctcctcaccctcctcactcagggcacgagggtcctgggcccagtcctcgccctgactcagcctgccctccgtgtcgtggtctcgtggacngtcatcacctatcctcctgcacgtacggaaccngcaggtcgtacgttagtaacttaataactattcgtcctccgtagtaaccaacacgaaccgagaccaaccgaccccaatcatntattngagtnagtacncgcctagtggttactactcgtcttcgtctcggtcctacgtacgtcgtagtacctaacgtcgttcccggtccccttacctacgtaccctacgttcccgtaccggtccgggtacctacccggtaggtccggttaacgggacgggtaaccgtacgggttacgttagttaaacttttacgtaccgtcgtaacccgtacgtacctaactaagttaacgaaccgtaacgaccagtcctaccgtcctaacccggttcgggttaccggggttaccgtcggggaaccggttacggggaaacccttcggtacccgtaccggaaccccggtttacgtaaccgggtacccgaccggtaaacccggtcgttacccccgg

SEQ ID NO: 62042 - DNA, 753 bp, Homo sapiens
  misc_feature: GYAE6OF01CAA3X.15.1.A01.1.454.CMB.1.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttggggttatcgtaccttgtcctccgtacggtaccaaccacccgaccccggcacgaccgacccccaaactcatagtatttagtacgacggaccaacgtaacgccgtaccctcgacgggtctttactaatccgtctttctcgtcggtcctccgaagtcgtgaccaaccaccggccctcccgtagaacctatcctcgtcgggccctaccgacggtcgtacggaaccgtaacggtacggtaactttaaactttactttaccgtgtaccgttacgtacctactaagttagtaacgggttaaaggtttaaactaaccgttaacctttaaacgttaccggttacgggtttaccggggaaccggggtaaccgggtaacctaaccggtccgttacccggtaccccgtcgttacggtacccgtaccgaaccgggtccccgtaacgggtccctccccggacccccgttccggtaccctccgtttccccgttacccgttccccccgcccgtttcccgtacccgtacgtaaccggtacgtaccggtaggccgggcgggtccgtgggacgtaaccggg

SEQ ID NO: 62043 - DNA, 617 bp, Homo sapiens
  misc_feature: GYAE6OF01ETGK5.15.1.A01.1.454.CMB.1.raw
  modified_base (442)..(442): a, c, t, g, unknown or other
  misc_feature (442)..(442): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgagttggttgggggttatctaccttgtctcctggtaccaaccaccaccccggcacgaccgacccccaaactcatgtatttagtgacggccaactaacgccgacctcgacggtctttctaatcgtctttctcgtggcctaccgaagtcgtcggacaaccgaccggccctccctagactaactcgtcgtgggcctcgaggctaggacgacgaggtacttaaatttacttactgctcgtctactatagtaggtaaagttaanaaactactatacgtagtcgggacggacggaaccagctcgaccgtctcgcgtcgacgaccgacgtcctccgtaccccgtcgtcctaccttccgtcccgttcccccgacccttcccgtaccggtaccgttaaccggtacgaccgttacggacgggcccgggcgtcggacggaacggg

SEQ ID NO: 62044 - DNA, 625 bp, Homo sapiens
  misc_feature: GYAE6OF01DCE5C.15.1.A01.1.454.CMB.1.raw
  modified_base (262)..(262): a, c, t, g, unknown or other
  misc_feature (262)..(262): n is a, c, g, or t
  modified_base (285)..(285): a, c, t, g, unknown or other
  misc_feature (285)..(285): n is a, c, g, or t
  modified_base (338)..(338): a, c, t, g, unknown or other
  misc_feature (338)..(338): n is a, c, g, or t
  modified_base (614)..(614): a, c, t, g, unknown or other
  misc_feature (614)..(614): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttggggttatcaccttgtctcctggtaaccaaccacccaccccggcacgacgacccccaaactcatgtatttangacgccaactaacgccgaccctnagggtcctttactaatcgtcctttctcgtggccttccaagtcctggcaaaccncggcctccctagaacctaatctcgtcgggctaccgaggtctagaccggacgaggactttaattaacgtttactggtacctgtacctacaattaagttaagtaaaggtttaactaactaacgttaaattaccgtagttcgggacggacgggaaccgaagtctacggaccgttctgtcgttaccgaacgcccgaaggctcccgaccccgtcgtacctacctccgttccgtccccgtcccttccgtccgcgttacgtagaccgtaggacggcgggtcgnggtccgaacgg

SEQ ID NO: 62045 - DNA, 835 bp, Homo sapiens
  misc_feature: GYAE6OF01ARL6K.15.1.A01.1.454.CMB.1.raw
tcagtctacgtagccacgaccggtgctcgatttagacgtctcatcagggcctgggctctgctgctcctcactctcctcactcaggacacagggtcctgggcccagtctgccctgactcagcctgcctcgtgtctgggtctctggacagtcgatcacctatctcctgcacgtggaaccagcagtgagtggttggggttatctactttgtcctccgtaggtaaccaacacccgacccggcacgaccgacccccaaatcatgtatttagtcgacggccaacgtaacgccgaaccctcgtaacgggttctttactaagtccggtcctttccgtcgttcggacccttaccgaaggttccgtagggacctaaaccggtcccgggtccccttacccgtagtaacctaacttccgtacggtcggggacccttaccggaacgggtaccgtttacggaaccggtaccgggtaaacggtaccctttaaaagtttttacgtttaaccgttcggtaacccgttcggtaaccctttcgtaatttaaggtaacgggtttaaaacgggtttaaacttaaaaccggtaaccttttaaacgttaaacccgtttaggggtttacccgggggaaacggggtaaacccgggtaaacccgtaaggtttacccgttaacgggtaccccgtttacgtaaccgtaccggttacccgaaccgggtaccccggtaaaccggtcccgttaaccccggtcccccggttcggttacccttaccgttcccggttacccgttccccgccccgtttccgtaccgtcgtacgttacgacgttcggtacgggcgttcggcggagtaccgg

SEQ ID NO: 62046 - DNA, 557 bp, Homo sapiens
  misc_feature: GYAE6OF01AUYZ5.15.1.A01.1.454.CMB.1.raw
  modified_base (324)..(324): a, c, t, g, unknown or other
  misc_feature (324)..(324): n is a, c, g, or t
  modified_base (333)..(333): a, c, t, g, unknown or other
  misc_feature (333)..(333): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcaccttgtctcctggtaccaacaccacccggcagacgccccaaactcatgatttatgaggccactaagccgaccctcgagggtctttctaatcgtcttctctggctcaagtctggcacacgcctccngacatctcnggcctcagctgacgacgaggactaatattactgtctgctactatagtagtaagttaataactactatactagttcggacggaggaccagcgtcgaccgtcgtgcgtcgacgaccgacgcctccgcccccgtcgtacctaccttccgttccgttacccccgccccttcccgtcccgtccgttacgtaccggtacgtcggaccggcgggcgtgggaccgaaccggg

SEQ ID NO: 62047 - DNA, 925 bp, Homo sapiens
  misc_feature: GYAE6OF01DY4LA.15.1.A01.1.454.CMB.1.raw
  modified_base (179)..(179): a, c, t, g, unknown or other
  misc_feature (179)..(179): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactcggaaccngcagtgagttgggttgggggttactcctacctttgtccttccgtacggtaacccaaaccaccccgaccccggacaacgaaccgacccccaaaactcaatgtattttagcggacggacctaacgtaacgccgaccctacgtacgggtctttactaacttccgtctttcctcgtcggtacctaccgtaagttccgtaggaccaaaccgtacccggtccccttaccccgtagtaacctaacgttccgttccggtcgggtcctaccggacggtccgtacggaaacccggtaacggacggtttaaacctttaaagttttaacgtttaaccgttcggtaccttacggtacccttaactaaagtttaacgttaaggggtttaaaaacggtttaaacgttaaaaccttaaaccgtttaaacgtttaaacccggtttaacgggttacccggggggtaaaccggggtaaaccgggggtaaaccccgtaacggtaccccggtttacccgggtaaacccccggtttccggttacccgggttacccggttaacccggaaaccccgggtaacccccggtaaacccggggttcccgttaccccccgggtacccccccggtttaaccgggttaccccttacccccggtttaccccgttacccccggtttaccccccctaacccccgtttccccgttaacggtacccgttaaccgggtaccgtacggttacggacgggtccggtacgtcgggacggtaacggg

SEQ ID NO: 62048 - DNA, 530 bp, Homo sapiens
  misc_feature: GYAE6OF01A2Y61.15.1.A01.1.454.CMB.1.raw
  modified_base (255)..(255): a, c, t, g, unknown or other
  misc_feature (255)..(255): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcaccttgtctcctggtaccaacaccaccccggcagacgcccccaaactcatgatttangaggccactaagcgaccctcagggctttctaatcgcttctctggctccaagtctggcaacaccggcctccctgacaatcctcgtgggctccgaggctgacgacgaggctaattatactgctagctcatatgaaggttataacactaatactattcggcggaggaccaagctgaccgtctgcgtcacgcccaacggcctcgccccctcggtccaccgtcctcgttccccaccctcctccgtcctacgtacgacgtcggacgcgggctggcgaacgg

SEQ ID NO: 62049 - DNA, 537 bp, Homo sapiens
  misc_feature: GYAE6OF01DGTRJ.15.1.A01.1.454.CMB.1.raw
  modified_base (445)..(445): a, c, t, g, unknown or other
  misc_feature (445)..(445): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttggggttatcgaccttgtctcctggtaacccaacacccaccccggcagacgacccccaaactcatgattatgaggccactaacgcgaccctcgacggtctttctaatcgtctttctcgtcggtctccaagtctggcaacacggccctcctagacaatctcgtggctcgagctagacgacgagcttattatactgctgctcatatagaagttataactactatactagtcgggcggaaggaccaagctcgaccgtcngcgtcacgccgagcctcgcccctcggtcctacctcttccgtcccctacccgtcctcgcgtactacgacgtcgacggcggacgtggcaacggg

SEQ ID NO: 62050 - DNA, 587 bp, Homo sapiens
  misc_feature: GYAE6OF01BQK20.15.1.A01.1.454.CMB.1.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcaccttgtctcctggtaccaacacccaccccggcagacgcccccaaatcatgatttatgaggccactaagccgaccctcgagggtctttactaatcgcttctcgtggcctcgaagtctggacacacggcctcctgacaatctcgtggctcgagctaggacgacgaggtacttaattacttacgtgtctcgctactatagtagtaaaggttaactaaactacttaatacttagttacgggacggacggaccaagtctcgaccgtcgtgccgtacaccgtacccgaacggcctcccgccccgtcggtcctaccttccgtccgttcccccaccccttcccgtccgtccgttaacgtacgtaccgtcggacggcgggcgtcgggcgtaaccggg

SEQ ID NO: 62051 - DNA, 710 bp, Homo sapiens
  misc_feature: GYAE6OF01DNDV4.15.1.A01.1.454.CMB.1.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgagttggttggggttactctaccttgtcctcctcggtacccaaccacccgaccccggcacgaccgaccccaaactcatgtatttatgacggacctaactaacgccgtacctcgtacggtctttactaactcgtctttcgtcgtcggtcctaccgtacgttcgtcggaccaaccgtacccggtccccttacccgtacgtaacctaacttccgtcgtcgggtaccctaccggacggtcgtacggaccggtaaccggtaggtaactttaaatttacgttacgtcgtctcgtactactagttagtaaggtaaacgttaataaactaacttaacttacgttacgttacgggacgggtaacggaaccgtaacggtcgtaccggtacccgttcgtcggtaccgtaccgaccgtacccgaccggttccgtccccggtccccgtcgtacccttccgttaccgttccccggttccccgtccccttccgtccgtaccgttaccgtacgacgtcggacggcgggtcgcgggacgtacgg

SEQ ID NO: 62052 - DNA, 838 bp, Homo sapiens
  misc_feature: GYAE6OF01A91EC.15.1.A01.1.454.CMB.1.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttggggttatctaccttgtctcctcggtaccaacacccgacccggcacgaccgacccccaaactccatgtactttagtcggacggccaactaacgccgacctcgacggtctttacgtaactccgtctttcctcgtcggtcctaccgaagttccgttacgggacctaaaccgacccgggtccccttaccccgtaggtaacccgtaaacttccgtaccggttcggggtacccttcccgaacggggtcctacgggaaacccggaacggtaacgggtaactttaaaactttacgtttaacgtcgtaccttcggtaacttaccgtaaagtttagttaacggttaaacggtttaacctaaacgtaacctttaaagttaaccggttacgttacccggggaaccggggtaacgggtaaaccctaacggtccgttaaccggtacccgtttacccggtacggccggttaacccgaacccgggtaccccgtaaacggggtccccttaccccggtacccccgttaacccgggttccttaacccgtttcccgtacccccgttttaacccccgtccccttacccgtacccgggttacccgttaaaccggttaggtacccggttagggaccggtcccggggtctaccggggaaccgtaaccgggg

SEQ ID NO: 62053 - DNA, 773 bp, Homo sapiens
  misc_feature: GYAE6OF01A5TAD.15.1.A01.1.454.CMB.1.raw
  modified_base (263)..(263): a, c, t, g, unknown or other
  misc_feature (263)..(263): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgattggttggggttatctaccttgtctcctggtaaccaacaccaccccggcacgaccgaccccaaactcactgtatttanggacgccaactaagccgaaccctcgtacgggtctttactaacgtccgtctttcctcgtcggtcctaccgaagttccgtcggaccaaacgccgggtccccttcccgtagaaccaacgttccgtacgtcggggtacctccggaggtcctacggaacgacggtaggtaaccttaaagtttacttacgtcgtcgttcgtactactaattacgtaggtaaagttaaactaacacttaataacttacgttcgggacggaacgggaaccaacggtcgttaacggcccgtttcgtaggtaccccgttacggaaccggaccccgtaagggtcccttcccccgggtaccccccggttaacgggtcccttaaaccgtttccccgggttaccccgtttaccccccctaaacccccggtttcccgttacccggttaccccggttaaaacccgttacgggtaaacccttcggggggaacccggtacccgggggtttacggaacccgggtacggaaacccggggg

SEQ ID NO: 62054 - DNA, 791 bp, Homo sapiens
  misc_feature: GYAE6OF01BNM7K.15.1.A01.1.454.CMB.1.raw
  modified_base (255)..(255): a, c, t, g, unknown or other
  misc_feature (255)..(255): n is a, c, g, or t
tcagtctacgtagccacgaccggtgctcgatttagacgtctcatcagggcctgggctctgctgctcctcactctcctcactcaggacacagggtcctgggcccaatctgccctgactcagcctgcctccgtgtctgggtctcctggacagtcgatcaccatctcctgcactggaaccagcagtgagtggttggggttatcacttgtctctcgtaaccaacacccacccggcacgacgaccccaaatcatgattangacgacactaagccgtacctgaggtctttactaatccgtcttctcgtacggcctaccgaagttcgtacggaccaaccgaccggccccttacccgtacgaactaacgttcctcggcggggtacctaccggaggtcgtaggaaccgggaacggaacggttaacctttaaaattttaacgtttaaccgtggtacttacggtaccttaaccttaaagtaaagtttaagggttaaaacgggtttaaactaaacctaaaccttaaagttaaccgtttaacgggttaccggggaaccggggaacggggtaaaccccgtaaaggtcccggttaaccggtaaccccgttaccggttacggtacccggtaccgaacccgggtaaccccgtaacgggtccccgttacccccggtacccccggttacccgggtacctacccgttcccgttaacccggttccccccgtcccttaccccgtccggttaaccgtaaccggttaacggaccgttacgggaccggtaccggggtcgtacgggaccgaaacggg

SEQ ID NO: 62055 - DNA, 776 bp, Homo sapiens
  misc_feature: GYAE6OF01CG8EQ.15.1.A01.1.454.CMB.1.raw
  modified_base (245)..(245): a, c, t, g, unknown or other
  misc_feature (245)..(245): n is a, c, g, or t
  modified_base (249)..(249): a, c, t, g, unknown or other
  misc_feature (249)..(249): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctctgcactggaaccagcagtgatggttggggttatcaccttgtctcctggtaccaacaccgaccccggcagacgaccccaaancatntattatgacggccaactaacgccgaccctcgagggtctttactaactcgtcttctcgtcggcctaccgaagtcgtacggaccaaaccgccggtcccttacccgtacgaactaacttcctacggtcggcctaccgaggtctacggacggaacggtaggtacctttaaagtttaactttacgtcggtctcgtacgtctaattaagtaacggttaaaaggttaacttaaacctaacgttaaacgtttaacgtttaacggttaccggggtaacgggtaaaccggggtaacccgtaaaccggtccgttaccggttacccggtccgttacggtaccggtaccgaacccggtaccccggtaaccgtccccgttaccccggtccccccggttacggttacccgtacccgttacccgtttccccgttaccccccgtacccccgttacccgttacccggtacccgtttaaaccggtaacggttaaccgtcgggtaaccgggtcccggggtcggtaccggggttaccggaaaccgggg

SEQ ID NO: 62056 - DNA, 178 bp, Homo sapiens
  misc_feature: GYAE6OF01AYJO7.15.1.A01.1.454.CMB.1.raw
  modified_base (178)..(178): a, c, t, g, unknown or other
  misc_feature (178)..(178): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccn

SEQ ID NO: 62057 - DNA, 689 bp, Homo sapiens
  misc_feature: GYAE6OF01EACDF.15.1.A01.1.454.CMB.1.raw
  modified_base (274)..(274): a, c, t, g, unknown or other
  misc_feature (274)..(274): n is a, c, g, or t
  modified_base (650)..(650): a, c, t, g, unknown or other
  misc_feature (650)..(650): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgagttggttgggggttatcaccgtttgtcttccgtcggtaacccaaccacccgaccccggcacgaccgacccccaaatcatagtatttagngacggccaactaacgccgacctgaggtctttactaattcgtcttctcgtggcctaccgtaagtcgtggaccaaccgaccggtcctcccgagactagtctcgtcggctccgaggctaggacgacgagtactaattatacgtgctcgctactatacgtaggtaaacgtttaactaaacgtacttaacttacgttacggttacggggaaccggtaacgggaaccaacggtccgttaccgggtacccgttccggtcggaccgttaccgaaccggtaccccggaacggtcccttccccgggtcccccgtttacggtaccccttaccgtttcccgtccggtttcccccgtccccgttacccgttcccgtacgtaaccggtanaccggttggaacgggtcggacgtcggaacggtaaccggg

SEQ ID NO: 62058 - DNA, 677 bp, Homo sapiens
  misc_feature: GYAE6OF01A8720.15.1.A01.1.454.CMB.1.raw
  modified_base (269)..(269): a, c, t, g, unknown or other
  misc_feature (269)..(269): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgtagttggtttggggttatctaccttgtcctcctggtaccaaccacccaccccggcacgaccgacccccaaactcatgtatttagngacggaccaactaacgccgaccctcgtacgggtctttactaatcgtcctttctcgtcggctacctagtctggaccaacgaccgtccctcccgtagaactaactccgtcgtcgggcctccggacggtacgtacggaccggacggtacggtaactttaaacgtttacgtttacctgtcgtcgactctaagttagtacggtaaagttaactaactacttacttaactaggtccgggacggaacggaccaaggtctccgaccgttcgtgaccgtccaaccgacccgtaaggtcccgtccccgtccccgtccgtccgtaccgttcccgtcccgttcccccggtcccgtacccgttccgtccgttaaccgggttacgtacgtacgggaccggaccgggtcgagggaccgtacgg

SEQ ID NO: 62059 - DNA, 616 bp, Homo sapiens
  misc_feature: GYAE6OF01DRYRZ.15.1.A01.1.454.CMB.1.raw
  modified_base (319)..(319): a, c, t, g, unknown or other
  misc_feature (319)..(319): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcacttgtctcctgtaccaacaccacccgcagacgccccaaactcatgatttatgacggccaacgtaagccgaccctacgagggtctttactaatcgcttctctggctccaagtctggcaacncggcctcctgacaatctcgtggctcgaggtctgacgacgaggcttaattattatcgctgctactattatagtaaagttataaacaactaatactacgttcgggacggaacggaccaaggtcgtacgtacccgtcgtacgaccgttcgaaccgacccgaaggtcccgttcccgtacccccgttaccgggtaccctaacccgttccgttacccgttcccccgtacccccgtttcccgtccggtacccgttaccggttacgaccgttggtaacggcgggtacgtcgggaccgtaaacggg

SEQ ID NO: 62060 - DNA, 551 bp, Homo sapiens
  misc_feature: GYAE6OF01CTH18.15.1.A01.1.454.CMB.1.raw
  modified_base (228)..(228): a, c, t, g, unknown or other
  misc_feature (228)..(228): n is a, c, g, or t
  modified_base (381)..(381): a, c, t, g, unknown or other
  misc_feature (381)..(381): n is a, c, g, or t
  modified_base (399)..(399): a, c, t, g, unknown or other
  misc_feature (399)..(399): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttggggttatcacttgtctctggtaccaacaccacccggnactacgaccccaaactcatgattatgagccactaagcgacctcacggctttacaactcgtcttctcgtcgctaccaagtctcggacaaacacggccctcctagaacaactctcgtgggctcgagctgacgacgagctaatatactgctgctanatagtgaaagttataaanactaatactagttcgggacggaacggacaagcgtggaaccgtccgtagccgttcgacgacccgtaaggctaccgcccaaccgtcgtaccacttcctccgttcccctacccgtcctcgaccttaacgtagacctgaagggcggtgtggaacgg

SEQ ID NO: 62061 - DNA, 579 bp, Homo sapiens
  misc_feature: GYAE6OF01EWDIM.15.1.A01.1.454.CMB.1.raw
  modified_base (245)..(245): a, c, t, g, unknown or other
  misc_feature (245)..(245): n is a, c, g, or t
  modified_base (364)..(364): a, c, t, g, unknown or other
  misc_feature (364)..(364): n is a, c, g, or t
  modified_base (525)..(525): a, c, t, g, unknown or other
  misc_feature (525)..(525): n is a, c, g, or t
tcagtctacgtagccacgaccggtgctcgatttagacgtctcatcagggcctggggctctgctgctcctcactctcctcactcaggacacagggtcctgggcccagtctgccctgactcagcctgcctccgtgtcgtgggtctcctggacagtcgatcaccattctcctgcactggaaccagcagtgagttggtttgggggttatcacctttgtctccgtcgtaaccaaccgacccgaccccggnacgaccgacccccaaactcatgtatttatcgacggacctaacgtaacgccgaccctcgtacggtcctttactaactcgtcttcgtcgttcgctttcccaaaggtcctagggccaaaccnccgggcctcccctagacctaaatccgtactcggggctccgaggcctaggacgacgaaggtctaaatttatactggctgctcataagtgaaagttataaacactatactatcgggacggaggacaagctgacctctgcgcagcccaagcctcgcccctgtcncttcctcgttcccgccctcctcgctacgtagacgtggcgcgggctggccgacgg

SEQ ID NO: 62062 - DNA, 578 bp, Homo sapiens
  misc_feature: GYAE6OF01A9TD4.15.1.A01.1.454.CMB.1.raw
  modified_base (328)..(328): a, c, t, g, unknown or other
  misc_feature (328)..(328): n is a, c, g, or t
  modified_base (385)..(385): a, c, t, g, unknown or other
  misc_feature (385)..(385): n is a, c, g, or t
tcagtctacgtagccacgaccggtgctcgatttagacgtctcatcagggcctgggctctgctgctcctcactctcctcactcaggacacagggtcctgggcccagtctgcccctgactcagcctgcctccgtgtctgggtctcctggacagtcgatcaccatctcctgcactggaaccagcagtgatggttggggttatcaccttgtctcctggtaccaacacccaccccggcacgacgcccccaaactcatgatttatgacggccaactaagccgaccctcgagggtctttctaatcgtcttctcgtggctccaagtctggacaacncggccctcctgacactctctgggctcgaggctggacgacgagtactaattattacgngctgctctatagtagtaagttactaactactatacttagtcgggacggacggtacagctcgaccgtcgtcgcgtccgacgtacccgaggtccgtaccgtcccccgttacggtcctaccgtccttcccggttcccccgccccttcccgtcctccgttaccgtagacgtcggacggccgggctgggacggaacgg

SEQ ID NO: 62063 - DNA, 764 bp, Homo sapiens
  misc_feature: GYAE6OF01AE1YJ.15.1.A01.1.454.CMB.1.raw
tcagtctacgtagccacgaccggtgctcgatttagacgtctcatcagggcctgggctctgctgctcctcactctcctcactcaggacacgagggtcctgggcccagtctgccctgactcagcctgcctccgtgtctggtctcgtgacagtcatcacatctctgcactaggaacagcagtgagttggttggggttactcctaccgtttcgtccttccgtacggtaacccaaccgaccccgaccccggcaaccgtacccgacccccaaagtcctagttagtaatttacgaggaccggacctaaccgtaacgcccgtacccgtacgtacggttcctttactaacgtccgttccgttcttcgtcggaccttaccgtaacgttcgtacggtaccacgtacgtccggtaccctccgttagaacctaacgttcctcggtacggtaccgtaccgaggtccgtacggaacggacgtaacgttacttaagttacttacgcgtactcgtacgtataagttacgtaagtaaacgttaataactaacttaacgtacgttacggtacgggtaacggacggtaccgacggttacccgtacggtacccgtcgtaacggtccgtaccggtaccgtaccgaccggttcccgtaccccgtcccgttaaggtccccttacgttccccggtttaccgtcccccggttacccgtacccggttccgtaacccgttacgggtaccgtaccgggttaggacccgggttacgggtccggtacggaaccgg

SEQ ID NO: 62064 - DNA, 702 bp, Homo sapiens
  misc_feature: GYAE6OF01BQPX6.15.1.A01.1.454.CMB.1.raw
  modified_base (271)..(271): a, c, t, g, unknown or other
  misc_feature (271)..(271): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactcggaaccagcagtgagttggttggggttatctaccgttgtctccgtacggtaaccaaccacccgacccggacacgaccgaccccaaactcatagtattanacgacgaccaacacgccgacctcgtacggtctttactacgtccgtctttccgtctcggcctacgtaacgtcgtacggacaacccgaccggtccctaccctagaactaacgtccgtcggtacggcctcgaacggtcacggtaacgacggacgtaactttaagtttactactgtctgtactagtaataagttaaggttaaacgttaactaaactaacgttaactaacggtttagtaccggggaacggtaacgggaaccgtacgtacgtacgtacccgtcgttacgaccgtaccgaccgtaccggtaacgtcccgttacccgcccccgttagtcctaccttacccgttacccgtaccccgtaccctaccgtacccgttacgacccgttaagacccgtagggaccggaccggtacggtcgggtaacggaaccggg

SEQ ID NO: 62065 - DNA, 889 bp, Homo sapiens
  misc_feature: GYAE6OF01A9ODF.15.1.A01.1.454.CMB.1.raw
tcagtctacgtagccacgaccggtgctcgatttagacgtctcatcagggcctgggctctgctgctcctcactctcctcactcaggacacgagggtcctgggcccagtctcgccctgactcagcctgcctcgtgtcgtgggtctccgtggacagtcgatcaccatctcctgcacgtaggaaccagcagtgtagttgggttggggttactctacctttgtctccgtacggtaaccaaccacccgacccgacacgacccgacccaaagtcagtagtactttaagtacggaccggacctaacgtaacgaccccgtaccgttcgtaacggttccttttacacgttccgtctttcgtcgttcggacctacgtaagttccgacggacctaaccgacccgtccctaccgtacgtaactacgttcgtccggtcggtaccctacgacggtaccgttaaccgggaacgtacggaacgtttaacgtttaaactttacttacgtcgtaccgttgtaacccgtttataaagtttaagttaaacggttaaacgtttaaacgtaaacccgtttaattaaacggtttaaaccggttacgggttaacccggggtaacggggaaaaccgggtaacccgttacggtaacccgggtttaccccgacccgtttaccgggtcccgtacccgggttaacccgaacccggggtacccccggtaaaccgttcccccggttcccccggttaccccggttaccggttacctaaccccttttcccccgggtttaccccccttaccccccgtacccggtttaccccgtaacccggtttaacggttaaacccccgtttaagggccccggttaaggggtcccggggtaaccccggtcggtaacccgggacgggttaaccgg

SEQ ID NO: 62066 - DNA, 619 bp, Homo sapiens
  misc_feature: GYAE6OF01EYAUD.15.1.A01.1.454.CMB.1.raw
  modified_base (232)..(232): a, c, t, g, unknown or other
  misc_feature (232)..(232): n is a, c, g, or t
  modified_base (275)..(275): a, c, t, g, unknown or other
  misc_feature (275)..(275): n is a, c, g, or t
tcagtctacgtagccacgaccggtgctcgatttagacgtctcatcaagggaaggaaggggggggtctcaggaggcagcgctctcaggacatctccaccatggcctgggctctgctgctcctcaccctcctcactcgagggcacagggtcctgggcccagtctgccctgactcagcctgcctccgtgtcgtgggtctcttggacagtcgatcacatctcctgcactggaaccngcagtgacgttggtacttataactatgtctctggtaccaacanaaccagcaaacgccccaatcatgtattatgagtctagtaatcggcctcgtagggtttactaagtcgtacttctcgtcgtctcctaagtcgtaggactaacacgtaccggccccctagacctatcctcgtcggcctccgagtcgtaggtaacggacgtacggcttagtaactttataccgtgacgtacgtctaagtataactaagaacgtacaacgcacgtacctaccgttcggttcgggttccggtacgggacgggtaacgggacccgtaacggccgttaccgggtaacccgttccggttaacgggcctaacggaccccggtaaacggcccgttaccccccggg

SEQ ID NO: 62067 - DNA, 882 bp, Homo sapiens
  misc_feature: GYAE6OF01B1H89.15.1.A01.1.454.CMB.1.raw
tcagtctacgtagccacgaccggtgctcgatttagacgtctcatcagggtcttcgtggctcacgtccaccaccacgcatgtgacctcgaggggtccctgagactctcatgtgcaggctctggattcagcgtcaggaatagttacatggtaggttcgggtccgccgaggcctccgaggggcgaggggctaggaggtggctctactaatgtaactttacgaccggtaggtcgggggacggtcgggaccaactactaacgtacggacaagtacgttccggaggaacgggcagtacttaccgaacctatccgtacgaagaagtaacgtaagttagggaacgaaccgtaccggttagttaactttaactttaaagtaacgtaacgaaccgtacggaccgttaggaacggaccgaccgtaagtaccggacgtaccgggttagttgtacggttttacttcggtagggtacgacggtaacgggtaaacgggtaacgggtttaaatttaaggtttacggtttacggtttacgggttaccgggtacccggtaaccgggggttaccggggtaacccgggtaaaccgggggtacccggttacgggtaccgttaacccggttccggttaccgtacccggttaccgtacccgtaccccgtaacccggaacccggtaacccgggtaccccttaccggtttccccggttaccccttccccggtccggtaaccccttccccgtaacccgtacccgaaacgccgtacccgtacccggtcgggtaccgggaccaccgggtaccggtcccgggcccggttcgggtaccgtcccggtacggttcccggaaaccgttacccggtacccgttacccggtaccggttaacccgtccggtaaccggg

SEQ ID NO: 62068 - DNA, 699 bp, Homo sapiens
  misc_feature: GYAE6OF01ANXXX.15.1.A01.1.454.CMB.1.raw
  modified_base (271)..(271): a, c, t, g, unknown or other
  misc_feature (271)..(271): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtcgtgggtcctccgtggacagtcgatcaccatctcctgcactggaaccagcagtgagttggttggggttatctaccgttgtctccgtcggtaaccaaccacccacccggcacgaccgaccccaaactcatgtatttagnggacgaccaacgtaacgccgaccgtcgacggttctttactactcgtcttctcgtcgcctaccgagtctcggaccaaccgccggtccctccctacgactaactcgtcgtcggctaccgacgctacggacgaacggtacgtactttaagtttacgttacgtgtctacgtcttactaacgttagtaagttaaacgtttaaactaaccgtaacttacgttaaccgttacgggtaccggggacgggaaccggtaaccgaacgtccggttaccggtaaccccgttcggtacggtcccgtaccggtaccgacccggtaacgtccccgtacccgtccccggttacgccttacccgtccgttcccggtccccgttccttaccgttccggacctttacgggacgtaccggtcggaccggtacggtcgtcggacgacgg

SEQ ID NO: 62069 - DNA, 701 bp, Homo sapiens
  misc_feature: GYAE6OF01AVLQP.15.1.A01.1.454.CMB.1.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttggggttatcaccttgtctcctggtaccaacaccaccccggcagacgccccaaactcatgatttatgaggccataagcgaccctcgagggtctttctaatcgcttctctggctccgaagtctgggaccaacgaccggccctcccgtagacctaactcttacgtggggccttccgacggtctggaccgacggaggtaccttaaattttactacgtcgtctagtccgtacattacgtaggtaaacggtttaataaaccgaacttaattaaccgttaggtttaccgggacggggaacgggtaacccaaggtcctacggtaacccccgttcggttacgaccggttcgaacccgggtacccgaaaggttccccgtccgtaccccccgtcgggttccctaccgttccgttcccgggtttccccccgaccccgttcccgttaccggtaccgtttacccgggaagttaacccggtacggacggggtacccggggtcggtaccgggtaccgaaacccgggg

SEQ ID NO: 62070 - DNA, 548 bp, Homo sapiens
  misc_feature: GYAE6OF01DXFE9.15.1.A01.1.454.CMB.1.raw
  modified_base (194)..(194): a, c, t, g, unknown or other
  misc_feature (194)..(194): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctggtctcctggacagtcgatcaccatctcctgcactggaaccagcagtgatgtggggtancacttgtctcctggtaccaacaccacccggcacgacgccccaaactcatgatttatgacggccaactaagccgaccctacgacgggtctttctaatcgtctttctctggctccaagtctggcaacgacgcctccctgacatctcgtcggctaccgagcgtgacgacggagacgttattatactgctgctacgatagtagtaagttataacactatactgttcggcggacgacaagtctacgaccgtctagcgtacgacgaccgagcctacgcccctcggtccacgttcctccggttccccgcccttccgtctccgttacgtacgaccgttgacggccgggctgggcgtaacggg

SEQ ID NO: 62071 - DNA, 511 bp, Homo sapiens
  misc_feature: GYAE6OF01ADOEZ.15.1.A01.1.454.CMB.1.raw
  modified_base (278)..(278): a, c, t, g, unknown or other
  misc_feature (278)..(278): n is a, c, g, or t
  modified_base (413)..(413): a, c, t, g, unknown or other
  misc_feature (413)..(413): n is a, c, g, or t
  modified_base (438)..(438): a, c, t, g, unknown or other
  misc_feature (438)..(438): n is a, c, g, or t
  modified_base (462)..(462): a, c, t, g, unknown or other
  misc_feature (462)..(462): n is a, c, g, or t
  modified_base (482)..(482): a, c, t, g, unknown or other
  misc_feature (482)..(482): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacacccaccccggcacgacgcccccaaactcatgatttatgaggccactaagcgaccctnagggctttctaatcgctttctctggctccaagtctggcaacacggcctcctgacaatctctgggctcaggctgacgacgaggctaaattattactgctgctcatatgtaaggttataactactatactagtcggnggaggacagctgaccgtctgcgtcncgcccaggctccgcccctcggtcnctcctcttccccaccctccncgctacgagactgcgcggctggcgtacgg

SEQ ID NO: 62072 - DNA, 706 bp, Homo sapiens
  misc_feature: GYAE6OF01AY5QZ.15.1.A01.1.454.CMB.1.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctctgcactggaaccagcagtgagttggttggggttactcaccttgtcctcctacgtaaccaacacccgacccggcacgaccgacccctaaactctattcgtatttagtaggacggacccaataacgcccgaccgtcgtaacgggtcctttactaacgtccgtcctttcgtcgtcggtacctacgtaagtcgtcggaccacgccggtcctccctagactactccgtcgcgggcctcgagtcgtacggacgtacgagtacttaatttacgtacgtcgtactcgtacttacagttacgttaaggttaaacgttaactaaacctactttaaacgttacgttacggtacgggaccgggaacggtaacgtaacggccgttaccgtaccgtcgtacggaccgtccgaccgtacccggtacggtaccctcccggtaccccgtccgtacctccgttacccgtccccgtttcccgaccccgtttccgacccggtaaccgttacccggtagtaccggtacgggtaccggccgggtacggtccggacggtaacggg

SEQ ID NO: 62073 - DNA, 666 bp, Homo sapiens
  misc_feature: GYAE6OF01BAVN6.15.1.A01.1.454.CMB.1.raw
  modified_base (260)..(260): a, c, t, g, unknown or other
  misc_feature (260)..(260): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttggggtatcaccttgtctcctggtaccaacacccaccccggcacgacgacccccaaactcatgtatttagngacggccaacgtaacgccgaccctcgagggtctttactaactcgtcttctcgtcggcctccaagtcgtcggaccaacgaccggtccctcctagacctaactcctcgtcgggcctccgacggtctacggaacggacggaacggtacttaaagtttacttacgtcgtctcgcttacgtagttaagtaggtaaagtttacaaactacttaacttactacgttacgggacggacgggtaacagtctacgaccgtcgtcggaccgtacgacgtacccgaacgtcccgtacccgtccccgttcggtcctaccgttcccttcccgttaccccctccccgttccgtaccggtaccgttaaccggtacgtacccggtcggtaccgggccgggtaccgtgggaaccggtaaccggg

SEQ ID NO: 62074 - DNA, 702 bp, Homo sapiens
  misc_feature: GYAE6OF01DLNXQ.15.1.A01.1.454.CMB.1.raw
  modified_base (197)..(197): a, c, t, g, unknown or other
  misc_feature (197)..(197): n is a, c, g, or t
  modified_base (257)..(257): a, c, t, g, unknown or other
  misc_feature (257)..(257): n is a, c, g, or t
  modified_base (686)..(686): a, c, t, g, unknown or other
  misc_feature (686)..(686): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctcgtgtctgggtctctggacagtcgatcaccatctcctgcactggaaccagcagtgagtggttggggtacnctacttgtctcctggtaccaacaccacccggcacgacgacccctaaatcatgtatttagngacggccaacttacgaccgacctgacggtctttactaacgtcgtctttctcgtcggtactccctaaggtctacggacctaaccgtccggtaccctaccctaggtaactaacttccgtcgtcggggccttacgacggtcgtacgaccgtaggacgtacttaattacttactcgtacgtcgtacttacattaacgttagtaaagttactaacgtaacttaacgttacgttacggttacgggacgggtaacggaaccgtaacggttcgtaccgtcccggttaacgtcggtaccgtaccggtaaccgtacccggtaacggtccctcccggtaccccgttcggttaacccacccgtttccgttccgtcccccgtcccgttacccgtacggtacccgttaacgggtccgacggtacggtacggtccgggttaacnccggtaaacgaccggg

SEQ ID NO: 62075 - DNA, 778 bp, Homo sapiens
  misc_feature: GYAE6OF01C88BQ.15.1.A01.1.454.CMB.1.raw
  modified_base (757)..(757): a, c, t, g, unknown or other
  misc_feature (757)..(757): n is a, c, g, or t
tcagtctacgtagccacgaccggtgctcgatttagacgtctcatcagggcctgggctctgctgctcctcactctcctcactcgaggacacacgggtcctgggcccagtctcgccctgactcagcctgcctcgtgtctgggtctctggacagtcgatcacatctctgcactgacagcagtgagttggttggggttactcctaccgttcgttcctaccgttacggtaaccaaccgacccgaccccggacaacgaccgtaccccaaactcagtagtactttagtacgacggtaccaacgtaaccggtccgtaacccgtcgtaacgggttccttttacgtaacgttcccgtacctttccgtcgttaccggacctaccgtaacgttcgtacggaccaaaccgtcccggtcccgttaccccaggtaacctaacttccgttacggtccggtaccgttaccggacggttaccgtacggaaaccgggtaggtaacggtttaacctttaagtttaaaccggtttatcggtcgttaccgtacttaaccgtagttaaacgttacggtaaacggtttaaacaaaccgttagttaccttagtaacggtttcgggtaacgggaaccgacgtaaacggtcgtaacgtcccggtcctaacgcgttaccgaaccgtaccgacgtctacccggtccccggttaacgtaccctcggttacccttccggttaccccgtcctaccggttacgtccgtaaccggtagtccggtacggacnccggggtactgggacctacgg

SEQ ID NO: 62076 - DNA, 726 bp, Homo sapiens
  misc_feature: GYAE6OF01B8H7P.15.1.A01.1.454.CMB.1.raw
  modified_base (124)..(124): a, c, t, g, unknown or other
  misc_feature (124)..(124): n is a, c, g, or t
  modified_base (237)..(237): a, c, t, g, unknown or other
  misc_feature (237)..(237): n is a, c, g, or t
  modified_base (252)..(252): a, c, t, g, unknown or other
  misc_feature (252)..(252): n is a, c, g, or t
tcagtctacgtagccacgaccggtgctcgatttagacgtctcatcaaggaagggaaggggggggggtctcaggaggcagcgctctcaggacatctccaccatggcctgggctctgctgcctccnccaccctcctcactcgagggcacgacgggtccgtcgggcccagtcctcgccctgactcacgcctcgcctccgtgtcgtggtcttcgtggacgtgtcgactccacactctcctnccgacgtacgaaccngacgaggttcgtacggttacgttaacttaagttaacttgtaccgttccttccgtaacggtaaccaaccgaaccgtaaacccgacggaaccccgaaaacccctacccccaaactcgtaattaggtacgttttagacggtaggtaacctaagttaaccgtcccggtacctttaggggttacggtttacctacgtcgttcttaccgtcggtcgaccttacggtaattaccggagtaaccgacgtacggttcctaccccgtcccgtagaccgttactcgttaccggtccggtacgtaccggtcggtacggtaacgggacgggtaggacgggtctaagtttagttacgttcgatccgactcttagaacgttaactacaacgcgtaacgactacgtcctggttacggttgggtaccgtcggggacgtacggaacgtgtacccggtcgaccgtcccgagtacccggaccgcgtcgtcccgg

SEQ ID NO: 62077 - DNA, 835 bp, Homo sapiens
  misc_feature: GYAE6OF01AXVX9.15.1.A01.1.454.CMB.1.raw
tcagtctacgtagccacgaccggtgctcgatttagacgtctcatcagggcctgggctctgctgctcctcactctcctcactcaggacacagggtcctgggcccagtctgccctgactcagcctgcctcgtgtctgggtctcctggacagtcgatccaccatcctccgtgcacgtaggaaccagcagtgtagtgggttaggggttactcctaccttagtcctccgtacggtaaccaaccgaccccgaccccggacaacgtacccgacccccaaactccatagtatttagaggaccgtacccaacgtaacgacccgaccgtacgtacgggtcctttacttactccgtactttccgtcgtcgactaccagtcgtcggacaacgtaccgcccttaccacgtaactacgttcgtcgtcggtccgtacgaggtcctaacggaccgaacggtacgtacctttaaatttacgttacgtcgtacgttgtcctacgttaattaaggttaacggttaaaaggtttaaacccttaaacgttaaccgtttaacgttaaccggtttacgtacccggggggtaacggtaaccggggaaccctaacggtaccgttacccggttacccgttccgtacgggtacccgtaaccggaccggtaacccccgtaacggttccccggtaccccgtaccccgttaccggtccctttaccccggttaccccgttacccccggtttaaccccccgtcccccgttttaccccgtacccgggtttacccttaacgggtaacccgtaccggttacccggggtaccgggtacccggggcccgggtaccggaaccgggttaaacgg

SEQ ID NO: 62078 - DNA, 845 bp, Homo sapiens
  misc_feature: GYAE6OF01BFKF0.15.1.A01.1.454.CMB.1.raw
  modified_base (214)..(214): a, c, t, g, unknown or other
  misc_feature (214)..(214): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcacactctcctgcactacggaacctagcagtgattgggttggggttactctaccgtttntcctccgtacggtacccaaccacccgaccccggacaccgaaccgaccccaaactcactagtagtttagtacgacggaccaactaacggacctaccgtcggtacggtcttttaccgtaacgtccgtcctttccgtcgtcggtacctaccggtacgtcgtacggaacctacccggtacccgtcccgttacccgtaacggaccttaaccgtccgttccggaccggtcctacccggacggtccggtaaccggaaacgggtaacggtaacggttactttaaacgttttacgtacgtcgtacgttactacttacgttaagtttaacggtaacggttaaaacgttaactaaacttaacgttaatttaccggtacgggttaccgggggtaaccggaacggtaacccgtaacggtccgtccgggtaacccgttacgtccggtaccggtacccgaccggtacccggtaacccgtccccgttaccccggaccccgtttccggaccccgttaccttcccccgggttacccccgttacccccgtcccggtttaccccgtaccgggttacggttaaccccggttaacggaccgggggttaccgacccggggttacggtacccggtagggtacccgggaaacccgg

SEQ ID NO: 62079 - DNA, 761 bp, Homo sapiens
  misc_feature: GYAE6OF01CTIFW.15.1.A01.1.454.CMB.1.raw
  modified_base (199)..(199): a, c, t, g, unknown or other
  misc_feature (199)..(199): n is a, c, g, or t
  modified_base (218)..(218): a, c, t, g, unknown or other
  misc_feature (218)..(218): n is a, c, g, or t
tcagtctacgtagccacgaccggtgctcgatttagacgtctcatcagggtccgtgggctctgctgctcctcactctcctcactcaggacacgaggtcctggcccagtctcgccctgactcagcctgcctcgtgtctgggtctcctggacagtcgatcacctatcgtcctgcactggaaccagcagtgagtggtgggtanctactgtctcgtgaccacnccgaccgcagaccacccaatcagtagtatttagacgacggacctaagtacgacccgtaaccgtcgtacggttacctttacgtaacttccggtaccttttccgtcgtaaccggtccttaaccgtaacggtttcggtaccggacctaaacccgacccgggtcccctaccggttagaaccctaacgttccgtaccggtacggttcccgtaccggtaacggtccgtaacggaaccggtacggtaacggtttaacttaaacgtttcgtttaacggctccggtactcgttaactaattaccgtaaggttaacgttaactaaaccgttactaacgttacgtaacgggttccgggaacggaacgtacacgtccgtgtaacccgtgttcgaccgttacggacccgtaccggtaccgtccgtaaccccgtccccgtaacggttcctcccggttacccttcccggtaacccccctcctcccgggttactaacccgttacgggtaccgttaaccggtacggccgggtaacccgttggtccggaaccggttaacgg

SEQ ID NO: 62080 - DNA, 665 bp, Homo sapiens
  misc_feature: GYAE6OF01BQ7PB.15.1.A01.1.454.CMB.1.raw
tcagtctacgtagccacgaccggtgctcgatttagacgtctcatcagggcctgggctctgctgctcctcactctcctcactcaggacacaggtcctgggcccagtctgccctgactcagcctgcctccgtgtctggtctcctggacagtcgatcaccatctcctgcactggaaccagcagtgatggttggggttatcaccttgtctcctggtaccaaccacccgaccccggcacgacaccccaaactcatgtattatgacgaccactaacgccgacctcgaggtctttactaatcgtcttctcgtcggtcctacgtagtcgtggaccaaccgtaccggtccctcccgtagaacctaacgttcctcgtacgggtcctaccgaggtccgtacggaacgacggtaacggtacttaaacgtttacttaccgtgtacttgtcctacgtaatacgttagtaaacggttactaaactacgttaatacgtacgtcgggacggacggtaccagtcgtacgaccgtctcgtctacgacgacccgtaaggtccctcccgtccccgtacgtccgtaccttccgttccccgttccccgtcccccgttccctccggtcccgttaacggttaccggaccggttcgggaccgggtcccgggacggtccggaccgtaccggg

SEQ ID NO: 62081 - DNA, 704 bp, Homo sapiens
  misc_feature: GYAE6OF01BKCKT.15.1.A01.1.454.CMB.1.raw
  modified_base (270)..(270): a, c, t, g, unknown or other
  misc_feature (270)..(270): n is a, c, g, or t
tcagtctacgtagccacgaccggtgctcgatttagacgtctcatcagggcctgggctctgctgctcctcactctcctcactcaggacacaggtcctgggcccagtctgccctgactcagcctgcctccgtgtcgtgggtctcctggacagtcgatcaccatctcctgcactaggaaccagcagtgagttggttggggttatcaccttgtcctccgtacgtaaccaaccacccgaccccggcacgaccgacccccaaactcatgtattagngacgaccaacgtaacgccgtacctcgaggtctttactaactcgtcttctcgtcggcctacgaagtcgtcggaaccaaccgaccggtccctacccgtagaacctaacgttccgtaccggtcgggtcctaccggaacggtcgtacggaaccggaacgtaacggtactttaaattacgttacgtcgtcgtacgtctactaattacgtaaggtaaagttaactaactacttaactacgttacggtcgggacggaacggtacgacgtacgtaccgtaccgtcgtcgtaccgtacgaccggtacccgaacggtcccgtaccccgtccccgtacggtacctacccgttccgtaccccgttacccccgtacccgttcccgtacggtaccgttaaccggtacgaccggtaggaccgggccgggtcgtacgggaccgtaccggg

SEQ ID NO: 62082 - DNA, 680 bp, Homo sapiens
  misc_feature: GYAE6OF01AG0H4.15.1.A01.1.454.CMB.1.raw
  modified_base (605)..(605): a, c, t, g, unknown or other
  misc_feature (605)..(605): n is a, c, g, or t
  modified_base (670)..(670): a, c, t, g, unknown or other
  misc_feature (670)..(670): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctctggacagtcgatcaccatctctgcactggaaccagcagtgatgggttggggttatccacctttgtcctccgtcggtaaccaaccacccgaccccggcacggaccgaccccctaaacgtcatacgtattttagcgacggaccctaactaacgcccgacctcgaggtctttacgtaatccgtctttctcgcggtccttaccgacggttccgtacgggaccaacccggtacccgggtccccgtaccctaggtaaccctaacgttcccgtcggtacgggccgttaccgaggtccgtacggaccggtaacggagtacctttaaagttacttacggtgtcttcgtactactaagtagtaacgttaacgttaactaactacttaacttagtacgttcgggacgacggactaagcctacggcctcgcgtaccgtacgcggtacccgacggtccctccggcccctcggtacncccgttacgtccctaccccgtactccccgtagtccgttaccgtactccggaggccggtcgtccgngggtcacggg

SEQ ID NO: 62083 - DNA, 951 bp, Homo sapiens
  misc_feature: GYAE6OF01CQ3KY.15.1.A01.1.454.CMB.1.raw
  modified_base (269)..(269): a, c, t, g, unknown or other
  misc_feature (269)..(269): n is a, c, g, or t
tcagtctacgtagccacgaccggtgctcgatttagacgtctcatcaaggaagggaaggggggggtctcaggaggcagcgctctcaggacatctccaccatggcctgggctctgctgctcctcaccctcctcactcgagggccacgacgggtcctcggggccccaggtctcgccctacgtacctcacggccctcgcccgttccgtgtccgtgggtccttcgttacgacagtcgataccacctattccgacctcgacaccgtaggaaaccngcgtaggttcggtacggtttacggtaactttaacgttaactacgttacgttacctacccgttacggtaaacccaaacgtaaccgaaaccccgaacgaaacccaaaccccgacccccctaaaacgttcctaagttagttaatttacgacggtaacggttaacgtaacgttaaccgtcccggtacccgttacggttaacgggtttacctaaccggtcttccgttacgtaccgtcgtacgtaccgtacgttccggacgtaacgacctacggtcccgtaccccttacccgtaacgtccttaaccgtcccggttcgtacccgggtaccgtaaccgtacggtccgtaacgggaacggggtaccgggtacgtacgtttaacgtttaacgttttacgtaccgttaacgggtacctaaccggttcttaaaaccgtaccgttaaacgtaaaccggttaaccgtaccgaaaccgtaacccgggttaaccgttacccgttttaacccgggtttccggggtttaaaccggggggttttcccgggtaaccgggggaaaccgggggttaccccggtaaaaccccggtacggggttaccccgtaacccggggttaacccgggtttaccccccggaaacggggttttaccccccgaaacccggggttaccccggtaaaccccgttaccccccccggggg

SEQ ID NO: 62084 - DNA, 726 bp, Homo sapiens
  misc_feature: GYAE6OF01CFH93.15.1.A01.1.454.CMB.1.raw
  modified_base (118)..(118): a, c, t, g, unknown or other
  misc_feature (118)..(118): n is a, c, g, or t
  modified_base (181)..(181): a, c, t, g, unknown or other
  misc_feature (181)..(181): n is a, c, g, or t
tcagtctacgtagccacgaccggtgctcgatttagacgtctcatcagggtcttcgtggctcacgtccaccaccacgcatgtgacctcaggggtccctgagactctcatgtgcaggctntggattcagcgtcaggaatagttacatgagttcggtccgccaggctcgaggcaggggctaggngtggtctctacaatgtattaccaccgtagtggggacggtcggaccagatacgtacgcgaagtcgttaccggagaagggcagtacttaccacctactactaccgaagaacgaccttaagttacggaactaacgtaccgtagtaactttactaatacgtacgaaacgcgtccgtaggaccgacgacccggtaataccggaccgtaacggtccgttaagtttccggttaagttttcccgtaggtcggtacgtaaagggtcgttaaacgggttaataacggtttacgttaacggttcggttacgaccgtagggtcggtacgtaccggtaccgtgtcgttacgtcgtcgtacgtacaccgtacctaccgtaccgacggtccctaacgttcccgtccctaccccgtcgtaccccgtacctacccgtacgacctacgccgtacgtccggccggtaccgtaccgtaccggccggtccggtggtacccggttcgacccggttccggtaaccggtacgttaccccgtaaccttccggtaccgtacgttaaccggg

SEQ ID NO: 62085 - DNA, 797 bp, Homo sapiens
  misc_feature: GYAE6OF01AJGR4.15.1.A01.1.454.CMB.1.raw
  modified_base (288)..(288): a, c, t, g, unknown or other
  misc_feature (288)..(288): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatccaccatctcctgcacgtaggaaccagcagtgtagttgggtttaggggttataccgtaccgttcgtccttccgtacggtaacccaaccgaccccgaccccggcacgacccgaccccaactcattactatttanggacggccaacgtaacgccgacctcgtacggtctttactactcgtcttaccgtcgtcgtcctaccgtagtaccgtcgtaaccgaacccgtacccggtcccctacccgtacgaaccttaccgttccgttaccgtaccgggtcccgtaccgacggtcgtaaccgggtacggaaccggacgttaacgtttaaatttaacgttcgtacgtcgtacgtctaacgtagttaagtacggttaaacgttaaacctaactaacgtttaacgtagttaccgggtcgggtaaccggtaaccgaacccgttaggcttacccggtccgtacggtccgaccgacgtacccggacccgtaccggtccccttacccggtaccccgttacgtacccgtacccgtttcccgttacccccggttcccgacccccgtttcggtaacccttccgggttaaccccgttagggtaaccgggtccgggttacgggaccccgggttcggtcccggggtaaacgtaaccccgggg

SEQ ID NO: 62086 - DNA, 669 bp, Homo sapiens
  misc_feature: GYAE6OF01ENKP1.15.1.A01.1.454.CMB.1.raw
  modified_base (177)..(177): a, c, t, g, unknown or other
  misc_feature (177)..(177): n is a, c, g, or t
  modified_base (228)..(228): a, c, t, g, unknown or other
  misc_feature (228)..(228): n is a, c, g, or t
tcagtctacgtagccacgaccggtgctcgatttagacgtctcatcagggcctgggctctgctgctcctcactctcctcactcaggacacaggtcctgggcccagtctgccctgactcagcctgcctccgtgtctgggtctcctggacagtcgatcaccatctcctgcactggaaccngcagtgatgtggggttatcacgttgtctcctggtaccaacacctacccggnacgacgccccaaactcatgtattatgacggcctactaacgccgtaccctcgtaggtctttactaacttcgtcgtttctcttacggtcctaccgtaacgtcctacggaccaaccgtccggccctccttacgactaactcgtcgtacgggctcaggcctagacgacgtaggtacttaattacgttactgacgttcgctagttaactacgttaggtaaacgttttaacaaacctacgttaacttaaccgttacggttacggggtccggtaaacgggaccgtaacggtccttcggaacccgttactacgggtacgtaaccgacggtaaccccggaaggttccccgtccgacccccgttacggtcctaccgttccgtaccgttccccgtcccttcccgtacgtacgtacgtacgtacgtacgtcggaccggcctagggtcaacggg

SEQ ID NO: 62087 - DNA, 976 bp, Homo sapiens
  misc_feature: GYAE6OF01DDXBT.15.1.A01.1.454.CMB.1.raw
tcagtctacgtagccacgaccggtgctcgatttagacgtctcatcagggcctgggctctgctgctcctcactctcctcactcaggacacagggtctgggcccagtctgccctgactcagcctgcctccgtgtctgggtctcctggacagtcgatcaccatctcctgcacgtggaaccagcagtgtagttgggtttgggggttatccgtacctttgtaccttcccgttaggtaacccaaccgaccccgaccccggacacggacccgaaccccccaaaactcctattaggtaattttacgcggaaccggaccctaaacgtaaacggtccccaacccttcggaacggggttacttttacctaacgtcgttcctttaccgttcgtacggtaccttacccgtaaggttccgtacgggaaccaaaccgtacccgggtaccccttaccccgtaacgtaaccgttaacttcccggttacggttccggggtacccgttaccggacgggtacccggttagggtaaacccgggtaacggttaacgggtaaccttttaaaagtttaccggtttaaacgttcgggtacccttaggtacccttaacgttaagttaacggtttaacgggttaaaagggtttaaaccttaaaccgttaaacgtttaacgtttaacccgtttaacggggttacccgggggtaaaccggggtaaccggtaaacccgtaacgttcccggttaacccgggttaccccggttaccgttacggaccgggttaccccgaaaccggggtacccgttaaaccgggttcccccttccccggggttacccccgttcccggggttaacccttacccggtttacccccgttccccgggtttacccccgaccccgtttacccgggttacccggtaacccggtttaaccgggtaccgaacccgggttcgggtaaccccggggtaccgggttaccgggccggaccggggttaacccgg

SEQ ID NO: 62088 - DNA, 510 bp, Homo sapiens
  misc_feature: GYAE6OF02F6UEG.15.1.A01.1.454.CMB.1.raw
tcagtctacgtagccacgaccggtgctcgatttagacgtctcatcagggcctgggctctgctgctcctcactctcctcactcaggacacagggtcctgggcccaatctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggaggaccaagctgaccgtcctgcgtcacgcccaaggctcgcccctcggtccactctcgttcccgccctcctcgcctacgtagactggagcggctggcacgg

SEQ ID NO: 62089 - DNA, 509 bp, Homo sapiens
  misc_feature: GYAE6OF02HTBXU.15.1.A01.1.454.CMB.1.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcaccttgtctcctggtaccaacaccacccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtctgcgtcagcccaaggctcgcccctcgtcactctcgttcccgccctcctcgctaccgtagactcggacgcgggctggcacggg

SEQ ID NO: 62090 - DNA, 422 bp, Homo sapiens
  misc_feature: GYAE6OF02IRT1Z.15.1.A01.1.454.CMB.1.raw
  modified_base (417)..(422): a, c, t, g, unknown or other
  misc_feature (417)..(422): n is a, c, g, or t
tcagtctacgtagccacgaccggtgctcgatttagacgtctcatcaggggctagagtggctctcaatgatttacaccgatggggacggtgggaccacatactacgcagattccgtgaagggcagattcaccatctccagagacaatttggagaacaccgtgattcttaatatgaacagcctgagagccgatgacacggctgtgtatttctgtgcgagagacgggtataatagttactggtttggcgactggggccagggaaccctggtcatcgtctcgtcagcctccaccaagggcccatcggtcttccccctggaacccctcctccaagagcacctctgggggcacagcggccctgggctgcctggtcaaggactactccgctacgtagactgagcgggctggcaaggcgcatagnnnnnn

SEQ ID NO: 62091 - DNA, 503 bp, Homo sapiens
  misc_feature: GYAE6OF02H309Y.15.1.A01.1.454.CMB.1.raw
  modified_base (407)..(407): a, c, t, g, unknown or other
  misc_feature (407)..(407): n is a, c, g, or t
  modified_base (455)..(455): a, c, t, g, unknown or other
  misc_feature (455)..(455): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcaccttgtctcctggtaccaacaccaccccggcagagcccccaaatcatgatttatgaggccactaagcgaccctcagggctttctaatcgccttctctggctccaagtctggcaacacggcctccctgacaatctctgggctccaggctgacgacgagctaattattactgctgctcatatgaaggttataacactatacttattcggnggaggacaagctgaccgtctgcgtcagcccaaggctcgcccctgtccnctcttcgttcccgcctcctcgctacgtgactgagcgggctggctacgg

SEQ ID NO: 62092 - DNA, 508 bp, Homo sapiens
  misc_feature: GYAE6OF02F2Q3R.15.1.A01.1.454.CMB.1.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcgaggaccaagctgaccgtctgcgtcagcccaaggctcgcccctcggtccactctcgttcccaccctcctcgctacgtagactgacgcgggctggcaacgg

SEQ ID NO: 62093 - DNA, 514 bp, Homo sapiens
  misc_feature: GYAE6OF02IOW7Z.15.1.A01.1.454.CMB.1.raw
  modified_base (318)..(318): a, c, t, g, unknown or other
  misc_feature (318)..(318): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagacgcccccaaactcatgatttatgaggccactaagcgacccctcagggctttctaatcgcttctctggctccaagtctggcaacncggcctccctgacaatctctgggctccaggctgacgacgaggctaattattactgctgctcatatgaaggttataaacactatactattcggcggagggaccaagctgaccgtcctgcgtcacgcccaaggctcgcccctcggtcactctcgttcccgccctcctcgctacgtgactgagccggcgtggcaacggg

SEQ ID NO: 62094 - DNA, 514 bp, Homo sapiens
  misc_feature: GYAE6OF02FV1YQ.15.1.A01.1.454.CMB.1.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacacccaccccggcagacgcccccaaactcatgatttatgaggccactaagcgaccctcagggctttctaatcgcttctctggctccaagtctggcaacacggcctccctgacaatctctgggctccaggctgacgacgaggctaattattactgctgctcatatgaagttataacactatactattcggcggagggaccaagctgacccgtctgcgtcagcccaaggcctcgccccgtcgtcactctcgttcccgccctcctcgccttacgtagactgaggcgggctggcaacgg

SEQ ID NO: 62095 - DNA, 778 bp, Homo sapiens
  misc_feature: GYAE6OF02HBA6F.15.1.A01.1.454.CMB.1.raw
  modified_base (268)..(268): a, c, t, g, unknown or other
  misc_feature (268)..(268): n is a, c, g, or t
tcagtctacgtagccacgaccggtgctcgatttagacgtctcatcagggcctgggctctgctgctcctcactctcctcactcaggacacgagggtccgtcgggcccagtctgccctgactcagcctgcctccgtgtctgggtctcctggacagtcgatcaccatctcctgcactggaaccagcagtgattggttggggttatctaccttgtctccgtcggtaaccaaccacccacccggcacgaccgaccccaaactcatgtatttangacgccaacgtaagccgacctgacgggtctttactaatcgtctttctcgtcggcctaccaagtctggaccaacgaccggtccctcctagaactaactctcgtcgggcctcgaggctaggaacgacggaggtacttaaatttacttactgtctcgcctactaattagttaaggtaaacggtttaactaaactaacttaaacttaacgttacggtttaccggggaccggggtaaaccggggaacctaaacgggtccgttaccggtaaccccggtttcccgttacgggtacccgttaccgaaccgggtacccccggtaaacgggttcccgttaccccgggttacccccccggttaccgggttacccttacccgtttccccggtttccccggttttccccccccgtcccccgtttaccccgttacccggttacccgtttaaaccggttaacggtacccggttacggggaccggggttacccgggggtaccttaccggggaaccggtaaccgggg

SEQ ID NO: 62096 - DNA, 512 bp, Homo sapiens
  misc_feature: GYAE6OF02IXJAV.15.1.A01.1.454.CMB.1.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagccccaaactcatgatttatgaggccactaagcgaccctcagggctttctaatcgcttctctggctccaagtctggcaacacggcctcctgacaatctctgggctccaggctgacgacgaggctaattattactgctgctcatatgaaggttataacactatactattcggcggagggacccaagctgaccgtcctgcgtcagcccaaggctcgcccctcggtccactcctgttccccgcctccctcgcttacgtagactggagcgggctggcaacgg

SEQ ID NO: 62097 - DNA, 508 bp, Homo sapiens
  misc_feature: GYAE6OF02G1LPW.15.1.A01.1.454.CMB.1.raw
tcagtctacgtagccacgaccggtgctcgatttagacgtctcatcagggcctgggctctgctgctcctcactctcctcactcaggacacagggtcctggtcccagtctgccctgactcagcctgcctccgtgtctgggtctcctggacagtcgatcaccatctcctgcactggaaccagcagtgatgttgggggttatcaccttgtctcctggtaccaacaccaccccggcagacgcccccaaactcatgatttatgaggccactaagcgaccctcagggctttctaatcgcttctctggctccaagtctggcaacacggcctccctgacaatctctgggctcaggctgacgacgagctaattattactgctgctcatatgaaggttataacactatactattcggcggagggacaagctgaccgtcctgcgtcagcccaaggctcgcccctcggtccactctcgttcccaccctcctcgctacgtagactgagcgggctggcaacgg

SEQ ID NO: 62098 - DNA, 805 bp, Homo sapiens
  misc_feature: GYAE6OF02FERCS.15.1.A01.1.454.CMB.1.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgagtggttggggttactctaccttgtcctacctacggtacccaaccacccgaccccggcacgaccgacccctaaactctatagtatttagacgacggaccctaacgtaacggtcccgtaccccgtcggtacgggttacctttaccttaacgtccgttctttccgtcgtacggtaccttacctaacggtcgtacggacccaaccgtaccggtccctaccgtacgtaactaacgttcgtccgtcgggtcctaccggacggtacgtacggaacggtacggtaacggttaactttaaagtttacttacgtcgtacgttacgtactttaacgtaagtttaacgtaaacggtttaaaacggtttaaactaaaccttaacgttaacgtaacggttacgggttaccggggaaacgggaaccgggtaaacccgtacggtcccggttaccggtaccccgttacggtaccggacccggtacccgaacccggtacccggtaaccggttcccgtccccgttaccccgttcggttacccctccgtttcccgtacccggttccccgttcccgtcgtacccggtaaccgttacggtacggtcgtacgggaccgggtcggacggtacggacgtaaccgg

SEQ ID NO: 62099 - DNA, 510 bp, Homo sapiens
  misc_feature: GYAE6OF02IAHVZ.15.1.A01.1.454.CMB.1.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcaccttgtctcctggtaccaacaccaccccggcagacgcccccaaactcatgatttatgaggccactaagcgaccctcagggctttctaatcgcttctctggctccaagtctggcaacacggcctcctgacaatctctgggctccaggctgacgacgaggctaattattactgctgctcatatgaagttataacactatactattcggcggaggacagctgaccgtctgcgtcacgccaggcctcgcccctgtcactctcgttcccaccctcctcgtcctacgtacgctggacggccgggcgtcggcgaacgg

SEQ ID NO: 62100 - DNA, 686 bp, Homo sapiens
  misc_feature: GYAE6OF02ICDFB.15.1.A01.1.454.CMB.1.raw
  modified_base (389)..(389): a, c, t, g, unknown or other
  misc_feature (389)..(389): n is a, c, g, or t
tcagtctacgtagccacgaccggtgctcgattttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttgggggttatcaccttgtctcctcggtaccaacaccaccccggcagacgcccccaaatcatgatttatgaggccactaagccgaccctcgagggtctttactaatcgctttctctggctccagtctggcaacacggcctcctgacaatctcgtgggcctccgaggctaggacgacggagggtacttaaagtttattacngtctgctacgaattagtaggtaaaggtttaataaaccgtaacttaacttacgtacgttccgggacgggtacggggaaccaaggtctacggacccgttcgtacggtccgtaccgaccggtacccgaacgggtcccgttcccggtcccccgtccgggttaccctacccgtttcccgtttcccggtttcccccccggtccccctttcccgttacccgggtacccgtttaaacccggtacggttaaccgttacgggaaccgggtcccggggttaccggttcgggacccgtaaacccggggg

SEQ ID NO: 62101 - DNA, 510 bp, Homo sapiens
  misc_feature: GYAE6OF02G45A5.15.1.A01.1.454.CMB.1.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagacgcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtctgcgtcagcccaaggcctcgcccctcggtccactctcgttcccgccctcctcgctacgtagactgagcgggctggcacgg

SEQ ID NO: 62102 - DNA, 551 bp, Homo sapiens
  misc_feature: GYAE6OF02JXR4B.15.1.A01.1.454.CMB.1.raw
  modified_base (316)..(316): a, c, t, g, unknown or other
  misc_feature (316)..(316): n is a, c, g, or t
  modified_base (332)..(332): a, c, t, g, unknown or other
  misc_feature (332)..(332): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcaccttgtctcctggtaccaacaccaccccggcagacgcccccaaactcatcgatttatgaggccactaagcgaccctcagggctttctaatcgcttctctggctcaagtctggcaacncggcctcctgacatcnctgggctccgagctgacgacgagctaattatactgctgtctcatatagtaagttataacactatactattcggcgaggacaagcgtcgaccgtcctgtcgtacgacgacccgaggcgtccgcccccgtcggtcctacgttccctcgttacccccgtcccttcccgtccgtaccctaccgtacgtacttacggacggtccggacgtcggaccgtaacggg

SEQ ID NO: 62103 - DNA, 507 bp, Homo sapiens
  misc_feature: GYAE6OF02IPGOQ.15.1.A01.1.454.CMB.1.raw
  modified_base (459)..(459): a, c, t, g, unknown or other
  misc_feature (459)..(459): n is a, c, g, or t
  modified_base (492)..(492): a, c, t, g, unknown or other
  misc_feature (492)..(492): n is a, c, g, or t
  modified_base (503)..(503): a, c, t, g, unknown or other
  misc_feature (503)..(503): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcaccttgtctcctggtaccaacaccaccccggcagacgcccccaaatcatgatttatgaggccactaagcgaccctcaggctttctaatcgcttctctggctccgaagtctggcaacacggcctcctgacaatctctgggctccgaggctagacgacgagacttaaattattactgctgctcatatagaagttataacactatactagttcggcgaggaccaagctcgaccgtctgcgtcgacgaccagcctcgcccctgcncgtctcgttcccgcctcctcgctacgtagctgngcgggctgganacgg

SEQ ID NO: 62104 - DNA, 512 bp, Homo sapiens
  misc_feature: GYAE6OF02IXXHX.15.1.A01.1.454.CMB.1.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacacccaccccggcagacgcccccaaactcatgatttatgaggccactaagcgacccctcagggctttctaatcgcttctctggctccaagtctggcaacacggcctcctgacaatctctgggctcaggctgacgacgaggctaattattactgctgctcatatgaaggttataacactatactattcggcggagggaccaagctgaccgtcctgcgtcacgcccaaggcctcgccccctcgtcactctcgttcccaccctccctcgctagtagactgagcgggctggcaacgg

SEQ ID NO: 62105 - DNA, 673 bp, Homo sapiens
  misc_feature: GYAE6OF02HJTV2.15.1.A01.1.454.CMB.1.raw
  modified_base (197)..(197): a, c, t, g, unknown or other
  misc_feature (197)..(197): n is a, c, g, or t
  modified_base (229)..(229): a, c, t, g, unknown or other
  misc_feature (229)..(229): n is a, c, g, or t
  modified_base (255)..(255): a, c, t, g, unknown or other
  misc_feature (255)..(255): n is a, c, g, or t
  modified_base (389)..(389): a, c, t, g, unknown or other
  misc_feature (389)..(389): n is a, c, g, or t
  modified_base (422)..(422): a, c, t, g, unknown or other
  misc_feature (422)..(422): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttgggttancacttgtctctcggtaccaacacccacccggnagaccgaccccaaatcatgtatttangacgccaactaagccacctgaggtctttactaatcgtcttctcgtggcctacgaagtcgtggaccaacgaccggtcctccctagaactatctcgtggcctcgagctagacgacgaggtacttaaattattacgngctagctctaattacgtaaggtaaacgtttaanaaactacttaataacgttagttaccgggacggtaacgggaaccctaagccgtacggtaacccgttcgttcggtaccgttacgaacccggacccgaaacgggttccctcccggtacccccggtacggttaccctaccgttcccgttcccgtttaccccccgtaaccccgttcccgttaccggtaacccgttaaccggtaacggtaccgtacgggaccggttcccggggcgttaccggggaactaacccgggg

SEQ ID NO: 62106 - DNA, 519 bp, Homo sapiens
  misc_feature: GYAE6OF02GQS4U.15.1.A01.1.454.CMB.1.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaaagcgacccctcagggctttctaatcgcttctctggctccaagtctggcaacacggcctccctgacaatctctgggctccaggctgacgacgaggctaattattactgctgctcatatgaaggttataacactatactattcggcggaggacaagctgaccgtcctgcgtcagcccaaggcctcgccccctcggtccacttctcgttccccgcccttcctccgctacgtagactcggagcgggctcggcaacgg

SEQ ID NO: 62107 - DNA, 529 bp, Homo sapiens
  misc_feature: GYAE6OF02JX4IN.15.1.A01.1.454.CMB.1.raw
  modified_base (482)..(482): a, c, t, g, unknown or other
  misc_feature (482)..(482): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcaccttgtctcctggtaccaacaccacccggcagacgccccaaactcatgatttatgaggccactaagcgaccctcagggtctttctaatcgcttctctggctccaagtctggacaacacggcctcctgacaatctctgggctccgaggctaggacgacgaggctaaattacttactgctgctcatatagaagttataacactatactagttcggacggaggaccagctgaccgtctcgcgtcacgccaacggtcctcgcccctcggtcctactcttcgtccccnccctcctcgtacctacgtacgcgtcgaggccggcgtcggacaacggg

SEQ ID NO: 62108 - DNA, 525 bp, Homo sapiens
  misc_feature: GYAE6OF02IFHYK.15.1.A01.1.454.CMB.1.raw
  modified_base (323)..(323): a, c, t, g, unknown or other
  misc_feature (323)..(323): n is a, c, g, or t
  modified_base (477)..(477): a, c, t, g, unknown or other
  misc_feature (477)..(477): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcaccttgtctcctggtaccaacaccaccccggcagacgcccccaaaactcatgatttatgaggccaactaaagccgacccctcagggtctttctaatcgcttctctggcctccaagtctggcaacncggcctcctgacaatctctgggctcaggctgacgacgagctaattattactgctgctcatatagtaaggttataacactatactagttcggcggaggaccaagctgaccgtctgcgtcacgccaagcctcgcccctcgtcacctctccgtcccnccctccctcgtcctacgtagacgtggacggcgggcgtcggacgaacgg

SEQ ID NO: 62109 - DNA, 511 bp, Homo sapiens
  misc_feature: GYAE6OF02FZDFE.15.1.A01.1.454.CMB.1.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattatactgctgctcatatgaaggttataacactatactattcggcggaggaccaagctgaccgtcctgcgtcacgcccaaggcctcgccccctcggtcactctcgttcccaccctcctccgctacgtagactgagccggctggcaacgg

SEQ ID NO: 62110 - DNA, 510 bp, Homo sapiens
  misc_feature: GYAE6OF02F5KKJ.15.1.A01.1.454.CMB.1.raw
  modified_base (470)..(470): a, c, t, g, unknown or other
  misc_feature (470)..(470): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagacgcccccaaaactcatgatttatgaggccactaaagcgacccctcgagggtctttctaatcgcttctctgctccaagtctggcaacacggcctcctgacaatctctggctcagctgacgacgagctaattatactgctgctcatatgaaggttataacactatactattcggcggaggaccaagctgaccgtcctgccgtcacgcccaaggctcgcccctcgcacctctcgtcccnccctcctcgctacgacgactggacggcggctcggcaacgg

SEQ ID NO: 62111 - DNA, 512 bp, Homo sapiens
  misc_feature: GYAE6OF02GP3AX.15.1.A01.1.454.CMB.1.raw
  modified_base (491)..(491): a, c, t, g, unknown or other
  misc_feature (491)..(491): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagacgcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcacgcccaaggctcgccccctcgtcacctctcgttcccaccctcctcgtacgtancgtgacggcggctggcaggcg

SEQ ID NO: 62112 - DNA, 525 bp, Homo sapiens
  misc_feature: GYAE6OF02FZDU7.15.1.A01.1.454.CMB.1.raw
  modified_base (480)..(480): a, c, t, g, unknown or other
  misc_feature (480)..(480): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagacgcccccaaaactcatgatttatgaggccaactaagcgacccctcagggctttctaatcgcttctctggctccaagtctggcaacacggcctccctgacaatctctggctcaggctgacgacgagctaattattactgctgctcatatgaaggttaataactactatactattcggcggaggacaagctgaccgtctgcgtcgacgcccaagcctcgccccgtcggtccaccttcctcgttccccncccttccctccgcctacgtacgactcgacggcggcgtggcaacgg

SEQ ID NO: 62113 - DNA, 524 bp, Homo sapiens
  misc_feature: GYAE6OF02IW19U.15.1.A01.1.454.CMB.1.raw
  modified_base (296)..(296): a, c, t, g, unknown or other
  misc_feature (296)..(296): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagacgcccccaaactcatgatttatgaggccactaagcgaccctcagggctttctaatcgcttcnctggctcaagtctggcaacacggcctccctgaccaatctctgggctccaggctgacgacgaggctaattatactgctgctcatatgtaaggttataacatatactagttcggcggaggaccaagctgaccgtctgcgtcacgccaacggctacgccccgtcggtcacctctcgttcccgcccttcctcgcctacgtagtaccgtcgacggcgggcgtcggacaacggg

SEQ ID NO: 62114 - DNA, 515 bp, Homo sapiens
  misc_feature: GYAE6OF02FT4PA.15.1.A01.1.454.CMB.1.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccacccggcagacgcccccaaactcatgatttatgaggccactaagcgaccctcagggctttctaatcgcttctctggctccaagtctggcaacacggcctcctgacaatctctgggctccaggctgacgacgaggctaattattactgctgctcatatgtaagttataacactatactattcggcggaggaccgaagctgaccgtctgcgtcacgccaaggctcgccccgtcgtcactctcgttcccacccttcctcgccttacgtacgactggacgccgggctggcgaacgg

SEQ ID NO: 62115 - DNA, 536 bp, Homo sapiens
  misc_feature: GYAE6OF02I40CM.15.1.A01.1.454.CMB.1.raw
  modified_base (409)..(409): a, c, t, g, unknown or other
  misc_feature (409)..(409): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacacccaccccggcagacgaccccaaactcatgatttatgaggccactaagcgaccctcagggctttcaatcgcttctctggctccaagtctggcaacacggcctccctgacaatctctgggctccaggctgacgacgaggctaattactactgctgctcatatgtaagttataacactatactattcggngagggacaagctgaccgtcgtgcgtcgacgcccgaaggctcgccccctcggtctaccgtcttccgttccccacccttccgtccgaccttacgtagacctggtacggccgggtctcgggactaacggg

SEQ ID NO: 62116 - DNA, 524 bp, Homo sapiens
  misc_feature: GYAE6OF02G62J4.15.1.A01.1.454.CMB.1.raw
  modified_base (330)..(330): a, c, t, g, unknown or other
  misc_feature (330)..(330): n is a, c, g, or t
  modified_base (382)..(382): a, c, t, g, unknown or other
  misc_feature (382)..(382): n is a, c, g, or t
  modified_base (468)..(468): a, c, t, g, unknown or other
  misc_feature (468)..(468): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttggggttatcaccttgtctcctggtaccaacaccaccccggcagacgcccccaaactcatgatttatgaggccaactaagccgaccctcagggtctttctaatcgtcttctctggctccaagtctggcacacggcctcccngacatctcgtgggctcgaggctgacgacgaggcttaattattactgctgctnatatgtaagttataacactatactagttcggcggaggacaagctacgaccgtcgtgccgtacacgccaagcctccgcccctcgtcnctcgtcgttcccgccctcctcgcctacgtacgctgaccggcgggtcgtggacacgg

SEQ ID NO: 62117 - DNA, 513 bp, Homo sapiens
  misc_feature: GYAE6OF02HQV5A.15.1.A01.1.454.CMB.1.raw
  modified_base (505)..(505): a, c, t, g, unknown or other
  misc_feature (505)..(505): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcaccttgtctcctggtaccaacaccaccccggcagacgcccccaaactcatgatttatgaggccactaagcgaccctcagggctttctaatcgcttctctggctccaagtctggcaaaacggcctccctgacaatctctggcctccaggctgacgacgaggctaattatactgctgctcatatgaagttataacatatactatcggcggagggaccaagctcgaccgtcctgcgtcgacgccaaggcctcgccccctcggccactcctcgttcccgccctcctccgctacgtagactcgacggcggcnggcaggcg

SEQ ID NO: 62118 - DNA, 525 bp, Homo sapiens
  misc_feature: GYAE6OF02GD97R.15.1.A01.1.454.CMB.1.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcaccttgtctcctggtaccaacaccaccccggcagacgcccccaaactcatgatttatgaggccactaagcgacccctcagggctttcaatcgcttctctggctccaagtctggcaacacggcctcctgacatctctggctcaggctgacgacgaggctaattattactgctgctacatatgaagttataacactatactagtcggcggaggaccagctgaccgtctgcgtcgacgcccaaggcctcgcccccgtcggtccacctccttcgttcccctaccctcctccgccttacgtacgacgtggacggccgggctcgggcaacggg

SEQ ID NO: 62119 - DNA, 526 bp, Homo sapiens
  misc_feature: GYAE6OF02GLT6A.15.1.A01.1.454.CMB.1.raw
  modified_base (276)..(276): a, c, t, g, unknown or other
  misc_feature (276)..(276): n is a, c, g, or t
  modified_base (483)..(483): a, c, t, g, unknown or other
  misc_feature (483)..(483): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgacccctnagggctttctaatcgcttctctggctccaagtctggcaacacggccctccctgacaatctctgggctccagctgacgacgagctaattattactgctgctcatatagtaagttataaacactatactagttcggcggagggaccaagctgaccgtcctgcgtacacgcccaaggcctcgcccccgtggtccacttcctcgttccccnccctcctccgcttacgtagactggacgcgggctcggacacggg

SEQ ID NO: 62120 - DNA, 830 bp, Homo sapiens
  misc_feature: GYAE6OF02H4B7B.15.1.A01.1.454.CMB.1.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttggggttatcacttgtctctcggtaccaacaccacccggcacgacgaccccaaactcatgatttatgaggccacgtaacgcgaccctcgagggtctttactaactcgtctttcgtctcggcctaccgtaagtctacggaccaaccgtaccgggccctaccgtacgaacctaacttccgttcgtacggggccttaccgacgggtaccgtacggaaccggaacggtacgggtaacctttaaaagtttaactttaccgtacggtccgttacggtccttaacgttaaacgtttaaacgttaaagggttaaaacgggttttaaaccttaaaaccgttaaccgtttaaacgtttaaccggttaacgggtttaccggggaaccggggtaaacggggaaacccgtaacgggtaccgttaccgggtaccccggttacccgttacggtaccccggttaccgtaacccgggtaaccccgtaaaccgggttcccgttacccccggtaccccccggttaccggttacccttaacccgtttcccgtttccccggtttaccccggttcccctttccccggttaccggtacccgttaaccggttacggtaccggttcgggaaccgggtcccgggtacgtaccgggacggtaaccggg

SEQ ID NO: 62121 - DNA, 599 bp, Homo sapiens
  misc_feature: GYAE6OF02HOXWA.15.1.A01.1.454.CMB.1.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttgggggttatcaccttgtctcctggtaccaacaccacccggcagacgacccccaaactcatgtatttatgacggccactaagccgacccctcgagggtctttctaactcgctttctcgtggctcctaagtctggcaaccacggcctccgtgacaatctcgtgggctccgaggcgtgacgacgaggtcttaattattactgtctgctctatagtagtaaaggttaataacgtaactattaacttacgttacgggacgggaacggaccaagcgtacggacccgttcgtcgcgtccgacgacccgaacgcctccgccccgtcgtcctaccgtcgttaccgttccccgtcccgtcccgttccgtacctaccggtacgtacgtcggaccggtccgggacgtcgggacgtaacggg

SEQ ID NO: 62122 - DNA, 525 bp, Homo sapiens
  misc_feature: GYAE6OF02GD8EN.15.1.A01.1.454.CMB.1.raw
  modified_base (277)..(277): a, c, t, g, unknown or other
  misc_feature (277)..(277): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagacgcccccaaactcatgatttatgaggccactaagcgacccctnagggtctttctaatcgcttctctggctccaagtctggacaaacggcctccctgacaatctctggctccgaggctgacgacgaggctaattattactgctgctcatatgtaagttataacactatactatcggcggtaggaccagctgaccgtctgcgtcacgcccgaaggcctccgcccctcgtccactcttcgtccccgccctcctccgtcctacgtacgacgtggacggcggctcggtcgaagtcg

SEQ ID NO: 62123 - DNA, 529 bp, Homo sapiens
  misc_feature: GYAE6OF02H2XH0.15.1.A01.1.454.CMB.1.raw
  modified_base (368)..(368): a, c, t, g, unknown or other
  misc_feature (368)..(368): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcaccttgtctcctggtaccaacaccaccccggcagacgcccccaaactcatgtatttatgagccactaagccgaccctcaggtctttctaatcgctttctctggctcagtctggcaacacggcctcctgacatctcgtggctcgagctgacgacgagtactaattattacngtctgctcatatagtaagttataactactatactagttcggacggaggaccaagctcgaccgtctcgcgtacacgccaagcctccgcccctcgtctccttctccgttccccacccttccgtcgcttacgtagacgtggacggcggtcgtcggacgtaacgg

SEQ ID NO: 62124 - DNA, 519 bp, Homo sapiens
  misc_feature: GYAE6OF02I192E.15.1.A01.1.454.CMB.1.raw
  modified_base (343)..(343): a, c, t, g, unknown or other
  misc_feature (343)..(343): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcaccttgtctcctggtaccaacaccaccccggcagacgcccccaaactcatgatttatgaggccactaagcgaccctcagggcttctaatcgcttctctggctccaagtctggacaacacggcctccctgacaatctctgggctcnggctgacgacgaggctaattattactgctgctcatatagaagttatacactatactatcggcggaggacagcgtcgaccgtccgtgccgtcacgcccgaacgctccgcccctcgtcacctcgtccgttcccgccctcctccgcctacgtagactcggacggcggctcggctaacgg

SEQ ID NO: 62125 - DNA, 517 bp, Homo sapiens
  misc_feature: GYAE6OF02HL6O8.15.1.A01.1.454.CMB.1.raw
  modified_base (326)..(326): a, c, t, g, unknown or other
  misc_feature (326)..(326): n is a, c, g, or t
  modified_base (354)..(354): a, c, t, g, unknown or other
  misc_feature (354)..(354): n is a, c, g, or t
  modified_base (362)..(362): a, c, t, g, unknown or other
  misc_feature (362)..(362): n is a, c, g, or t
  modified_base (512)..(512): a, c, t, g, unknown or other
  misc_feature (512)..(512): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagacgcccccaaactcatgatttatgaggccactaagcgaccctcagggctttcaatcgcttctctggctccaagtctggcaacacggcctcccngacatctctgggctcaggctgacgacgngctaattntactgctgctcatatgaaggttataacactatactattcggcggacgggacaagctgaccgtcctgcgtcacgcccaaggcctcgcccccgttcggtcctacctcttcgtcccgtcccctcctccgctacgtagactcgagcgggctggngacgg

SEQ ID NO: 62126 - DNA, 609 bp, Homo sapiens
  misc_feature: GYAE6OF02I6FRP.15.1.A01.1.454.CMB.1.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttggggttatcaccttgtctcctggtaccaacacccaccccggcacgaccgcccccaaatcatgtatttatgaggccaactaagccgaccctcgagggtccttttcaacttccgtactttctcttcggcctaccgaagtctcggaccaaccgaccggccctccctgaccaactccttcgacgggtctaccgaggtcctaggaccggacggacggtacttaatttactacgtgctagctacatactagtaaggttactaaactacttaattacgtagttcgggacggaacgggaaccgacgctcgaccgttccgtgcgtacgacgaccgacggtcctccgccccgttgacctacgttcctccgtccccgtccctccgtccgtacgttacgtacgacgtcggacggtcggcgtggacgtacgg

SEQ ID NO: 62127 - DNA, 549 bp, Homo sapiens
  misc_feature: GYAE6OF02GU05S.15.1.A01.1.454.CMB.1.raw
  modified_base (392)..(392): a, c, t, g, unknown or other
  misc_feature (392)..(392): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttgggggttatcaccttgtctcctggtaccaacacccaccccggcagacgcccccaaactcatgatttatgaggccactaagccgaccctcgagggtctttctaatcgcttctctggctccgaagtctggcaacaccggcctcctgacaatctcgtcgggcctccgaggctgacgacgaggacttaaattattactgtctgctnatatagtaagttataactactatactagttcggacggaggaacagctcgaccgtctcgcgtcacgccgaacggcctccgccccgtgtccaccttccgtccgttccccgtcccttccgtccgccgtacgtagtactcggacggcggcgtcggcacggg

SEQ ID NO: 62128 - DNA, 707 bp, Homo sapiens
  misc_feature: GYAE6OF02IJO3R.15.1.A01.1.454.CMB.1.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgagttggttggggttatcaccttgtctcctggtaccaaccacccacccggcacgaccgacccccaaactcatagtatttagtggacggccaactaaagccgacccctcgacgggtcctttactaacgttcgcctttctccgtcgggtccttaccgaagttccgtacggacctaaaaccgacccggtccccttaccccgtagtaacctaaacttccgttcggtcggggtccttacccgaacgggtctacgggaccggaaccggtaagggtacctttaaaattttacgttaaccgttcgccgttagtacttactaattacgttaagtaaaaggtttaacttaaactaacttaattaacgttacgttacgggacggaacgggaaccgaagtccgtacgtaccgttcgtcgaccgtcgacgacccgtaaggccgtcccgccccggttcgtacctaccgttccgtcccgtttcccgccctcccgtcgtaccgtacgtacgacgtcggtaggccgggcgtcggacgacgg

SEQ ID NO: 62129 - DNA, 750 bp, Homo sapiens
  misc_feature: GYAE6OF02J2PW2.15.1.A01.1.454.CMB.1.raw
  modified_base (233)..(233): a, c, t, g, unknown or other
  misc_feature (233)..(233): n is a, c, g, or t
tcagtctacgtagccacgaccggtgctcgatttagacgtctcatcaggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttgggggttatctaccttgtctacctggtaccaacaccaccccggnacgacgcccccaaaactcaatgactttatgacggaccaactaacgccggaacccctcgtaggggtccttttactaaactccggtcttcctcttacgggcctacctaaacggttccttacgggcctaaaaccgtcccggggtccccttcccccgttaggaacccaaactttcccgtccggtaggggtcccttcccgaacggggtccttacgggaacccggaaacggtacgggtaacctttaaacgtttttaacttaccgtacgggtcctttacggtccttactaattaacgttagtaaaggttactaaacgtaacttaactacgttacgttacgggtacggaacgggtaccaacgtctacggtaccgtaccgtcgtaccgtcgaccgtacccggaacggtccgtcccgtacccccgtcggtccctaccttcgtacccggtttcccctaaccccgttcctaccgtacccgttaaccggtacgaccgtcgggtaccgaccgggtcgtacgggcgaacggg

SEQ ID NO: 62130 - DNA, 523 bp, Homo sapiens
  misc_feature: GYAE6OF02GEDZG.15.1.A01.1.454.CMB.1.raw
  modified_base (276)..(276): a, c, t, g, unknown or other
  misc_feature (276)..(276): n is a, c, g, or t
  modified_base (369)..(369): a, c, t, g, unknown or other
  misc_feature (369)..(369): n is a, c, g, or t
  modified_base (385)..(385): a, c, t, g, unknown or other
  misc_feature (385)..(385): n is a, c, g, or t
  modified_base (454)..(454): a, c, t, g, unknown or other
  misc_feature (454)..(454): n is a, c, g, or t
  modified_base (488)..(488): a, c, t, g, unknown or other
  misc_feature (488)..(488): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagacgcccccaaactcatgatttatgaggccactaagccaccctnagggtctttactaatcgcttctctggctccaagtctggcaacacggcctcctgacatctctggctcagctgacgagagctaattatactgctnctcatatgtaagttanaactatatactagttcggacggagggaccaagtcgtagtaccgtcctgaccgtcagcccgaaggcctcnccccgtcgtcactctccgtcccacccttccgtcnccttacgtgactcggacgtcgggctggcgtaacgg

SEQ ID NO: 62131 - DNA, 573 bp, Homo sapiens
  misc_feature: GYAE6OF02GKWGS.15.1.A01.1.454.CMB.1.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttggggttatcaccttgtctcctggtaccaacacccaccccggcagacgacccccaaactcatgatttatggacggaccaactaacgccgaccctcgagggtctttactaatccgtcttctctggtcctccaagtctcggacaaccgaccggcctccctagaacctaactcctcgtcggctccgagctggacgacgagcttaaattattactgctgctcatatagtaagttataactactatacttagtcggacggtacggaccagcgtacgacccgtctcgcgtacacgccgaagtcctccgccccgtcgtcctacttcctccgtacccctccctcctcgtaccttacgtacgtactcggacggtccggcgtacggacaacggg

SEQ ID NO: 62132 - DNA, 905 bp, Homo sapiens
  misc_feature: GYAE6OF02ICMTS.15.1.A01.1.454.CMB.1.raw
  modified_base (260)..(260): a, c, t, g, unknown or other
  misc_feature (260)..(260): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttgggggttatcacttcgtctcgtggtaccaacacccaacccggcagacgaccccaaatcatagtatttagngacggaccaacgtaaacgccgaccctacgacgggtccttttactaaactccgtccttttcctccgttacgggtccttaacccgtaaacgttccgttacggggaacctaaaccgaacccgggtcccctttaccccggtacgaaacctaaactttccgtaccggttcgggggtcccttacccggaacgggtccgttaacggaaaccggaaacgggtaacgggtaaccttttaaaattttaaactttaacccgttaggttcccgttacggtacccttaacttaaagtttaaaccggttaaagggttaaaacgggtttttaaaactaaaaacccgttaaaacccgttttaaattttaaaccccggttttaaagggttttaaccccggggggaaacccgggggtaaaacggggtaaaccccggaaaacggtcccgggtttacggaacccccgggtttacgttaccgggtaccgttaacccgaaacccggtaccccgtaaacggggtcccttccccgggttcccccggttacgggttaccccttaacgttcccgtttacccggttcccccaaaccccgtttccccgtacggtacccgttaacgtaaccggtacgtacgggaccggtccgggaccgtacgggacgaaccggg

SEQ ID NO: 62133 - DNA, 586 bp, Homo sapiens
  misc_feature: GYAE6OF02FVT47.15.1.A01.1.454.CMB.1.raw
  modified_base (256)..(256): a, c, t, g, unknown or other
  misc_feature (256)..(256): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcaccttgtctcctggtaccaacacccaccccggcagacgcccccaaactcatgatttangaggccactaagccgaccctcgagggtctttactaatcgcttctctggcctaccagtcgtggacaacgaccggccctcctgaacaatcctcgtgggcctcgaggctggacgacggagtactaaattattactgctgctcatataggtaagttataactactaatactagttcgggacggacggaccaagtctacggtaccgtccgtgcgtcgacgacccgaggcctccggtaccccgtcggtacctaccgttccgttccgtaccccctacccgttccctccggaccttacggtacgtaccgtggaccggtcgggccgtaggacgaacggg

SEQ ID NO: 62134 - DNA, 577 bp, Homo sapiens
  misc_feature: GYAE6OF02IQAGS.15.1.A01.1.454.CMB.1.raw
  modified_base (265)..(265): a, c, t, g, unknown or other
  misc_feature (265)..(265): n is a, c, g, or t
  modified_base (354)..(354): a, c, t, g, unknown or other
  misc_feature (354)..(354): n is a, c, g, or t
  modified_base (395)..(395): a, c, t, g, unknown or other
  misc_feature (395)..(395): n is a, c, g, or t
tcagtctacgtagccacgaccggtgctcgatttagacgtctcatcagggcctgggctctgctgctcctcactctcctcactcaggacacagggtcctgggcccagtctgcccctgactcagcctgcctccgtgtctgggtctcctggacagtcgatcaccatctcctgcactggaaccagcagtgatggttgggggttatcctaccttgtctcctggtacccaaccacccaccccggcagaccgacccccaaactcatgatttangtaggccaactaacgccgacccctcagggtctttctaatcgtcttctcgtggcctccaagtctggcaacacggcctcctgacatctcgnggctcaggctcgacgacgagacttaattatactgctgtctntaatatagtaaagttactaacactaatactagttcggacggacggaaccaagtcgtcgacccgtctcgtaccgtctacgacccgtacgccgtccgcccccgttacgctacctcttccgttaccccgcccttccctacgtccttaccggtacgaccgtgggacgcgggtcgtagggccacggg

SEQ ID NO: 62135 - DNA, 519 bp, Homo sapiens
  misc_feature: GYAE6OF02G2VC1.15.1.A01.1.454.CMB.1.raw
  modified_base (478)..(478): a, c, t, g, unknown or other
  misc_feature (478)..(478): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagacgcccccaaaactcatgatttatgaggccactaagcgaccctcagggctttctaatcgcttctctggctccaagtctggcacacgcctcctgacaatctctgggctcaggctgacgacgaggctaattatactgctgctcatatgtaaggttataaactactatactagttcggacggaggacaagctcgtaccgtctgcgtcacgcccaaggcctcgccccgtcgtctactcgtcgttccccnccctcctccgcttacgtagactgacgcggctcggcgaacgg

SEQ ID NO: 62136 - DNA, 507 bp, Homo sapiens
  misc_feature: GYAE6OF02GGE6Z.15.1.A01.1.454.CMB.1.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcaccttgtctcctggtaccaacaccaccccggcagacgcccccaaactcatgatttatgaggccactaagcgaccctcagggctttctaatcgcttctctggctccaagtctggcaacacggcctcctgacaatctcgtggctcaggctgacgacgaggctaattatactgctgctcatatagtaaggttataacactatactagttcggacggaggaccaagctcgaccgtctgcgtcacgccaacgcctcgcccctcgtcactctctcccgcctcctcgcttacgtagactcgcgcggcgtggcacgg

SEQ ID NO: 62137 - DNA, 725 bp, Homo sapiens
  misc_feature: GYAE6OF02HGMPL.15.1.A01.1.454.CMB.1.raw
tcagtctacgtagccacgaccggtgctcgatttagacgtctcatcaagggaaggaagggggggggtctcaggaggcagcgctctcaggacatctccaccatggcctgggctctgctgctcctcaccctcctcactcgagggcacgagggtcctgggcccagtctgccctgactcagcctgcctccggtgtcgtgggtctcgttggacagtcgatcaccatcctcctgcacgtacggaaccagccgagtgtaacgtttggtaacttaagtaactatcgtctcctacggtaccaacacgaaccaggaccaaaccgaccccaaactcgatagtactttagtggtagtactagtaacgtcgggtccctacggtacggggtttctaaagtctcttactcgtcggtcctaccgtaagtcgtacggacctaacaccgtccggtccccctacgtaaccctacgtcgtaccggtccgggtaccctaccgggtacggtccgtagggtaacgggtacggacgggtacgttaggttaactttaacgttacgtacgtaccgtagtaccttactaacgttaactaaccgtagtacgtaacggtccgaacgtaccgtccgttaccgggtttaggggtaccggttacgggaccggggaccggtaaccgtaacggtccgtaccggttaccgtaccggtacggtaccggaccgacccggttaccggtccccgttaaccccggg

SEQ ID NO: 62138 - DNA, 590 bp, Homo sapiens
  misc_feature: GYAE6OF02IXP63.15.1.A01.1.454.CMB.1.raw
  modified_base (319)..(319): a, c, t, g, unknown or other
  misc_feature (319)..(319): n is a, c, g, or t
  modified_base (339)..(339): a, c, t, g, unknown or other
  misc_feature (339)..(339): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcaccttgtctcctggtaccaaccacccaccccggcagacgcccccaaactcatgatttatgaggccacgtaagccgacccctcgagggtctttactaatcgcttctcgtggcctccaagtcnggcaacgaccggcctccctnacaatctctgggcctccgaggcttacggacgacgacggtactaatttactactgtctgtctacatagtagtaaggttataactactatactagttcgggacggtaggaccaggcctacggtaccgtccgtagccgtcacgacccgaaggccttccgcccccgtacgtccaccgttccgtcgtttcccccgacccttccctccgtacttaaccggttagaccgtcggacggtcgggtcgtcgggacgacggg

SEQ ID NO: 62139 - DNA, 720 bp, Homo sapiens
  misc_feature: GYAE6OF02H8OVF.15.1.A01.1.454.CMB.1.raw
  modified_base (178)..(178): a, c, t, g, unknown or other
  misc_feature (178)..(178): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccngcagtgatggttggggttatcaccttgtctcctggtaccaacaccacccggcacgacgacccccaaatccatcgtatttagtggacggaccaacgtaacgccgacccctcgacgggtcttttactaactcgtcctttctcgtcggcctaccgaagttccgtaggaccaaccgaccggcccctaccgtacgaactaacttccgtaccgtcggggtcctaccgaggtccgtaggaaccggaacggaggtaccttaaagtttacgttaccgtgtaccgttgtaccttacgtaattaagttacggtaaaaggtttaactaaactaaccttaacgttaacgttacggttaccgggacgggtacggaacctaagtccgtacgtacccgttcgtcgaccgtccaaccggtacccgaaggtcccgtcccgtaccccgtccggttacctaccgttccgttcccggttcccccgtccctttacccgttcgacccgtttaacggacgtaccggttacggacggtcccgggtacgttaccgggacgtaaccggg

SEQ ID NO: 62140 - DNA, 633 bp, Homo sapiens
  misc_feature: GYAE6OF02IRIGH.15.1.A01.1.454.CMB.1.raw
  modified_base (415)..(415): a, c, t, g, unknown or other
  misc_feature (415)..(415): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttggggttatcaccttgtctcctggtaccaaccacccaccccggcacgaccgacccccaaaactcatgtaattttatcggacggcccaacgtaaacgccgtacccctcgagggtctttactaatccgtcttctcgtcggcctaccaagtcgtggcaaccgccggcctcctgactatcgtcgtcgggctcgaggtctaggacgacggaagtacttaaattacgttacncgtctgtcctactattagtagtaaggttaactaacgtaactattacctacgttcgggacggtaacggaccaagcctacgccgtccgtggtccgtacgaccgtccggaacgccgtcccgtccccgtcgtacctaccgttccgttacccgttccccgccccttcccgtaccgtaccgtacgttacgtacgtcggacggccgggtacgtaccggacgacgg

SEQ ID NO: 62141 - DNA, 516 bp, Homo sapiens
  misc_feature: GYAE6OF02JJK40.15.1.A01.1.454.CMB.1.raw
  modified_base (373)..(373): a, c, t, g, unknown or other
  misc_feature (373)..(373): n is a, c, g, or t
  modified_base (397)..(397): a, c, t, g, unknown or other
  misc_feature (397)..(397): n is a, c, g, or t
  modified_base (480)..(480): a, c, t, g, unknown or other
  misc_feature (480)..(480): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaaactcatgatttatgaggccactaaagcgaacccctcagggctttcaatcgcttctctggctccaagtctggcaacacggcctcctgacaatctctggctccaggctgacgacgaggctaaattattacgngctgctcatatagaagttataaanactatactatggcgaggaccaagctagaccgtctgctcgtagacccgaagctgcccctaggtcactctcgtcccaccgttccnctctaccgtagacctggacgcgggactggacaacgg

SEQ ID NO: 62142 - DNA, 632 bp, Homo sapiens
  misc_feature: GYAE6OF02JFSSJ.15.1.A01.1.454.CMB.1.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcaccttgtctcctggtaccaacaccacccggcagacgcccccaaactcatgatttatgagccactaagcgaccctcagggtctttctaatcgtcttctctcggctccaagtctggccaacacggcctccctgacatctctgggctcggacgcgtacgacgacggagtaacttaatttacttacgcgtcgtcgtacctagtatagttaaggtaaacgttaactaaccgtaacttactacgttacggtcgggacgggtaacgaaccgtacgtctaccggtaccgtcgtcgtaccgtacgaccgacccgtacggtccgtaccccgttcccgtacgtacgttcccgttcccgttcccggttacccctccccgttccgtaccgttaaccggttaccgtacggtacgttcggaccgggtacggtccgtacggacggaccgg

SEQ ID NO: 62143 - DNA, 550 bp, Homo sapiens
  misc_feature: GYAE6OF02FUSK0.15.1.A01.1.454.CMB.1.raw
  modified_base (231)..(231): a, c, t, g, unknown or other
  misc_feature (231)..(231): n is a, c, g, or t
  modified_base (391)..(391): a, c, t, g, unknown or other
  misc_feature (391)..(391): n is a, c, g, or t
  modified_base (542)..(542): a, c, t, g, unknown or other
  misc_feature (542)..(542): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggnagagcccccaaactcatgtatttatgaggccactaaagccgacccctcgagggtctttctaatcgtcttctctggctccaagtctggcaacacggcctccctgacaatcctctgggcctccgaggctggaacgacgaggacttaattattactgctgctnatatagtaagttataaactactaatactagttcggacggtacggaccagctcgaccgtcctgcgtcacgtacccgaacggtcctccgccccgtcgtcctactcttcgtcctccaccccttcctccgtctacgtacgtactgacggcgggtntggaccgg

SEQ ID NO: 62144 - DNA, 552 bp, Homo sapiens
  misc_feature: GYAE6OF02IKV90.15.1.A01.1.454.CMB.1.raw
  modified_base (274)..(274): a, c, t, g, unknown or other
  misc_feature (274)..(274): n is a, c, g, or t
  modified_base (352)..(352): a, c, t, g, unknown or other
  misc_feature (352)..(352): n is a, c, g, or t
  modified_base (362)..(362): a, c, t, g, unknown or other
  misc_feature (362)..(362): n is a, c, g, or t
  modified_base (374)..(374): a, c, t, g, unknown or other
  misc_feature (374)..(374): n is a, c, g, or t
  modified_base (508)..(508): a, c, t, g, unknown or other
  misc_feature (508)..(508): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaccagcagtgatgttggggttatcgaccttgtctctggtaccacaccacccggcagagccccaaatcagtgattttatgaaggcctactaagcgacccctnagggctttcgaatcgcttctctggctccaagtctggcaacacggctcctgacatctctggctccgaggctagacgagnggactaattnttactgctgctnatactgaacggttataacatatacgttagttcggacggagggaaccaaggtcacggaccgttcgtacgacgtcgaagcccgaaggtccctaccggcccctcggttccaacttcgtcgttcccccaccttccccngtcccttacggtacgtctacgacggccgggctcgggacaacggg

SEQ ID NO: 62145 - DNA, 771 bp, Homo sapiens
  misc_feature: GYAE6OF02IDXLC.15.1.A01.1.454.CMB.1.raw
tcagtctacgtagccacgaccggtgctcgatttagacgtctcatcagggcctgggctctgctgctcctcactctcctcactcaggacacagggtcctcgggcccagtctgccctgactcagcctgcctcgtgtcgtggtctcctggacagtcgatcacatctcctgcacgtggaaccagctagtgagttgggttggggttactctaccttgtccgtaccttacggtaaccaaccgacccgaccccgggacaacggacccaccccctaaactccaagttaggtaatttacgtacggaccggaacctacgtaaacggcccgtaaccccgtcggtaacgggttctttactaacgttccgtcctttcgtcgtcggtccaccgtagtccgtacgaccgaaaccgccggtccctaccgtagaactaacttccgtcggttcggccttaccgaacggtctaacggtaaccgggaacgtacggtaacttttaaactttaaccgttcgtacggtacctcgtactaccgtaaagttaggtaggtaaacgttaaactaactacgttaactacgttacggtacgggtaacgggtaaccgaacacggtcgtaccgtcccgtacgtcgtaccggactaacccggaccgaccgggtccttaccccggtccccgttacgtacccgttaacctccgttttaccccgtacccctacccgtcctacccggtaccgttaaccggtaccgtcggaccggtaacggtcccgggtcggttacggaccggtaccgg

SEQ ID NO: 62146 - DNA, 459 bp, Homo sapiens
  misc_feature: GYAE6OF02FTSL8.15.1.A01.1.454.CMB.1.raw
  modified_base (255)..(255): a, c, t, g, unknown or other
  misc_feature (255)..(255): n is a, c, g, or t
  modified_base (429)..(437): a, c, t, g, unknown or other
  misc_feature (429)..(437): n is a, c, g, or t
  modified_base (439)..(459): a, c, t, g, unknown or other
  misc_feature (439)..(459): n is a, c, g, or t
tcagtctacgtagccacgaccggtgctcgatttagacgtctcatcaaggaagggaaggggctggagtgggtctcaactatcagtggtagtggtgttagcacatattacgcagactccgtgaagggccggttcaccatctccagagacaattccaagaacacgctgtatgttcaaatgaacagcctgagagccgaggacacggccgtatattactgtgcgaaagccttgtgtatagcagtgcctggtaccaaggtnactactggggccagggaaccctggtcaccgtctcctcagcctccaccaagggcccatcggtcttccccctggcaccctcctccaagagcacctctgggggcacgagcgccctgggctgcctggtcaaggactacttccgctacgtagactgagcgggctggcaaggcgcatagnnnnnnnnngnnnnnnnnnnnnnnnnnnnnn

SEQ ID NO: 62147 - DNA, 561 bp, Homo sapiens
  misc_feature: GYAE6OF02IU90U.15.1.A01.1.454.CMB.1.raw
  modified_base (256)..(256): a, c, t, g, unknown or other
  misc_feature (256)..(256): n is a, c, g, or t
  modified_base (333)..(333): a, c, t, g, unknown or other
  misc_feature (333)..(333): n is a, c, g, or t
  modified_base (341)..(341): a, c, t, g, unknown or other
  misc_feature (341)..(341): n is a, c, g, or t
  modified_base (390)..(390): a, c, t, g, unknown or other
  misc_feature (390)..(390): n is a, c, g, or t
tcagtctacgtagccacgaccggtgctcgatttagacgtctcatcagggcctgggctctgctgctcctcactctcctcactcaggacacagggtcctgggcccagtctgcccctgactcagcctgcctccgtgtctgggtctcctggacagtcgatcaccatctcctgcactggaaccagcagtgatggttggggttatcacttgtctcctgtaccaacacccaccccggcagacgaccccaaactcatgatttangaggcccaactaacgccgacccctcgagggtctttctaatcgctttctctggctccaagtctggcaacacgcctccngacatctntggctccgaggctcgacgacgaggtactaaatttactactgctgcctanatagtagtaaagttactaacaactatactagttcggacggacgggaccagcgtcgaccgtctcgcgtcacgcccgaagcctccgcccgttcgtcctacttccgtccttccccaccttcccgtacgtacctacgtacgtacgtcggtacggcgggtcgtcggacgtaacggg

SEQ ID NO: 62148 - DNA, 625 bp, Homo sapiens
  misc_feature: GYAE6OF02FX0IV.15.1.A01.1.454.CMB.1.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcaccttgtctcctggtaccaacaccaccccggcacgacgccccaaactcatgattatgacggccaactaagccgacccctcgagggtcttttctaatcgtctttcgtctggcctccaagtctggcaacaccggcctcccgtgacatctcgtgggctcaggctgacgacgaggtcttaatttacttacgtgtcgtcgcttactattagtagtaaggttaactaaacctacttaacttactacgtttccgggacgggaacgggaccgaacgtacgtcggtacccgtccgtcgtccgtacgacgacccgaacggtccgtaccggccccccgttccggttacccaccgtttcccgtaccgtttcccccaaccccgttcctcccgtaccgttaccgtacgtaccgtcggacgggtcgggccgtggcgaaccgg

SEQ ID NO: 62149 - DNA, 858 bp, Homo sapiens
  misc_feature: GYAE6OF02ICTRT.15.1.A01.1.454.CMB.1.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgagtggttggggttatcacttgtctcctggtaccacaccacccgcacgacgccccaatcatgtatttatgacggaccaactaagccgaccttacgagggtcctttactaacgtcgtccttccttcgtcgggtacctaccgtaaacgttccgtagggaccaaaccgtaccgggtccccttacccgtacgtaaaccaaacttccgttacggtccggggtaccttaccccggaagggtccgtaacggaaaccggtaaccggtacggtaaactttaaacgtttttaactttaaaccgtgttacccgttacgtaccgttactaaacgtttaaagttaacggtaaaagggttttaaaccttaaaaccgtaaacctttaaacgtttaaccgtttaaacgggttttacccggggaaaccgggggttaaaccgggaaacccggttaaaggtacccgttaaccggtaaccccggttccgtttaccgggaaccggttcccaaacccgggaccccggtaaacgggttccccgttaccccgtaccccccggttaccgggttaccctacccgtttacccgttccccggttttaccccccgtccccccgtttacccggtccggtaacccgtttaccgttaacggtacgttcgggaccgggtccgggtaccgtacggggaccgtaaacggg

SEQ ID NO: 62150 - DNA, 582 bp, Homo sapiens
  misc_feature: GYAE6OF02FZQUF.15.1.A01.1.454.CMB.1.raw
  modified_base (233)..(233): a, c, t, g, unknown or other
  misc_feature (233)..(233): n is a, c, g, or t
  modified_base (406)..(406): a, c, t, g, unknown or other
  misc_feature (406)..(406): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcatgcactggaaccagcagtgatggttgggggttatcaccttgtctcctggtaccaacacccaccccggnacgacgacccccaaactcatgtatttatgacggaccaactaagccgaccctcgagggtcctttactaatcgtcttctctcggtcctaccgaagtcgtgaccaacgaccgccctcctgactaatcgtcgcggcctccgaggtctacggacgacggacgtattaattacttacgngctgctactatagtagtaagttataactactatacgtagttcggacgaaggaccagctcgaccgtcagcgtacgacgaccgtacgcctccgcccgtcgtcctacgtccgtccgtccccgtcccttccgtccgtcgttaacggtcgtacgtacggacggccgggtccgtaggaccgg

SEQ ID NO: 62151 - DNA, 796 bp, Homo sapiens
  misc_feature: GYAE6OF02HLMVS.15.1.A01.1.454.CMB.1.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttggggttatcaccttgtctcctggtaccaacacccacccggcacgacgaccccaaactcatgatttatgaggccactaagccgacccctcgacgggtccttttctaaactcgtactttccgttcttcgggaccttaccgaagttccgttgggaccaaaccgaccggtcccctccccgtagaaccaattccgtacgtcggggacccttacccggacgggcgttacggaaccggtaacggacggtaacctttaaagtttacgttttaaccgtcggtccttcggtccttactaacgttaagttaagggttaaaacggtttaacttaaaccgtaacctttaactttaaacgttttaacgggttaccggggtaaccggggtaacgggtaaaccccggtaaaggtccgttaccggtaaccccgggttaccgttacgggacccggttaccgtaccggaaccccgtaaacggtcccgttacccgggtccccccgttacgggttacccaacccgttcccgttacccggtttacccccgtccccggttcccgtcccgtaaccgttaccggtaaccgttaccgtcggaccggtcggtccggttaggtaccggaacggg

SEQ ID NO: 62152 - DNA, 798 bp, Homo sapiens
  misc_feature: GYAE6OF02IUGXF.15.1.A01.1.454.CMB.1.raw
  modified_base (478)..(478): a, c, t, g, unknown or other
  misc_feature (478)..(478): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtcgtggtctccgtggacagttgatcaccatctcctgcacgtaggaaccagcgagtgagttgggtttggggttaactctaccgttgtcctccgtacggtaacccaccacccaccccggcacgaccgaccccaactcgatagtattagagtacggacctaacgtaacgtccgaccctagtacggtcctttaacaacttccgtcctttctcgtcggtacctaccgtagttcgacggaccaaccgacccggtcccttacccgagtaaacctacttccggtaccgtcggggtacctaccggtacgggtctacggacggaacggtaacggtactttaaagtttactttacgngttaccgtagtaccttaattagtaaaggtttaaaggtaaacggtttaaacctaaaccttaacttaacgttaaccggttaacggtacccggggtaaggaaccggaccgtaacggtccgttaccggtacccgttcgtccggtaccgtccaacccgggacccgtaacgggtcccgttccccggaccccggtttaccgttacccgtacccgtttccccggtttacccttccccccggtaccctttcccggacccgtttaccggtaaccggttccgtaaccgggtacggtaccgggcccggggttaaccgtcgggtaaccggcgg

SEQ ID NO: 62153 - DNA, 710 bp, Homo sapiens
  misc_feature: GYAE6OF02F7M25.15.1.A01.1.454.CMB.1.raw
  modified_base (221)..(221): a, c, t, g, unknown or other
  misc_feature (221)..(221): n is a, c, g, or t
  modified_base (256)..(256): a, c, t, g, unknown or other
  misc_feature (256)..(256): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttggggttatcaccttgtctcctggtaccaacncccacccggcagacgaccccaaactcatgatttangagccactaagcacccctgaggtctttactaactccgtacttctctggcctaccagtcgtggccaacgaccggcctacccgtgaacctaactcctcgtacgggtcctccgaaggccgttacggaccggaacggacggtactttaaactttaatttaccgtcgtcttcggtacttactaagtagttaaggtaaaggtttaacttaaaacctaacgttaactttaaccgtttaacggttaccgggtacggggtaaccgggaaccgtaagggtcccgttacggacccgttacccggttcggacccggttaccgaaccggtaccccggaacgtacccggttacccgccccccggttacggtccctaccttcccgttaccgttccccctaaccccgttcctacccggtaccttacccgtaacgttcgaccggtccgggacgtcggaccgacggtcccgg

SEQ ID NO: 62154 - DNA, 627 bp, Homo sapiens
  misc_feature: GYAE6OF02JJONM.15.1.A01.1.454.CMB.1.raw
  modified_base (417)..(417): a, c, t, g, unknown or other
  misc_feature (417)..(417): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttgggggttatcaccttgtctcctggtaccaaccacccaccccggcacgacgacccccaaactcatgattatgacggccaactaacgccgaccctcgacgggtctttactaactcgtcttctctcggctaccaagtctggacaacgaccggcctccctagactaactcgtcgtgggtcctaccgaggtctacggacgacggacgtacttaattacttacgtacgtcgtntctctaatagttaaggtaacgttaataactacttactaacttagttcggacggtacggacctaagtctacgtacccgtctcgcgttacgacgccgaacgtcctccggaccccttcggacctaccgtcgttccgtccccgtccctcccgttacgtacccgttacgttaaccggacgtaccggtacggccgggtacgtcggtacggtaccgg

SEQ ID NO: 62155 - DNA, 602 bp, Homo sapiens
  misc_feature: GYAE6OF02G9SFO.15.1.A01.1.454.CMB.1.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttggggttatcaccttgtctcctggtaccaacacccaccccggcacgacgacccccaaactcatgtatttatgacggccaacgtaagccgaccctcgagggtcctttctaatccgtctttctctggcctaccaagtctggacaaccaccggtcctcctcgactaatctcgtcggcctcgaggtctgaaccgacgaggtacttaattatacgtgctcgctcatatagtaagttacaactactatactagtcggacggacggacagctacgaccgtcgtgcgtcgacgtaccgaaggcctccgtccccgtcggtacctaccgttccgttaccgttcccctaccccgttcccgtaccgtccgtaaccgttacggaccgttacggaccggtacgggtccgtagggaccggtaaccggg

SEQ ID NO: 62156 - DNA, 676 bp, Homo sapiens
  misc_feature: GYAE6OF02H9SNF.15.1.A01.1.454.CMB.1.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgtagttgggtttgggggttactcctacctttgtccttccgtacggtaacccaaccaacccgaccccggacacgaccgacccccaaactcatagtattatgacgccacgtaacgccgaccctgacggtctttactaactcgtcttctcgtcggtcctaccgaacgtcgtacggacctaaccgaccggtccctacccgtacgacctaactcgtcgtcgggtctccgaggtcgtacggacggacgacgtacttaaatttacttacgtgtcgtcgtacttactaagttacgtaggtaaacggtttaactaaacgtacttaacttaacttacggttaccgggaacgggtacgggaaccaacgtcgtcgtaccgtccgtcgtcgtcacgacccgtacggtcctacccgtcccgtcgtacctacttccgtcccgttcccgcccttaccgtccgtaccgtaccgtacgtacgtacggcggtcgggacgttcggcgtaacgg

SEQ ID NO: 62157 - DNA, 810 bp, Homo sapiens
  misc_feature: GYAE6OF02JMMJH.15.1.A01.1.454.CMB.1.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttgggggttatcaccttgtctcctcggtaccaacacccacccggcacgacgacccccaaactcaatgtatttatgacggccaacgtaaacgccgaacccctcgtaacggggtccttttactaacgtccgttctttcttcgtcggtaccttccgtaaacgttccgttacgggacctaaaaccgtaccgggtccccttaccccgttacggaaaccaaactttcctccggtcggggtacccttccggaacgggtccgtacggaaccggaacggtacgggtaactttaaacgtttactttaacccgtgttacgtcgtaccgttaccttaataaggttaacggtaaagggtttaaaccttaaaccgtaactttaaacgttacgtttaacggttaccggggacggggtaacggtaaaccggaaacggtcgtaaacccggtacccggttaccggtcggtaccgttcgaacccgacccggttaacggcccgtttccggcccccgttcgggtacccttaacccgttccttacccgggttccccctaacccgttcccgtacggtaccccgttacgggttaaccaccggttacggaccgggttccgggaccgttacgggacccggtaaccggg

SEQ ID NO: 62158 - DNA, 813 bp, Homo sapiens
  misc_feature: GYAE6OF02JUV3L.15.1.A01.1.454.CMB.1.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcacatctctgcactgaaccagcagtgtagttggttgggggttatcctaccttgtccttccgtcggtaaccaaccacccacccggacacgaccgacccccaaatctatacgtatttagcgtacggacctaacgtaacgccgacccctcgacgggtctttacaagttccgtcttctcgtacggtaccttaccgtaacgtccgtacggaccctaaaccgtcccggaccccttacccgtaacgtaaacccgtaacgttcccgttccggttaccggggtacccgtaccggttacgggtacccggttaccgggaaaaccggttaccgggtaacgggttaaccctttaaaacttttacgtttaaccgtacgtccgttacggtaccccttagtaaacgtttaagggttaacggttaaacgtttaccgttaaaaccttaccgtttaaagttaacccttaacgggtttccggggaaccgggtaacggtaaccgtaaacggtcgttaccgggtaacccggttcgtcggtaccgtaccggtaacgacccgtaacgggttccctaccccggttcccgtacgttaccgacctttccctccggttcccctcccgttaccgttcgtacctaacggttacgccgtacggtaccgggtcggcgtacggtaccgcgg

SEQ ID NO: 62159 - DNA, 697 bp, Homo sapiens
  misc_feature: GYAE6OF02HQ12K.15.1.A01.1.454.CMB.1.raw
  modified_base (592)..(592): a, c, t, g, unknown or other
  misc_feature (592)..(592): n is a, c, g, or t
  modified_base (616)..(616): a, c, t, g, unknown or other
  misc_feature (616)..(616): n is a, c, g, or t
tcagtctacgtagccacgaccggtgctcgatttagacgtctcatcagggccgtgggctctgctgctcctcactctcctcactcaggacacgagggtctgggcccagtctgccctgactcgagcctgcctccgtgtctgggtctccgtggaccagtcgatcacctacgtctccgtgcacgtaggaaccagcgaggtgtagttcggttaggggttactaccgtacgtttcgtccgtccgtacggtaaccaaccacccgacccgacgtaacgacccgaacccctaaactctagtagttatttagacggaccggacctaacgtaaccgcccgtaccgtacgtacgggttctttaacaacgtccgttcttacgtcgtcggtcctaacgtagtcgtacggacgaaccgtaccgtaccttaccgtagtactaacgtctccggtacggtctaccgaggtccgtaacggacggtaaggacggtaactttaaagttaacgttcgtacgtactacgactacgtaaattaggttaacggtaaacgttaactaaactaattacttaagtcggttacgggacggtaagaaccgagcctacggtccngtaggtccacgacgaccgagtccncccgtaccgtacgtctcgttcccgttcgtaccccgcttccgtccgtagtaacgtgacgtgaggtccgaggtcgacgtacgg

SEQ ID NO: 62160 - DNA, 653 bp, Homo sapiens
  misc_feature: GYAE6OF02I9NKC.15.1.A01.1.454.CMB.1.raw
  modified_base (360)..(360): a, c, t, g, unknown or other
  misc_feature (360)..(360): n is a, c, g, or t
  modified_base (366)..(366): a, c, t, g, unknown or other
  misc_feature (366)..(366): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttgggggttatcaccttgtctcctcggtaccaaccacccaccccggcacgacgacccccaaactcatgtatttatggaggccaactaagccgacctcgaggtcttctaatcgtcttctctgcctcagtctcggcaacgccggcctcctcgacaatctcgtggctccgagtcngaacgngacggtacttaattacttactgctcgtctactaattacgttaggtaaagtttaacaaactacttaatacgttacgttcgggtacgggacgggaacgaacggtctaccggtaccgttccgtcgtacgtaccgaaccgaccccgaacgggtcccttacccgggtcccccgttccgggtaccctaccgttccgttcccgttacccccgacccccttccgtaaccgtccgttaacggtaccggtaacgtacggggaccgggcgggtacccggtagggtacccggaaccggg

SEQ ID NO: 62161 - DNA, 771 bp, Homo sapiens
  misc_feature: GYAE6OF02H75IB.15.1.A01.1.454.CMB.1.raw
  modified_base (198)..(198): a, c, t, g, unknown or other
  misc_feature (198)..(198): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttggggttanctacttgtctctggtaccaacaccgacccggcacgacgaccccaatcatgtattagtgaggaccacgtaagccgacccgtgacgggtctttactaactcgtcctttctcgtcggcctaccgtaagttcctacgggacctaaccgaccggtccccttacccgtagtaacctaacgttccgtcgtacggggtacctccggaggtcctacggaacggaaccggtaggtaactttaaatttacttacgtgtcctgtactactaagtacgtttaagggtaaacggtttaaataaacctaacgttaacttaacgttaacggttccggggaacgggtaacgggtaacccaacggttcgtaccggtacccgttcgttacggtacccggtacgaacccggtacccggtaacgtcccgttacccggccccgttaccgggttacctaccgtttcccgttaccccgtttaccccccgtaccccgttacccgttacccgggtacccgtttaaccggtaccggtaacccggttacggggtaacccggggtccggggttaccgttaaccgggaccggtaaacccgggg

SEQ ID NO: 62162 - DNA, 891 bp, Homo sapiens
  misc_feature: GYAE6OF02IX6VT.15.1.A01.1.454.CMB.1.raw
tcagtctacgtagccacgaccggtgctcgatttagacgtctcatcagggcctgggctctgctgctcctcactctcctcactcaggacacagggtcctggcccagtctgccctgactcagcctgcctccgtgtctgggtctcctggacagtcgaatcaccatctcctgcactggaaccagcagtgatggttggggttatcaccttgtctcctggtaccaacacccaccccgcacgaccgaccccaaactctactgtaactttatcggaacggacctaacgtaaacggccgacccctacgacggggttactttaccgtaaagtccgtacttccttcgtcggtccttaaccggtaacggttcgtcggaaccgtaaaccgtacccgggtaccccttacccggtagaaacctaacgttccgttcggtcgggggacccttaccggaacgggtacctacggggaaccggtaaccgggaaacgggttaaccttaaacgtttttaaccgttaaaccggtttcggtacccgttacggtacccttaaccgttaaacgttaacgggttaaagggtttaaaggtttaaaccttaaacgtaacctttaaacgttacgttaacggtttaccgggaccgggtaaacggggacccgtaaaggtaccgtaccgtacccgggttaccctcggtacccgttaccgaaaccggtccggtaaaccggtcccgttaccccggacccccgttttacccgggaacttccccggttacccggtttcccctttaccccccgggtaccccttttccggtaaccccggtaacccggttttaaccggtaaacggtttaccggtaccggggtaacgggttcccccggggacgggtttaccggggaaccccggttaaccgggg

SEQ ID NO: 62163 - DNA, 712 bp, Homo sapiens
  misc_feature: GYAE6OF02H1OLJ.15.1.A01.1.454.CMB.1.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatccaccatcctcctgcacgtacggaaccagcagtgagttgggttggggttactctacctttgtcctcctacggtaaccaaccacccgaccccggcgacgaccgacccccaaactactacgtagtactttatggacggccaacgttaacgccgtacccgtcgacggttctttacgtaattccgtctttctcgtcggtcctaccgtagtcgtcgaccaaccgccgccttaccgagacgtaactcgtcgtacggctcgagctacggacgacgagttactaacttattacgtgtctcgtactactaagttagtaacggttaaagtttaacgaaacttaacgtacgtttaaacgtacgttacggggacgggtaaccggaaaccgtagtacccgttaccggaacccggttccgttccgcggttacccgaccgaacccggaccgtacccgttccccgccccgtcggtaccttaccctttcccgtaccctccccgtaccccgtttccgtaccgtaccgttaaccgtcggacgttcggacgggtcggtacggtacggacggtaacgg

SEQ ID NO: 62164 - DNA, 876 bp, Homo sapiens
  misc_feature: GYAE6OF02GQXWR.15.1.A01.1.454.CMB.1.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgacacgtaggaaccagcagtgagttgggttcggggttatctacttgtccttcctacggtaacccaaccacccgaccccgggcaacggacccgaccccccaaaactcctattagttaattttagacggaacggacccttaagaaaaccggtccgaaccccgttacggtacggggtttccttttacgtaaacgttcccgttcctttccgtcgtcggtacctacccgtaaggtcgtacggaccaaaccgtcccgtccccgtacctacgaactacttccgtcggtccgggaccttcgacgtacgttcggaaccgtacggtaacgtaacctttaaagttttacttacggttcgtaccgttccgtaacttaccgtaaagtttaacggtaaacggtttaaaggtttaactaaaaccgttaactttaaacgttaaccgtacgggtttaccgggaaaccggggtaacccggggtaaccttaaaacggtcccggtaaccggttaccccggtttacccggtaccggtacgtttaacccgaaaccggtaccccggaaccgggtttcccgaacccccggttaccccggttaccggttaccgtacccgttttccccgtcccggtttaccccccgtccccgttaccgttcccggtttacccgtaaccggttacgttaaccggtcggccgggttacccggtcgggtaccgggttacgaacccgggg

SEQ ID NO: 62165 - DNA, 951 bp, Homo sapiens
  misc_feature: GYAE6OF02GB254.15.1.A01.1.454.CMB.1.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgagttggtttgggggttactactaccgtttgtccttcctacggtaaccaaccacccgaccccggcaacgaccgacccccaaactcagtagtaattttagtggacggccctaacgtaaaccggcccgtacccccgtagtacggggttccttttacctaaagttccgtcctttccgttccgtcgggtacctaccgtaagttccggtcggacccaaaccgacccggtcccctccccgtaggtaaccaacttccctacggttacgggtcctaccgtacgggacgttacggaaccggacgggtaacggtaactttaaacgttttaacgttaaccgttcggtccgttacggttacccttaccgtaaagttaaacggtttaacggttaaaacgggttttaaacgtaaaaaccctttaacgtttaaaaccgttttaaaccgttttaacccgggtttaccggggggaaacccggggtaaaccggggtaaaccccttaaacgggtacccgtttaacccggggttaaccccccggtttaccggttaccgggttaaccccgttaccggaaccccgggttaacccggtaaacccggttccccggttacccccggtccccccgggtttccgttaacccggtttaccctttacccgtttacccggttacccccccttcccgttcccccgttaacccggtacccgtttaacccgggttacgttacccggttaggggtaaccccgggcgggggtttacccggtacgggtacccgggtaaccgggg

SEQ ID NO: 62166 - DNA, 736 bp, Homo sapiens
  misc_feature: GYAE6OF02GZTUU.15.1.A01.1.454.CMB.1.raw
  modified_base (275)..(275): a, c, t, g, unknown or other
  misc_feature (275)..(275): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactcggaaccagcagtgtagttggtttgggggttatcctaccgttgtcctcctggtaacccaaccacccaccccggcacgaccgcccccaaactcatgtacttttanggacggacctactaacgccacccgtcgtacgggtcctttactaacgtccgtcctttccgttccgtcgggtccttacccgtaacgtccgttacgggacccaaccgtacccgggtccccttcccgtacgaacctaacgttccgttaccggtggggtccctccggacggtctacggaacggacggtacggtaacttaattacgttactcgtctcgtacttacattaagtagtaaacggttactaaacgtacttaaacgtactttaggtaccgggacgggtaaccgggaactaaccggtctaccggtcccgttccgtacgtaccgtccgaccgacccggtaccggcccgttcccgtacccccgttcgtcccgtacgttcccgttcccgttaccccgtccctcccgtaccgtcccgtaaccgtacggtacgtacggtaccgggccggtggtaccggaccgtacggg

SEQ ID NO: 62167 - DNA, 793 bp, Homo sapiens
  misc_feature: GYAE6OF02JFLRA.15.1.A01.1.454.CMB.1.raw
tcagtctacgtagccacgaccggtgctcgatttagacgtctcatcagggcctgggctctgctgctcctcactctcctcactcaggacacagggtcctcgggcccagtctgccctgactcacgcctgcctccgtgtctgggtctcctggacagtcgatcaccatcctcctgcacgtggaaccagcagtgtagtggttggggttactctaccgttgtctccgtacgtaccaccacccgaccccggcacggtaccgacccccaaacgtactagtacgttaattttacgcggaacggtacccaaacgttaaccggaccccggtacccctaccggaacgggttccttttaactaaccgttccgtccctttccgtcgttcgggtacccttaacccgtaaggttccgtacggtaacctaaaccggtacccggtcccctccccgttacgaacctacgttccttccggtacggtcccgtaacgtcggccgttacggaaccggtacggtaacgtaacttaaactttacgttacccgtgtaaccgtcgtacctacgttaagttaacgtaaggttaaacgtttaactaaacgtaacgttaataccggttacgttacgggacggggtaaccgaacgtacgtcgttaccggactccgtacggtacctcgaccgaccgtacggtaccgtcccgtaccccgttgtccgttaaccgttccgtacccgtccccgtccccttccggttacccgacgttaaccggtaccgtcggtaccggttcgggacccggtacggtccggaccgtaccggg

SEQ ID NO: 62168 - DNA, 710 bp, Homo sapiens
  misc_feature: GYAE6OF02G1P1S.15.1.A01.1.454.CMB.1.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactaggaaccagcagtgagttggttggggttactctacctttgtctcctacggtaacccaaccaccccgaccccggcacgaccgacccccaaactccatgtactttagtagaggcctaactaacgccgacccctcgtaggtcctttacttaactccgtctttcctcgttcggtccttaccgtaagtcgtaggacctaaaccgacccgcctacccgtgaacctactcctcgtcgggctaccgcgtcgtacgacggacgtacggtattaacgttattacgtcgctcgctactagttaacgtaggtaaacgttaacaattacttaagtactacgggttacgggacggtaaccgggaaacacggtcttaccggtacccttccgttaggacccgttacgaacccgacccgttaacggcccgttccccggtacccgtacgggtccctaccgtttccgtccccgttaccccgtccccgttacccacggttacccttaccggtagtaccgttacggccgggtaccgggtccggttacggaccgtaccggg

SEQ ID NO: 62169 - DNA, 714 bp, Homo sapiens
  misc_feature: GYAE6OF02HN69X.15.1.A01.1.454.CMB.1.raw
  modified_base (169)..(169): a, c, t, g, unknown or other
  misc_feature (169)..(169): n is a, c, g, or t
  modified_base (177)..(177): a, c, t, g, unknown or other
  misc_feature (177)..(177): n is a, c, g, or t
  modified_base (229)..(229): a, c, t, g, unknown or other
  misc_feature (229)..(229): n is a, c, g, or t
  modified_base (249)..(249): a, c, t, g, unknown or other
  misc_feature (249)..(249): n is a, c, g, or t
  modified_base (374)..(374): a, c, t, g, unknown or other
  misc_feature (374)..(374): n is a, c, g, or t
tcagtctacgtagccacgaccggtgctcgatttagacgtctcatcagggcctgggctctgctgctcctcactctcctcactcgaggacacagggtcctgggcccagtctgccctgactcagcctgcctccgtgtctgggtctcctggacagtcgatcacatctactgcnctggaccngcagtgatggttggggtatctactgtctctgtaccacaccacccgcacgacnccccaatcatagtatttagngacggtacctacgtaacggccacccctacgacggttacctttactaactcggtcttcctcgtcgacctacgtaactcgaggacccaacgacccggtcctaccacgacaaccttcgtcgacggtcnccgaggcctaggacgtacgacggtaaacttaacgttacgtactagccgtagccgtctagtaacgtaacggtaaagttactaaacgttactaacgtttaacgttacggttacggacgggtacggaaccctaacggccgtttacgtacccggtacgtcggtaaccctaccgggtaaaccgtacccggttaaacccggccccgttaacgggtcccccgtaacggttcccgtaaccggtttcccgtccggtttcccccgtaacccgtttcccgaccggttaaccgtaccgtagggtacctacgggggtaccggtcccggggtcgtaaccggggtaccaaccggg

SEQ ID NO: 62170 - DNA, 589 bp, Homo sapiens
  misc_feature: GYAE6OF02HDJR5.15.1.A01.1.454.CMB.1.raw
tcagtctacgtagccacgaccggtgctcgatttagacgtctcatcagggcctgggctctgctgctcctcactctcctcactcaggacacagggtcctgggcccagtctgccctgactcagcctgcctcgtgtctgggtctcctggacagtcgatcaccatctcctgcactggaaccagcagtgatggttgggggttatctaccttgtctcctggtaacccaacacccgaccccggcacgacgcccccaaactcatgatttatgacggccactaagccgacccctcgagggtctttactaatccgtctttctcgtcggcctccaagtcgtggccaacgaccggcctcccagacactctcgtgggctcgagctagacgacgagacttaattactatgctgtctctatagttaggtaagttactaaacacttaatacttagtcggacggaggaccagctagaccgtctgccgtcgacgaccagtccgtccgccccgtcgtacctccgttccttccgttaccccgtcccttacccgtcgtaccgttaacgtacgtacgtcggaccggtccgggtacggtcggacgtaaccggg

SEQ ID NO: 62171 - DNA, 551 bp, Homo sapiens
  misc_feature: GYAE6OF02FJOUW.15.1.A01.1.454.CMB.1.raw
  modified_base (257)..(257): a, c, t, g, unknown or other
  misc_feature (257)..(257): n is a, c, g, or t
  modified_base (277)..(277): a, c, t, g, unknown or other
  misc_feature (277)..(277): n is a, c, g, or t
  modified_base (299)..(299): a, c, t, g, unknown or other
  misc_feature (299)..(299): n is a, c, g, or t
  modified_base (317)..(317): a, c, t, g, unknown or other
  misc_feature (317)..(317): n is a, c, g, or t
  modified_base (326)..(326): a, c, t, g, unknown or other
  misc_feature (326)..(326): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttggggttatcaccttgtctcctggtaccaacacccaccccggcagacgcccccaaactcatgatttangaggccactaagcgaccctnagggctttctaatcgcttctcngctccaagtctggcaacncggcctccngacatctcgtggctcaggctgacgacgagctaattatactgtctgctacatagtagtaagttaataactactaattactagttacgggcggacggacaagtctacgaccgttctcgtcgtcacgaccgaacggcctcgccccgtcgtctccgttctccgttcccgtcccttcccgtccgtccgtaccgtacgacgtcggaccggcgggtcgtcggacggtaacgg

SEQ ID NO: 62172 - DNA, 801 bp, Homo sapiens
  misc_feature: GYAE6OF02H14F1.15.1.A01.1.454.CMB.1.raw
  modified_base (300)..(300): a, c, t, g, unknown or other
  misc_feature (300)..(300): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtcgtgggtctccgtggacagtcgactcacctatctcctgcactaggaaccagctaggtgtagtttggggtttacggggttactccttaccgtttgtcctaccgttacggtaacccaaccacccgaccccggacgaaccgaccgaccccctaatctatgttaatttagngacgacctacgtaacgccgtaccgtacggtacggttcctttactacgttccgtctttccgtacggtcgtacctaccgtagtcgacgaccaaccgtcccgtacctaccggtactaccgtacttccggttcggccggtacctacggacggtcgtaacgggaaccggtacgtacggtttaactttaaactttcgtacgtcgtccgttactaccttaacgttagttaacggttaaacggtttaaacgttaaaccgttaaacttaaacggttaaccgtttaaccggttaccgggttaaccgggaacgggtaaccggtaaccgtaccggttaccgttacccggtacccgttccgtacggtaccgaccggtaacccaccggtaccgttccccgtccggtaccccgttaccgtcccgttacctttccccgttacccttcccccgttaaccgttacccgtcgttaaccgttacggcgtacgttcggacggttccggacgacggtacgacg

SEQ ID NO: 62173 - DNA, 789 bp, Homo sapiens
  misc_feature: GYAE6OF02FL795.15.1.A01.1.454.CMB.1.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctccgtggacagtcgatcaccatcctcctgcacgtacggaaccagcagtgtagttgggtttgggggttactcctacgtttcgtccttccgtacggtaacccaacccaaccccgacccccggacgaacggtacccgaaccccctaaaactctatacgttaatttacgcggacggtaccctaacgtaaccgacccgaaccccgtacggtacgggttaccttttacgtaactccgttcctttacctcggtcggtacctaccgtagtccgtacgaccgaaaccgtcccggtacccttcccgtagtaaacctacgttctaccggtggtacccgtcgacggtccgtacggacggacggtaacgttacttaaagtttacgttactgtacgtcgtactatacgtagttaacgttaacgttaaactaactaacttaacgttacgtacgggttaccgggacggtaaccggaacgacgtaccgtaccggccgtacgtcggaccgttcgaacccgtaccgacgttcccgtaccccgtccccggttacggtcccttccgtttacccgttcccgttccccggtccccttaccgtcccggtaaccgttaaccggtaccgtcggtaccgggtaccgggtccggaccggttacgaccgggtaaccgg

SEQ ID NO: 62174 - DNA, 671 bp, Homo sapiens
  misc_feature: GYAE6OF02GS65F.15.1.A01.1.454.CMB.1.raw
  modified_base (265)..(265): a, c, t, g, unknown or other
  misc_feature (265)..(265): n is a, c, g, or t
  modified_base (337)..(337): a, c, t, g, unknown or other
  misc_feature (337)..(337): n is a, c, g, or t
  modified_base (348)..(348): a, c, t, g, unknown or other
  misc_feature (348)..(348): n is a, c, g, or t
  modified_base (397)..(397): a, c, t, g, unknown or other
  misc_feature (397)..(397): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttgggggttatcaccttgtcctcctcggtaccaacacccaccccggcacgaccgacccccaaactcatgtatttagngacggccactaacgccgaccctcgagggtctttctaatccgtcttctctggcctaccaagtcgtggccaacnccggccctccngaccatctcgtgggctcgagctacgacgacggagtactaatttattacncgtactgtctactaataagtaggttaaagttaacgtaaacctagttaacttaacgttacggttaccgggacggggaacgggaacctaacggtacgtcggtaaccccgttcggttcggaccggtaccgaaccggtacccgtaaaccgggtcccgttccccggtccccccgttacggtcccttaccgttccgtttacgttcccgtcccggtccccttacccgtccgtaccgttaacgtacgtacggtcggaccgggtcgggtccgtacggaaccgg

SEQ ID NO: 62175 - DNA, 722 bp, Homo sapiens
  misc_feature: GYAE6OF02JE1TX.15.1.A01.1.454.CMB.1.raw
tcagtctacgtagccacgaccggtgctcgatttagacgtctcatcagggcctgggctctgctgctcctcactctcctcactcaggacacagggtcctgggcccagtctgccctgactcagcctcgcctccgtgtcgtgggtctccgtggactagtcgatcaccatcctcctgccacgtaggaaccagcgagtgtagttgggtttagggggttactacgtaccgtttcgttccgtaccgttacggtaacccaaaccctaccccgaaccccggacgacgaacccgaccccctaaacctcatacgtaactttagtacgacggaccctaacgtaacgaccggtacccgtaccgtacggggttcctttactaaacgtccgttcttccgtaccgtcgtcctacccgtacgtcgtcggaccgaaccgcccggtccctcctacgactagtcctcgtccggtcctacgacgcgtacgacggacgtagtaacttaattacgttacgtgcttcgtacctataactagtaaggttaaacgtataaactaacttactacgttacggcgggacggaaccggtacgtagcgtaccgccgttcgtacgcgtaccgaacgtaccgaccgtcgtccccgtacccgtacggtccctaccgttccgttacccggtccccgtaccctccgtaccgtaccgtacgtacgtacggtcgacgggcggtacgacgggaccgtaacgg

SEQ ID NO: 62176 - DNA, 919 bp, Homo sapiens
  misc_feature: GYAE6OF02I70A5.15.1.A01.1.454.CMB.1.raw
  modified_base (550)..(550): a, c, t, g, unknown or other
  misc_feature (550)..(550): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtcgtgggtctcctggacagtcgatccaccatctccgtgcacgtaggaaccagcgagtgaagttgggtttgggggttactccgtaccgtttcgtccgttcccgtacgggtaacccaaacccgacccccgacccccgggtaccaacgggaacccaacccccctaaactacccgattacggtagttttaacgtaggtaacggaccccgtaacgtaaccggcccggaacccccctttacggacggggttaccttttaacgttaaccttccggtccttttaccgtcgttacggtcccttacccgttaaggtccgtacgaccgtaaccgacccgtccttacccctagaactaactccgtcgtacgggtcccacggtacgcgtaggaacggtccgaagttctaaatttacgttacctgttaccgngttaccgtactaacgtagttaaacgtaaggttaaaccttaacgttaaaccgttaactttaaccgttttaacgggtaaccggggtaaaccgggtaaaacggggttaccgtaaacggtacccggttaccggggaaccccgtttaacccggtcggttaaccccggttagggaaccccgtaacccgggtaaccgggttccccggtaccccggccccccggtttaaccgggttaaccgaccctttaccccggggtttcccccttccccccgggtaaccccggttccccttaccgggtttaccctaaaccgggttacccgtaacgggttaccggaccggggtacccgggtcggtaaccgggaccgtacccggggg

SEQ ID NO: 62177 - DNA, 963 bp, Homo sapiens
  misc_feature: GYAE6OF02HA954.15.1.A01.1.454.CMB.1.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgagttggttggggttactctacctttcgtccttccgttcggtaacccaaaccgaccccgaccccggcaacggaccgacccccctaaaactcaagttagtaacttttagcggtacggccctaactaacggcccgtacccccgtaggtacgttaccttaactacgttccgttccttcgtcggtcgtaccgtacgtacgttcgacgaaccgaccggtacccgtccctacgtaaccgaacttaccgttccgtcggtcccggtacctaccgggacggtaccgtaacgggaaccgtaacggggttaacttaacgttttaaacgtttacgttcgtaccggttcgttacgtccgttaagttaacgtttaacgggttaaacggggtttaaacttaaaaccttaaccgttaaccgtttaaacgtttaacccgggttaccgggttaccgggggaaaccggggttaaacccggaaaccggttacggttaaaccccggtaccccgggtttaccccgttaccgggtttaacccggtaccccgtaaaccggggtaccccggttaaacccgggttacccggtttaccccccgggtcccccgggtttcccccgggttacccgttaccccggtttaccccgtttaccccggtttcccccccgttaaccccccgttccccgtttaccccgggtaacccgttttaaccgggtaaacccggtttaacccggggttacgggttaccccggggtaggggttttacccggggccccggggtttaaggaaccccggggaacccgg

SEQ ID NO: 62178 - DNA, 750 bp, Homo sapiens
  misc_feature: GYAE6OF02FRY2F.15.1.A01.1.454.CMB.1.raw
  modified_base (315)..(315): a, c, t, g, unknown or other
  misc_feature (315)..(315): n is a, c, g, or t
  modified_base (488)..(488): a, c, t, g, unknown or other
  misc_feature (488)..(488): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtcgtgggtctcctggacagtcgatcaccatctcctgcactcggaaccagcagtgtattgggtttaggggttactcctactttgtccttacctacggtaacccaaccacccgaccccggcacgacccgaccccaaactcactgttatttatcggacggacctaactaagaccggacccctacgngggttaccttttacctaacgtccgttaccgtttccgtcgtaccggtcctaccgtaacgttccggtcgacgaaccgacccggtccctcccgttaggaacctaacttccgtcggtcggtcccgtacgacggtctacggaacggacggtacgtaactttaaatttacgtacgtacncgtcgactactaagttagtaaggtaaagtttactaaactacgtttaactacgtttacggtaccggggacgggaacggtacgtaaaccgggtctacccggtaccgtcgtaccggtactccggaacccgtaaccgacgtcccgttccccggtcccgtccggtacttcccgttccctttccccggtaccccgttccccttaccggtcccggttaaaccgtcgtacggtcgtcgggtacgggccggtcggtaccggacgtaaccgg

SEQ ID NO: 62179 - DNA, 721 bp, Homo sapiens
  misc_feature: GYAE6OF02HM1FU.15.1.A01.1.454.CMB.1.raw
  modified_base (469)..(469): a, c, t, g, unknown or other
  misc_feature (469)..(469): n is a, c, g, or t
tcagtctacgtagccacgaccggtgctcgatttagacgtctcatcagggcctgggctctgctgctcctcactcctcctcactcaggacacagggtcctgggcccagtctgtcctgactcagcctgcctccgtgtctgggtctccgtggacagtcgatcaccatctcctgcactggaaccagcagtgtagtggttaggggttatctactttgtcctccgtcggtaaccaaccacccgacccggcaacgacccgaccccaaactcattatatttcgtacggacggacctaactaacgccgtaaccccgtgtaacgggtccttttacgtaacgttcgtactttcgtcgttccggacctaccgtaagtccgtacggaccaaccgtccggtccctaccgtacgacctaacttccgtcgtcgggtacctacggagttcgacgacggtaacgtacgtaactttaacttacgttacncgtacgtctactactaattagtaacggtaaagttactaaactagttaactacggtagtccgggaacggtacggaacgacgtacgtaccgtaccgtcgtcgtaccgacgaccgaccgtacgtccgtcccggtcccgtacggttacctaccttccgttaccccgtttaccccctcccgttaccgtccgttaaccgttaacggtaacgttaccggacgggtaccggtccgggtaacggtaccggtaacggaccgg

SEQ ID NO: 62180 - DNA, 809 bp, Homo sapiens
  misc_feature: GYAE6OF02HDT7Z.15.1.A01.1.454.CMB.1.raw
  modified_base (179)..(179): a, c, t, g, unknown or other
  misc_feature (179)..(179): n is a, c, g, or t
  modified_base (488)..(488): a, c, t, g, unknown or other
  misc_feature (488)..(488): n is a, c, g, or t
  modified_base (713)..(713): a, c, t, g, unknown or other
  misc_feature (713)..(713): n is a, c, g, or t
tcagtctacgtagccacgaccggtgctcgatttagacgtctcatcagggcctgggctctgctgctcctcactctcctcactcagggacacagggtcctgggcccagtctgccctgactcagcctgcctccgtgtctgggtctcctggacagtcgatcaccatctcctgcactggaaccngcagtcggtagttggggtttgggggttactcctaccgtttcgtccttccgttacggtaacccaaacccgaccccgaacccccgggccaacggacccggtacccccctaaaactcctaagttacggtaattttacgtaggaccggtaccctaacgtaacggaccccggtaaacccccttccggtaagggtccctttttactaacgttccggtcctttaccttccggtgtacccttccggaacgttcgtcggaccgaaaccgtaccggtcccctaccgtcgaactacgttcacgtcgggcctacggaccgngttacgaacggtacggtaagttacgtttaaacttatttccggctcttccgacttataacgttagttaacggtaaagtttaaaccgtaacttaacttaagttaaccgttcgggttacggggaccgggtaacgggaacccgaagttcccgttacggacccgttcgccggttactacccggaccgtaccgaccggttccctacccgggtccccgttaaccggttcccnccgttcccgttccccgttccccgttccgtacccggttaccaccggtttaacgacggtacgttaggggccggtccggacggttacggacccgacggg

SEQ ID NO: 62181 - DNA, 800 bp, Homo sapiens
  misc_feature: GYAE6OF02HUOPI.15.1.A01.1.454.CMB.1.raw
  modified_base (167)..(167): a, c, t, g, unknown or other
  misc_feature (167)..(167): n is a, c, g, or t
tcagtctacgtagccacgaccggtgctcgatttagacgtctcatcaggggcctgggctctgctgctcctcactctcctcactcaggacacagggtcctgggcccagtctgccctgactcagcctgcctcgtgtctcgggtctctggacagtcgatcacatctctgcncgtgaaccagcagtgtagttgggttggggttactcacctttcggtcctcgtacggtaaccaactacccgacccggacgacgaccgacccctaagtacactagttacgtttagtcggaaccggtacctaacgtaacggccaccccgtacggacgggttactttacgtaaccgtccgtcttcctcgtcggccttaaccgacgttcggtaccgaccgaaaccgtcccggtccctaccccgtagaaccgtactccgttaccggtcggttaccgaccgtacggtcgtaacccgggtacgtaaccgggtacgttaaccgtttaactttacgttaaccggtcgtcccggtcttaccgtacgttaagtaaacggttaaacggttacggtaaacttaaaccgtaacgttaaacgttaccgttacggttaccgggggaccgggtaacggaacccgtacggtaaccgtccggtaacccggttcgaccggtaccctacggacccgtaccggtaccgtaccgtccccgttacccgtcgtttccaaccggtttcccgtaccggtttcccccgtcccggttcccgtacgtaccgtaaccggttaggacccgtagggcccggttacgggtcgtacggtacccggaacgg

SEQ ID NO: 62182 - DNA, 820 bp, Homo sapiens
  misc_feature: GYAE6OF02F2FM6.15.1.A01.1.454.CMB.1.raw
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcacttgtctctggtaccaacacccaccccggcacgacgacccccaaactccatgtatttactgaggtccaacgtaaacgccgtacccctcgacgggtcttttacctaacgtccgtctttcctccgttcggacctaccgtaacggttcgttacgggaacccaaaccgtaaccgggtccccttaccccgttacggaaacctaaaccgtttccgtttaccggtcggggggttaccctcccggtaagggttaccgttcggaaaccgggtaaccggaaacgggtacgttttaaaactttaactttaacggttcgtaccgttcgggtaccttaacctaaaggtttaacgttaaacgggtttaaacgtttaaacttaaaacccgtttaacttaaacgttaaccgttaacgggtttacccggggaaccggggtaaacgggtaacccgaaacggtccgtaacggttaccccgggtccgttacggcgtaccgacgtccccggaacggtccctacccggtcccccgttacgggttacctccgttaccgttcccggttacccctccccggtccgttaccgtaccgttaccgaggtaccgtcggtaccgggcggtccggttaggcccgtaaccggg

SEQ ID NO: 62183 - DNA, 629 bp, Homo sapiens
  misc_feature: GYAE6OF02FL1S1.15.1.A01.1.454.CMB.1.raw
  modified_base (261)..(261): a, c, t, g, unknown or other
  misc_feature (261)..(261): n is a, c, g, or t
  modified_base (268)..(268): a, c, t, g, unknown or other
  misc_feature (268)..(268): n is a, c, g, or t
  modified_base (358)..(358): a, c, t, g, unknown or other
  misc_feature (358)..(358): n is a, c, g, or t
  modified_base (378)..(378): a, c, t, g, unknown or other
  misc_feature (378)..(378): n is a, c, g, or t
  modified_base (607)..(607): a, c, t, g, unknown or other
  misc_feature (607)..(607): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgagtggttgggggttaatctaccttgtcctctcggtaaccaaccacccgaccccggcacgacgacccccaaactcatntatttancgaggccaactaagccgacctcgaggtctttacaatccgtcttcctcgtcggtcctaccgtaagtctcggacaaccgccgtccctccgtnaacgtactctcgcggctcgnggcgtagacgacggagtacttaagttacttacgtcgcgttgcctactagttagtaggtaaagttaaactaacttactaacttacgttacggttacgggacgggtaacggaaccgtaacgtacgtccggtaaccgttccgtggaccgtacgacccgaccgacggtcctcccggccccgttcggtcctaccgttccgtcccgtcccgtcctccgtcgtcctacgtagtacncggcggtcggcgtcggatacgg

SEQ ID NO: 62184 - DNA, 824 bp, Homo sapiens
  misc_feature: GYAE6OF02FHANK.15.1.A01.1.454.CMB.1.raw
tcagtctacgtagccacgaccggtgctcgatttagacgtctcatcagggcctgggctctgctgctcctcactctccctcacgtcaggacacagggtcctgggcccagtctgccctgactcagcctgccctccgtgtctgggtctcctggacagtcgatcaccatcctctgcactggaaccagcagtgatggttgggggttatcgtaccttgtcctcctggtaacccaaccacccgaccccggcacgacgcccccaaaactcagttacgtatttagtaggacggaccctaactaacggcccgtaccccctcgacgggggtacctttttacctaaactcggtaccttttccttcctacggggtcccctttaaccgaaacggttccgttacggacctaacccggtacccgggtcccccttaccccgttaggaaacccttaaccgttccgttccggttacggggtccctaccggtaacgggtccggtacggtaaaccgggaccggtaaacggttacctttaaattttaaccttacgttacgcgttagtaccttaacgtatttaaacgtagtaaaacggtttaactaaacctaacgttaacgttaaacgttacgtttcggggaccggaaccgggggttaacccaagggtaccctacggtacccccgttaccggtacggttcccgtaaccggtaccgaccccgttaacgccccgttacccgcccccggtacggtcctacgttcccgttacccgtaccccctacccgttccaccgttacccgaagttacggacccgttcggacggggcccgttggaccgtacggaacccgg

SEQ ID NO: 62185 - DNA, 932 bp, Homo sapiens
  misc_feature: GYAE6OF02HIMIR.15.1.A01.1.454.CMB.1.raw
  modified_base (120)..(120): a, c, t, g, unknown or other
  misc_feature (120)..(120): n is a, c, g, or t
tcagtctacgtagccacgaccggtgctcgatttagacgtctcatcagggcctgggctctgctgctcctcactctcctcactcaggacacagggtcctgggcccagtctcgccctgactcngcctgcctccgtgtcgtggtctcgtgacagtcgatccaccatcctacctgccacgtaggaaccagcagtgtaagttgggttagggttactcctaccgttgtccttacgtacggtaaacccaaacccaccccgaaccccgggacaaccggtaacccgaaccccccctaaaatccgtaacgttaacggttaattttaacggaccgggtaaccgaaccccgtaaaccgtaaaccggtcccggtaaccccgtacggtaccgggttaccttttaacgtaaacgttccgttacgtttcccgttacggttcggaccccttaacgggtaaacgtttcggtaaccggtaacccgtaaaccgacccggttaccccttaccgtaaccgaaacttaaccgttccggttcggtaccgggccttaacggaccggtacgttacgggaaaccggtaaacgggacgtttaaactttaacgtttactaccggtctaccggtttactacgttacctaagttaacgggtaaacgttaacggttaaacttaaacgtaactaaccgtttacgtacggttaacggggtaaaccggacggtaacccgtacggttacgtaacccggtacccgtttacgtccgggtacccttaacccgggaacctaaacccgggcgtttaccccgtaccccggttacccccggttacgttaaccctttccggttaccccgtttccccgttccccccggttaacccgttaccggttaccccggttaaccgttacgtacccggttaacggtgggacccggttccggggaccgttacgggaccggtaacgg

SEQ ID NO: 62186 - DNA, 730 bp, Homo sapiens
  misc_feature: GYAE6OF02HOK8X.15.1.A01.1.454.CMB.1.raw
  modified_base (413)..(413): a, c, t, g, unknown or other
  misc_feature (413)..(413): n is a, c, g, or t
tcagtctacgtagccacgaccggtgctcgatttagacgtctcatcagggcctgggctctgctgctcctcactctcctcactcgaggacacagggtcctgggcccagtctgccctgactcagcctgccctcgtgtcgtgggtctcctggacagtcgatccaccatctacctgctacgtcggaaccagacaggtagagttggttggggttaatcctaccgttgttcgtacagttaccgtaaccaaacccacccgaccccggtacacgacccgaccccaaactcaattgtaatttaggtacggactaaccgaactaaccgacccgtacccgtacggtacggttacctttactaacgtctacctttcctacggtcgtacctacgacttcgtacggaccaaccgccggtccctcgtanaccgtaatccgtcgtcgacctccgaggtacacggacgtagaacgtaacgttaattacgtatcgcgtatctactaagttaagtaaggtaacgttaaataacttacttaagtacgttaacggttaccgggtacgggaacggtaaccgacgtacgtaccgtaccgtcgtacgacgtaccgaccgtaaccgacgttcccgtcccgtacccgtacgtacccgttaccgttccgtaccccggtccccctacccgttaccgtacccgttaccgttaaccgtacgttacggacccgggtcgggtacggtcggtacgggaaccggg

SEQ ID NO: 62187 - DNA, 782 bp, Homo sapiens
  misc_feature: GYAE6OF02JXMOS.15.1.A01.1.454.CMB.1.raw
  modified_base (261)..(261): a, c, t, g, unknown or other
  misc_feature (261)..(261): n is a, c, g, or t
  modified_base (757)..(757): a, c, t, g, unknown or other
  misc_feature (757)..(757): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcacatctcctgcactaggtaatcagcagtgagttgggttcgggggttatcctaccttgtctacctcggtaaccaaccgacccacccggctacgaccgaccccaacncagtgtaatttgagtacgccaataacggaccaccctacggacggttctttactaacgtccgtccttccttacgtccgtacctaccgtaacgttccggtacgaacccgaacgaaccccggccctttacccgcgaaactactccttccggtcgggtaccctcggaacgtcgccggtaaccggacggaaggttcttaaacttacgttttaaccgtacggtctacgttacctagttaaaactggttaaacgtaaacggttaaattaaacccgtaatttaacgtaacgtaccgggtttaccggggaaccggtaaaccgggaccgtaacgttacccgttaaccgggtccggtttaccgccgtacggtacccgtaaccgggaccccgtttaggaccccgttccccgtccccgttccgtaccgttcccgttcgttccccgtttaaccccggccccttacccgttcggaacccgttttaggaaaccggttccgaaggggtacccnccgggggttccgacggtaacccggg

SEQ ID NO: 62188 - DNA, 777 bp, Homo sapiens
  misc_feature: GYAE6OF02FMR0Z.15.1.A01.1.454.CMB.1.raw
  modified_base (629)..(629): a, c, t, g, unknown or other
  misc_feature (629)..(629): n is a, c, g, or t
tcagtctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgagttggttggggttactctaccttgtcctcctcggtaccaaccacccaccccggcacgaccgacccccaaactccagtcgtaacttttagtacggacggccctaacgtaaacgtcccgaaccccgttcgaacggggtccttttcgtaaacgttccgtctttcctccgtcggtcctacccgtaaagttcgtacggaccaaccgtacccgggtaccccttcccgtagtaacctaacgttccgttaccgtggggtcctaccgacggcgttacgggaacggtaacggtacggtaactttaaacgttttattaaccgtcgtccgtcgtaccttaacgtaacgttaagtaacggtaaagtttaaacgtaaaccgtaaacttaacctacgtttaacggttacgggacgggtaaaccggtaaccgtaacgtcgttacccggtaccgttaccgnggtaccgtaccgaccgtacccggacggtcccgttccggtcccccgttaggtaccctaccgttcccgttaccgtccccgtcccgtccctaccggtaccttaccggtacgttaccgtacggtccggcgggttcgtaccggacgtaaccgg

SEQ ID NO: 62189 - DNA, 790 bp, Homo sapiens
  misc_feature: GYAE6OF02GIDDP.15.1.A01.1.454.CMB.1.raw
tcagtctacgtagccacgaccggtgctcgatttagacgtctcatcagggccgtgggctctgctgctcctcgactctccctcactcaggacacagggtcctgggcccagtctgccctgactcagcctgcctccgtgtctgggtctccgtggacagtcgatcaccatctctgcgactggaaccagcagtgtagtggttggggttactctaccttgtcctccgtgtaccaaccacccgacccgcagaccgaccccaactcatatattatgacggcctacgtaacgccgaccctagacgggttcctttactaactccgtcttcgttcgtcgtcctaccgtaacggtcgtacggaccaaccgccggtcccctacccgtacgtaacctaacgttcgtccggtcggtccgtacccggacggtcggtacggaaccggtacgggtaaccggttaaccttaaacgttttaacgttaccgttacgtaccgttacgtccgttaacgtaacgttaacgttaacgggttaaaaccggtttaataaaacccgtttaacttaacgtttaacccgttaacggggtttccggggttaaacccggggaacgggtaacccgtacgggttacctacccgggtacccggttaccgttaggtacccggttacgcccgggttaaacccgacgggtcccgtaacccggtccccgttacggtcccgttaccgttccgttacccgttaccccctaccgttccgtaacggcgttaccggtactacggtcgggacggtcggtacgtacgggctaccggg

SEQ ID NO: 62190 - DNA, 692 bp, Homo sapiens
  misc_feature: GYAE6OF02HGEDQ.15.1.A01.1.454.CMB.1.raw
  modified_base (241)..(241): a, c, t, g, unknown or other
  misc_feature (241)..(241): n is a, c, g, or t
  modified_base (296)..(296): a, c, t, g, unknown or other
  misc_feature (296)..(296): n is a, c, g, or t
  modified_base (351)..(351): a, c, t, g, unknown or other
  misc_feature (351)..(351): n is a, c, g, or t
  modified_base (368)..(368): a, c, t, g, unknown or other
  misc_feature (368)..(368): n is a, c, g, or t
  modified_base (387)..(387): a, c, t, g, unknown or other
  misc_feature (387)..(387): n is a, c, g, or t
tcagtctacgtagccacgaccggtgctcgatttagacgtctcatcaaggaagggaaggggggggtctcaggaggcagcgctctcaggacatctccaccatggcctggctctgctgcctcctcaccctcctcactacgagggccaacgacgggtcctcggggccctaggtcctcgccctcgactcgacgtcctcgcccgttccgtgtccgtgggttctcgttaggactagtgactcgacctntctccgtagccgtactacggaacagtcgagtacgtacgttgtaacttataacgtntcgtctacgtacgtacaacgacgaaccgagaccaaccgaccccatcatgtattanaggacgtacaggttacncgtccgtaggtacggttanacgtcgtctctacgtgtactcgtagtccgtagactacgacgtcggtccctaccgtacgtactaccgtccgttacggcccgtaccgtaccggacggttacccggtagggacggaaccggtacgtcggttaacgttactttaccgttacgcgtaccgcgtaactactaggtactaacgacgtacaagccgtacaaccgttccgtttaggggtcgtttcgggaaccgggtacgaccgggaatacccggtccttaaccgggttaccgtccgtaaccgggtcccgtaaccggtacccaccgttccccggg

SEQ ID NO: 62191 - DNA, 725 bp, Homo sapiens
  misc_feature: GYAE6OF02GDUC5.15.1.A01.1.454.CMB.1.raw
  modified_base (152)..(152): a, c, t, g, unknown or other
  misc_feature (152)..(152): n is a, c, g, or t
  modified_base (526)..(526): a, c, t, g, unknown or other
  misc_feature (526)..(526): n is a, c, g, or t
tcagtctacgtagccacgaccggtgctcgatttagacgtctcatcaggggccgtggggctctgctgctcctcactctcctcactcaggacacagggtcctgggcccagtctgccctgactcagcctgcctccgtgtctgggtctcctggacngtcgatcaccatcctctgcactcggaaccagcagtgtagttgggtttggggttatcctacctttgtcttccgtcggtaaccaaccgacccaccccggcacgaccgaccccctaaactcatagtacttttagacgtacggccaacgtaacgccgtaccccgtacgaacgggttcctttacctaaacgtcctactttacctcgtcggtcctaccgtaacgtcgtacggaccaaccgtcccgggtaccctccctaggaacctaacttcgtccggtcgggtccttaccggcggtcgttacggacggacggtacggtacctttaaattttaaccgttactcggtacttcgtcgtactaacgttagtaggtaaacgttanaaactattattacgtagttcgggacggacggtacaacgctaccggccgttcgacgtcgtaccgacgtaccacgtcgtccccgtacccggttccgtacgtaccttcccgttccggtacccccggttccctacccgttaccggtaccgtaccgttacggtacgcggggtacgggccgggtaccggtcggacggtaacccgg

SEQ ID NO: 62192 - DNA, 435 bp, Homo sapiens
  misc_feature: GYAE6OF01CGR7K.23.60.F05.1.454.CMB.1.raw
  modified_base (194)..(194): a, c, t, g, unknown or other
  misc_feature (194)..(194): n is a, c, g, or t
  modified_base (249)..(249): a, c, t, g, unknown or other
  misc_feature (249)..(249): n is a, c, g, or t
  modified_base (429)..(435): a, c, t, g, unknown or other
  misc_feature (429)..(435): n is a, c, g, or t
tcagacgcgagtatcacgaccggtgctcgatttagtacgtcatcagggaaaggggctggagtgggtgggtttgattagaagtaaagttatggtgggacaacaaaatacgccgcgtctgtggaaggcagattcaacatctcaagaaatgattccacaagtgtcgcctatctgcaaatgaacagcctgaaaaccgnggacacaggcgtgtattactgtacgagcagatttctctggttcggggatccccanactttgactactgggggccagggaaccctggtcaccgtctcctcagcctccaccaagggcccatcggtcttccccctggcaccctcctccaagagcacctctggggcacagcggccctgggctgcctggtcaaggctacgttccatactcgcgtctgagcgggctggcaaggcgcatagnnnnnnn

SEQ ID NO: 62193 - DNA, 527 bp, Homo sapiens
  misc_feature: GYAE6OF01EPEYQ.23.60.F05.1.454.CMB.1.raw
  modified_base (201)..(201): a, c, t, g, unknown or other
  misc_feature (201)..(201): n is a, c, g, or t
  modified_base (308)..(308): a, c, t, g, unknown or other
  misc_feature (308)..(308): n is a, c, g, or t
tcagacgcgagtatcacgaccggtgctcgatttagtacgtcatcagggaaagggggaggaactgctcagttaggacccagagggaaccatggaagccccagctcagcttctcttcctcctgctactctggctcccagataccaccggagaaattgtgttgacacagtctccagccaccctgtctttgtctccaggggaaanagccaccctctcctgcagggccagtcagagtgttagcagctacttagcctggtaccagcagaaacatggccaggctcccaggctcctcatctatgatgcatccaacngggccactggcatcccagccaggttcagtgcaggtggtctgggacagacttcactctcaccatcagcagcctagacgcctagaagtattttgctagtttattactgtcagcagcgtagcaacgtcggaccctacgttcggacgggtacgggaccgaaggtaggaaactacgaaacgtaacgtggtaggctgcaccgtatactagttcttcacgttcccg

SEQ ID NO: 62194 - DNA, 515 bp, Homo sapiens
  misc_feature: GYAE6OF01A8XKK.23.60.F05.1.454.CMB.1.raw
  modified_base (201)..(201): a, c, t, g, unknown or other
  misc_feature (201)..(201): n is a, c, g, or t
  modified_base (354)..(354): a, c, t, g, unknown or other
  misc_feature (354)..(354): n is a, c, g, or t
  modified_base (509)..(509): a, c, t, g, unknown or other
  misc_feature (509)..(509): n is a, c, g, or t
tcagacgcgagtatcacgaccggtgctcgatttagtacgtcatcagggaaagggggaggaactgctcagttaggacccagagggaaccatggaagccccagctcagcttctcttcctcctgctactctggctcccagataccaccggagaaattgtgttgacacagtctccagccaccctgtctttgtctccaggggaaangccaccctctcctgcagggccagtcagagtgttagcagctacttagcctggtaccagcagaaacatggccaggctcccaggctcctcatctatgatgcatccaacagggccactggcatcccagccaggttcagtggcagtgggtctgggacngacttcactctcaccatcagcagcctagacgcctagaagtatttgctagtttattactgtcagcagcgtagcaacgtcggtccctacgtttcggcggagggaccgaaggtgaaatacgaaacgaacgtagtaggctgacacgtatctagtcttcnttcccg

SEQ ID NO: 62195 - DNA, 557 bp, Homo sapiens
  misc_feature: GYAE6OF01CK07N.23.60.F05.1.454.CMB.1.raw
  modified_base (201)..(201): a, c, t, g, unknown or other
  misc_feature (201)..(201): n is a, c, g, or t
  modified_base (307)..(307): a, c, t, g, unknown or other
  misc_feature (307)..(307): n is a, c, g, or t
tcagacgcgagtatcacgaccggtgctcgatttagtacgtcatcagggaaagggggaggaactgctcagttaggacccagagggaaccatggaagccccagctcagcttctcttcctcctgctactctggctcccagataccaccggagaaattgtgttgacacagtctccagccaccctgtctttgtctccaggggaaangccaccctctcctgcagggccagtcagagtgttagcagctacttagcctggtaccagcagaaacatggccaggctcccaggctcctcatctatgatgcatccaacngggccacgtggcatcccagccaggttcagtggcaggtgggtctgggacagtacttcactctccaccatcacgcacgcctagacgcctagaagtatttgactagtttattactgtcagcagcgtacgacacgtcggtcccgtacgtttccgggacgggtacgggaaccgaagggtacggaaacgtacgaaacggtacgtggtacggcgtacgaccaaccgtacttaccgttgttccttcgtacgttccccg

SEQ ID NO: 62196 - DNA, 579 bp, Homo sapiens
  misc_feature: GYAE6OF01C65PK.23.60.F05.1.454.CMB.1.raw
  modified_base (200)..(200): a, c, t, g, unknown or other
  misc_feature (200)..(200): n is a, c, g, or t
  modified_base (209)..(209): a, c, t, g, unknown or other
  misc_feature (209)..(209): n is a, c, g, or t
  modified_base (311)..(311): a, c, t, g, unknown or other
  misc_feature (311)..(311): n is a, c, g, or t
  modified_base (390)..(390): a, c, t, g, unknown or other
  misc_feature (390)..(390): n is a, c, g, or t
tcagacgcgagtatcacgaccggtgctcgatttagtacgtcatcagggaaagggggaggaactgctcagttaggacccagagggaaccatggaagccccagctcagcttctcttcctcctgctactctggctcccagataccaccggagaaattgtgttgacacagtctccagccaccctgtcttgtctccaggggaaangccaccctntcctgcagggacagtcagagtgttagcagctacttagcctaggtaccagcaagaaacatcggccaggcctcccaggcctcctcatctatgatgcatccaacngggccatggcatcccagccaggttcagtggcaggtggtctgggacagacttcactctacaccatcagcagacctagacncctagaagtatttgactagtttacttacgtgtcagcagtcgttaagccgtaacgtcggtaccctacgttcgggacgggtacgggaaccgtaaagggtacggaaaccgtacgaaaaccggtaaacgtagggtacggtccgtacggacctaaccgtacgttaccgttcgttaccttccgtaacgttccccg

SEQ ID NO: 62197 - DNA, 589 bp, Homo sapiens
  misc_feature: GYAE6OF01DID2J.23.60.F05.1.454.CMB.1.raw
  modified_base (580)..(580): a, c, t, g, unknown or other
  misc_feature (580)..(580): n is a, c, g, or t
tcagacgcgagtatcacgaccggtgctcgatttagtacgtcatcagggaaagggggaggaactgctcagttaggacccagagggaaccatggaagccccagctcagcttctcttcctcctgctactctggctcccagataccaccggagaaattgtgttgacacagtctccagccaccctgtctttgtctccaggggaagagccaccctctcctgcagggccagtcagagtgtagcagctacttagcctggtaccagcagaacatggccaggctcccaggctcctcatctatgatgcatccaacagggccactggcatcccagccaggttcagtgctaggtgggtctgggacagtaccttcacttctcaccatcagcacgcctaagacgtcccgtagaaacgttattttcgacttagttttattaccgtgttacagtcagtcgtaacgactaaccgttcggtacccctacggtttccgggaccgggtacggggaaccgtaacgggtaggaaacgttaccgaaaaccggtaacgtggtacgggcttacggactacccgtattacctacgtttccttccgtnttacccccg

SEQ ID NO: 62198 - DNA, 598 bp, Homo sapiens
  misc_feature: GYAE6OF01BPNOI.23.60.F05.1.454.CMB.1.raw
  modified_base (269)..(269): a, c, t, g, unknown or other
  misc_feature (269)..(269): n is a, c, g, or t
tcagacgcgagtatcacgaccggtgctcgatttagtacgtcatcagggaaagggggaggaactgctcagttaggacccagagggaaccatggaagccccagctcagcttctcttcctcctgctactctggctcccagataccaccggagaaattgtgttgacacagtctccagccaccctgtctttgtctccgaggggaaagagcccaccctctcctgcagggccagtcagagtgttagcagctacttagcctggtaccagcagaaacntggccaggcctcccgaggctcctcatctatgatgacactaccaacgacgggccacgtggaccactccccagcccgtaggttcaggtcggacgtagggttgggtcgtacggggacacggtaccttcacgttctaccacctatcagcacgtcctagacgtcctagtaagttagttttgacttagttttattacgtgtcagcagtcgtacgactaacgtcggtacccgtacggttcgggacggacgggaaccgaagggtacggaaactaacgaaacgtacgttaggtacggtctacgacctacgtactcttacgttcttccgtacgttcccg

SEQ ID NO: 62199 - DNA, 524 bp, Homo sapiens
  misc_feature: GYAE6OF01EQTVT.23.60.F05.1.454.CMB.1.raw
  modified_base (201)..(201): a, c, t, g, unknown or other
  misc_feature (201)..(201): n is a, c, g, or t
  modified_base (229)..(229): a, c, t, g, unknown or other
  misc_feature (229)..(229): n is a, c, g, or t
  modified_base (306)..(306): a, c, t, g, unknown or other
  misc_feature (306)..(306): n is a, c, g, or t
  modified_base (513)..(513): a, c, t, g, unknown or other
  misc_feature (513)..(513): n is a, c, g, or t
  modified_base (518)..(518): a, c, t, g, unknown or other
  misc_feature (518)..(518): n is a, c, g, or t
  modified_base (520)..(520): a, c, t, g, unknown or other
  misc_feature (520)..(520): n is a, c, g, or t
tcagacgcgagtatcacgaccggtgctcgatttagtacgtcatcagggaaagggggaggaactgctcagttaggacccagagggaaccatggaagccccagctcagcttctcttcctcctgctactctggctcccagataccaccggagaaattgtgttgacacagtctccagccaccctgtctttgtctccaggggaaangccaccctctcctgcagggccagtcagngtgttagcagctacttagcctggtaccagcagaaacatggccaggctccaggctcctcatctatgatgcatccaacngggccacgtggcatcccagccaggttcagtggcaggtgggtctgggacagacttcactctcaccatcagcacgcctagacgcctagaagtattttgacttagtttattactgtcagcagtcgtagcaacgtcggtaccctacgtttcggacggagggaccgaagggtacggaaactacgaaacgtacgtgtcggctgcacctatctntcttntntccc

SEQ ID NO: 62200 - DNA, 532 bp, Homo sapiens
  misc_feature: GYAE6OF01DWWDO.23.60.F05.1.454.CMB.1.raw
  modified_base (201)..(201): a, c, t, g, unknown or other
  misc_feature (201)..(201): n is a, c, g, or t
  modified_base (210)..(210): a, c, t, g, unknown or other
  misc_feature (210)..(210): n is a, c, g, or t
  modified_base (290)..(290): a, c, t, g, unknown or other
  misc_feature (290)..(290): n is a, c, g, or t
  modified_base (309)..(309): a, c, t, g, unknown or other
  misc_feature (309)..(309): n is a, c, g, or t
tcagacgcgagtatcacgaccggtgctcgatttagtacgtcatcagggaaagggggaggaactgctcagttaggacccagagggaaccatggaagccccagctcagcttctcttcctcctgctactctggctcccagataccaccggagaaattgtgttgacacagtctccagccaccctgtctttgtctccaggggaaangccaccctntcctgcagggccagtcagagtgttagcagctacttagcctggtaccagcagaaacatggccaggcctcccaggcctcctnatctatgatgcatccaacnggccactggcatcccagccaggttcagtggcaggtggtctgggacagacttcactctcacatcagcacgcctagacgtcctagaagtatttgctagtttattactgttcagtcagtcgtaagcaacgtcggaccctacgtttcgggacggacgggaccgtaagggtagaaactacgaaaacgtacgtaggtcggctagccactatcttgtcttcacgttcccg

SEQ ID NO: 62201 - DNA, 554 bp, Homo sapiens
  misc_feature: GYAE6OF01AXYDQ.23.60.F05.1.454.CMB.1.raw
  modified_base (203)..(203): a, c, t, g, unknown or other
  misc_feature (203)..(203): n is a, c, g, or t
  modified_base (268)..(268): a, c, t, g, unknown or other
  misc_feature (268)..(268): n is a, c, g, or t
tcagacgcgagtatcacgaccggtgctcgatttagtacgtcatcagggaaagggggaggaactgctcagttaggacccagagggaaccatggaagccccagctcagcttctcttcctcctgctactctggctcccagataccaccggagaaattgtgttgacacagtctccagccaccctgtctttgtctccgaggggaaagngccaccctctcctgcagggccagtcagagtgtagcagctacttagcctggtaccagcaagaaacntcggccaggcctcccgaggcctcctcatctatgatgacactacccaacgacgggccacgtcggcacgtccccagccgtaggttcaggtcggctaggtgggtcagggacagtaccttcacttctaccaccactcgagcacgccgtagacgctagtaagtagtttgacttagtttattctgtcagcagtcgtacgacacgtcgtacctacgttcggacggacggacgaggtacgaacgtacgaacgacgtagacggcgacgacacgtactcgtagtcttctcgttccc

SEQ ID NO: 62202 - DNA, 431 bp, Homo sapiens
  misc_feature: GYAE6OF01EV97F.23.60.F05.1.454.CMB.1.raw
  modified_base (231)..(231): a, c, t, g, unknown or other
  misc_feature (231)..(231): n is a, c, g, or t
  modified_base (250)..(250): a, c, t, g, unknown or other
  misc_feature (250)..(250): n is a, c, g, or t
  modified_base (425)..(431): a, c, t, g, unknown or other
  misc_feature (425)..(431): n is a, c, g, or t
tcagacgcgagtatcacgaccggtgctcgatttagtacgtcatcagggaaaggggctggagtgggtgggtttgattagaagtaaaagttatggtgggacaacaaaatacgccgcgtctgtggaaggcagattcaacatctcaagaaatgattccacaagtgtcgcctatctgcaaatgaacagcctgaaaaccgaggacacaggcgtgtattactgtacgagcagatttcnctggttcggggatccccanactttgactactggggccagggaaccctggtcaccgtctcctcagcctccaccagggcccatcggtcttccccctggcaccctcctccaagagcacctctggggcacagcggcctggctgcctggtcaaggactactccatactcgcgtctgagcgggctggcaaggcgcatagnnnnnnn

SEQ ID NO: 62203 - DNA, 563 bp, Homo sapiens
  misc_feature: GYAE6OF01ELAI6.23.60.F05.1.454.CMB.1.raw
  modified_base (200)..(200): a, c, t, g, unknown or other
  misc_feature (200)..(200): n is a, c, g, or t
  modified_base (309)..(309): a, c, t, g, unknown or other
  misc_feature (309)..(309): n is a, c, g, or t
tcagacgcgagtatcacgaccggtgctcgatttagtacgtcatcagggaaagggggaggaactgctcagttaggacccagagggaaccatggaagccccagctcagcttctcttcctcctgctactctggctcccagataccaccggagaaattgtgttgacacagtctccagccaccctgtctttgtctccaggggaanagccaccctctcctgcagggccagtcagagtgttagcagctacttagcctggtaccagcagaaacatcggccaggctcccaggcctcctcatctatgatgcatccaacngggccacgtggcactcccagccaggttcagtggcaggtggtctgggacagtacttcactctcacctatccagcacgccgtagacgtcctagaacgttattttgacttaggttttacttactgtacagcagcgtagacaacgtcggtacccgtacgtttcgggacgggacgggaccgaagggtacggaaacgtacgaaaacgtacgtaggtacggctacgaccacgtacttcttagttccttcgtcgttaccccg

SEQ ID NO: 62204 - DNA, 760 bp, Homo sapiens
  misc_feature: GYAE6OF01EAWVZ.23.60.F05.1.454.CMB.1.raw
  modified_base (200)..(200): a, c, t, g, unknown or other
  misc_feature (200)..(200): n is a, c, g, or t
  modified_base (269)..(269): a, c, t, g, unknown or other
  misc_feature (269)..(269): n is a, c, g, or t
tcagacgcgagtatcacgaccggtgctcgatttagtacgtcatcagggaaagggggaggaactgctcagttaggacccagagggaaccatggaagccccagctcagcttctcttcctcctgctactctggctcccagataccaccggagaaattgtgttgacacagtctccagccaccctgtctttgtctccaggggaangccaccctctcctgcagggccagtcagagtgttagcagcttactagccttaggtaccagacaagaaacngtcggaccaggcctcccgaggtcctcctcatctatgatcgactactaccgaacgacggccacgtcggacactcccgagtcccgtaggttaccgaggtcggacgtagggtcgggtcgtacggggaactaggttacccttaccgtacctttacctacccgaacctacgtaccgaacggaccgtaaccggtaccccgttaaggaaccggttacccgttaaggtaaacgttttacgttttacggtaacgttttaacggttttttaactttaccgtcgttaccgacggtaccgtaggtaccggttaacgacccgttaaccggttccgggtacccccgtttaacgggtttcccggggaacggggtaaaccggggtaacccggtaaagggtaacggtaaaaccgtaaccggtaaaaccggtacggttcgggtaccggtccgtacggaccctaaccgttacggttacccttacgttccctttagtacccgtttcccccg

SEQ ID NO: 62205 - DNA, 535 bp, Homo sapiens
  misc_feature: GYAE6OF01EZL8V.23.60.F05.1.454.CMB.1.raw
  modified_base (201)..(201): a, c, t, g, unknown or other
  misc_feature (201)..(201): n is a, c, g, or t
  modified_base (307)..(307): a, c, t, g, unknown or other
  misc_feature (307)..(307): n is a, c, g, or t
  modified_base (528)..(528): a, c, t, g, unknown or other
  misc_feature (528)..(528): n is a, c, g, or t
tcagacgcgagtatcacgaccggtgctcgatttagtacgtcatcagggaaagggggaggaactgctcagttaggacccagagggaaccatggaagccccagctcagcttctcttcctcctgctactctggctcccagataccaccggagaaattgtgttgacacagtctccagccaccctgtctttgtctccaggggaaanagccaccctctcctgcagggccagtcagagtgttagcagctacttagcctggtaccagcagaacatggccaggctcccaggctctcatctatgatgcatccaacgngggccacgtggcatcccagcccaggttcaggtgcgtaggtcggtctgggacaggactttcactctcacctatcagcacgctagacgctagaagttattttgcttagtttattactgtctagtacgagtcgtacgcaacgtcggtccctacgttcggacggacgggacgaagggtagaaacgtcgaaacgacgtaggtggctacgcacctactctatcttcncgtcccg

SEQ ID NO: 62206 - DNA, 625 bp, Homo sapiens
  misc_feature: GYAE6OF01BYNB2.23.60.F05.1.454.CMB.1.raw
  modified_base (365)..(365): a, c, t, g, unknown or other
  misc_feature (365)..(365): n is a, c, g, or t
tcagacgcgagtatcacgaccggtgctcgatttagtacgtcatcagggaaagggggaggaactgctcagttaggacccagagggaaccatggaagccccagctcagcttctcttcctcctgctactctggctcccagataccaccggagaaattgtgttgacacagtctccagccaccctgtctttgtctccgaggggaaagagcccaccctctcctgcagggccagtcagagtgttagcagctacttagcctggtaccagcagaaacagtggccaggctcccaggcctcctcatctatgatgcatccaagaggccacgtggccactcccgagccgtaggttccaggtggcgtaggttcggggtntcggggacaggtactttcacgttctacaacctactccagccacgaccgttagaccgcctagaagtagttttgacgttaagttttattacgttgtacgtagtactaggtcgtagacctaacgtccgggtaccctaccggtttaccgggacgggtacgggtaaccgtaaagggtacggtaaaacgtaccgtaaaacggtacgtaggtacggccgtacgaccctaacccgtagtacccgttagttaccttctcgtttaccccg

SEQ ID NO: 62207 - DNA, 727 bp, Homo sapiens
  misc_feature: GYAE6OF01EF0CY.23.60.F05.1.454.CMB.1.raw
  modified_base (204)..(204): a, c, t, g, unknown or other
  misc_feature (204)..(204): n is a, c, g, or t
  modified_base (277)..(277): a, c, t, g, unknown or other
  misc_feature (277)..(277): n is a, c, g, or t
  modified_base (305)..(305): a, c, t, g, unknown or other
  misc_feature (305)..(305): n is a, c, g, or t
tcagacgcgagtatcacgaccggtgctcgatttagtacgtcatcagggaaagggggaggaactgctcagttaggacccagagggaaccatggaagccccagctcagcttctcttcctcctgctactctggctcccagataccaccggagaaattgtgttgacacagtctccagcccaccctgttctttgtctccgaggggaaanacgcccaccctctcctgcgagggccagtcagtagtgttagcagctacttagccttaggaccagacaagaaacngtcggaccaggcctcccgaggcctcctnatctagtgatcgactactacccgaagcgggccctacgtcggaccacgttccccgaagtcccgtaggttcaggtggacgtagggtcggggtactggggaacctacggtacctttccgaacctttccgtaacctaaacccctagttacccgaacggtacccgtaaccggtacccgttaacggaccggtacccgttaaggtaacgtttacgttttacggtacgtttaacgttttaacgtttacgttacgttacgtacgtaccgtaagtacggtaacgtacgtaaccgtaccggtacccgttaccggtttacggggaccgggtaacgggaaccgtaaagggtaacggaaacgtaacgaaacggtacggttaggtacggtcgtacgacctaaccgtacttacgttacgttcttccgtcgttaccccg

SEQ ID NO: 62208 - DNA, 607 bp, Homo sapiens
  misc_feature: GYAE6OF01EX1DN.23.60.F05.1.454.CMB.1.raw
  modified_base (204)..(204): a, c, t, g, unknown or other
  misc_feature (204)..(204): n is a, c, g, or t
tcagacgcgagtatcacgaccggtgctcgatttagtacgtcatcagggaaagggggaggaactgctcagttaggacccagagggaaccatggaagccccagctcagcttctcttcctcctgctactctggctcccagataccaccggagaaattgtgttgacacagtctccagcccacccttgtctttgtctccgaggggaaangccaccctctcctgcagggccagtcagagtgttagcagctacttagcctggtaccagcaagaaacatggccaggcctcccgaggcctcctcattctatgatcgcactccgaacgagggcctagtggcactccccagccgtaggttcaggtggctagggtcgggtcgtagggacaggtactttccacttcctaccgaacctataccgacgccacgtacctaggacgaccgtagtaagttatttagacttagtttacttacgtcgtcagtcgagtacgtacgactaccgtcggtacccgttacgtttacgggacgggtacgggacgaagggtacggaaactacgtaaacggtacgtaggtacggtcgtcgacctacctagttcttagttccttacgtcgttcccg

SEQ ID NO: 62209 - DNA, 587 bp, Homo sapiens
  misc_feature: GYAE6OF01BEXC1.23.60.F05.1.454.CMB.1.raw
  modified_base (202)..(202): a, c, t, g, unknown or other
  misc_feature (202)..(202): n is a, c, g, or t
tcagacgcgagtatcacgaccggtgctcgatttagtacgtcatcagggaaagggggaggaactgctcagttaggacccagagggaaccatggaagccccagctcagcttctcttcctcctgctactctggctcccagataccaccggagaaattgtgttgacacagtctccagccaccctgtctttgtctccgaggggaaangccaccctctcctgcagggccagtcagagtgtagcagctactagcctggtaccagcagaaacatggccaggcctcccgaggcctcctcatctatgatgcatccaacgacgggccacgtggccactccccagccgtaggttccaggtcggctagggtcgggtctggggacagtacttcacgttctacacctatccacgcacgcctagacgtccgtagtaagtattttgacttaagtttacttacgtgtcacgcagcgtagacaacgtcggtccctacgtttcgggacgggtacggaccgtaagggtacgtaaacgtacgaaaccgtacgtaggtacggccgtacgaccctaccgtacgtccgttacgttcctttcgtcgttccccg

SEQ ID NO: 62210 - DNA, 746 bp, Homo sapiens
  misc_feature: GYAE6OF01B6YH5.23.60.F05.1.454.CMB.1.raw
  modified_base (738)..(738): a, c, t, g, unknown or other
  misc_feature (738)..(738): n is a, c, g, or t
tcagacgcgagtatcacgaccggtgctcgatttagtacgtcatcagggaaagggggaggaactgctcagttaggacccagagggaaccatggaagccccagctcagcttctcttcctcctgctactctgctcccagataccaccggagtaaattgtgttgacacagtctccacgccctacctgttctttgtctccgaagggaaagcgcccacccttctcctgcgacgggccagtcagtagtgttagcagcttactagccgtggtaccagacaagaacagtcggaccaggcctacccgaggtcctccctactaactcgttaagtcgaattcggcctaacgtacccgaaacgacgggccctaacggtcggaccaaccgtccccgaaggtcccgtaaggttccgaaggtcggtacgtacgggttcgggtccggttaggggaactaacggtaccgtttaccgtaacctttccgaacccgtaacctacgtaccgacgacctaacggtccgtaaggaccgtacccgttaaaggtaaagttcgtttttacgacgttttaacgtttttaaagttaccgtttacgtaacgtaacggtacgtaacggtacgttacgaaccgttaaccgtcccggtaacccgttacggtttcgggacgggtacgtaaaccggtaagggtaacgtaaacgtaacgtaaacgtacgtggtacgtcgtacgtaccaaccgttactcgttacgttactccgtnttaccccg

SEQ ID NO: 62211 - DNA, 738 bp, Homo sapiens
  misc_feature: GYAE6OF01EXM45.23.60.F05.1.454.CMB.1.raw
tcagacgcgagtatcacgaccggtgctcgatttagtacgtcatcagggaaagggggaggaactgctcagttaggacccagagggaaccatggaagccccagctcagcttctcttcctcctgctactctggctcccagataccaccggagaaattgtgttgacacagtctccagccacccttgtctttgtctaccgaaggggaaagcgccaccctctcctgcgagggccagtcagtgtgttagcagcttacttagcctaggtaaccagaccaagaaaccagtcggacccaaggcctacccgaaggcctccgtacacttactagtgattcgaccgtactacccgaaagacgggaccctacggtcggacctaacgtccccaaggtacccgtacggttccgtagggttccggacggtaacgggttcggggttccgttacggggaaaccgtacggtaccctttactacccgttccttaccaaccctagtaccgaacgtaccgaaccgaccgtaacggtaacggtaccgttaagtaacggtttattttacgacttaagtttattacgtcgtacgtacgtacgtagtacgtacgaccgacgttccgtaccgtacggtttacgggacggaacgggaacgtaaaggggtaacgtaaacgtaaccgtaaaacggtaacgtagggtacgtccgttacgaacccgtaaccgtacgttaccgtacggtttcttaccgtaccgtttaccccg

SEQ ID NO: 62212 - DNA, 642 bp, Homo sapiens
  misc_feature: GYAE6OF01B73YX.23.60.F05.1.454.CMB.1.raw
  modified_base (201)..(201): a, c, t, g, unknown or other
  misc_feature (201)..(201): n is a, c, g, or t
tcagacgcgagtatcacgaccggtgctcgatttagtacgtcatcagggaaagggggaggaactgctcagttaggacccagagggaaccatggaagccccagctcagcttctcttcctcctgctactctggctcccagataccaccggagaaattgtgttgacacagtctccagccacctgtctttgctccgaaggggaaancgcccaccctctcctgcagggccagtcagagtgtagcagctattagcctaggtaccagacaagaaacatggaccaggcctcccgaggcctcctcatctatgatcgctataccaacgagggccaacgtggccaactccccgaagccctaagggttcaggtggcgtaggtgggtctgggacaggtacttcactctacaccatcagcacgaccgtagacgtacctaaggtaacgttagttttacgtacttagttttaacttacgttacgtacgtaacgtacgtaacgtacgtaacgtacctaacgtccggtacccgttacggtttaccgggaacgggtaacgggtaaccggtaagggtaacggaaaacgtaccgaaaaacggtacgttaggtacggtcgtacgacaacctacgttacgttagttaccttcgtacgtttaccccg

SEQ ID NO: 62213 - DNA, 556 bp, Homo sapiens
  misc_feature: GYAE6OF01CPXGO.23.60.F05.1.454.CMB.1.raw
  modified_base (199)..(199): a, c, t, g, unknown or other
  misc_feature (199)..(199): n is a, c, g, or t
  modified_base (392)..(392): a, c, t, g, unknown or other
  misc_feature (392)..(392): n is a, c, g, or t
  modified_base (475)..(475): a, c, t, g, unknown or other
  misc_feature (475)..(475): n is a, c, g, or t
  modified_base (515)..(515): a, c, t, g, unknown or other
  misc_feature (515)..(515): n is a, c, g, or t
  modified_base (517)..(519): a, c, t, g, unknown or other
  misc_feature (517)..(519): n is a, c, g, or t
  modified_base (521)..(521): a, c, t, g, unknown or other
  misc_feature (521)..(521): n is a, c, g, or t
  modified_base (523)..(556): a, c, t, g, unknown or other
  misc_feature (523)..(556): n is a, c, g, or t
tcagacgcgagtatcacgaccggtgctcgatttagtacgtcatcagggaaaggggctggagtgggtgggtttgattagaagtaaaagttatgggtgggacaacaaaatacgccgcgtctgtggaaggcagattcaacatctcaagaaatgattccacaagtgtcgcctatctgcaaaatgaacagcctagaaaaaccgnggacacaggcgtgtattactgtacgagcaagatttctcgttgggttccggggactcccccgatacttttgacctacgtgggggcccaagggtaaccctcggtcctaccgtccttcctcaccgcctacccaaccgaacgggccccaagttccggtcccttccccccgtggccctaccctccctaccgaacgacncctacccgtcgttcgggggaccacgtacggcggcccgtgggcctgcctggtacaacggtctacttcacttactcggtcgtcgngacggcgggtcgtacggacgtaacgggcgacaagtacgcngnnngncnnnnnnnnnnnnnnnnnnnnnnnnnnnnnnnnnn

SEQ ID NO: 62214 - DNA, 681 bp, Homo sapiens
  misc_feature: GYAE6OF01EW7SZ.23.60.F05.1.454.CMB.1.raw
  modified_base (199)..(199): a, c, t, g, unknown or other
  misc_feature (199)..(199): n is a, c, g, or t
  modified_base (265)..(265): a, c, t, g, unknown or other
  misc_feature (265)..(265): n is a, c, g, or t
  modified_base (294)..(294): a, c, t, g, unknown or other
  misc_feature (294)..(294): n is a, c, g, or t
tcagacgcgagtatcacgaccggtgctcgatttagtacgtcatcagggaaagggggaggaactgctcagttaggacccagagggaaccatggaagccccagctcagcttctcttcctcctgctactctggctcccagataccaccggagaaattgtgttgacacagtctccagccacctgtctttgctccgaggggaangccaccctctcctgcgaggccagtcagagtgttagcagtctacttgcctggtaccagcaagaaacngtcggccaggcctcccgaggtccttcctnacttctagtgactcgacactccgaacgagggcccagtcggcactcccgagtccgtaaggttcgaggtggcgtaggtcggtacgtgggaactacgtactttccaacgttcaccaacctatccgacgacctacgtaccgtaggaccgtacgttaaggtaagttacgttttacgacgtttagtttaacgttacgttgtaccgtaggtacctacggtacgtacgtacctaaccggtaccgggtacccgttacggtttaccggggaccgggtaacgggtaaccgtaaggggtaacgtaaaacgtaaccggtaaaccggtaacgtacgggtacggtacgtaccggtacctaccgttacgttaccgttacgtttccttcgtaccgtttaccccg

SEQ ID NO: 62215 - DNA, 627 bp, Homo sapiens
  misc_feature: GYAE6OF01BD92H.23.60.F05.1.454.CMB.1.raw
  modified_base (203)..(203): a, c, t, g, unknown or other
  misc_feature (203)..(203): n is a, c, g, or t
  modified_base (258)..(258): a, c, t, g, unknown or other
  misc_feature (258)..(258): n is a, c, g, or t
tcagacgcgagtatcacgaccggtgctcgatttagtacgtcatcagggaaagggggaggaactgctcagttaggacccagagggaaccatggaagccccagctcagcttctcttcctcctgctactctggctcccagataccaccggagaaattgtgttgacacagtctccagccaccctgttctttgtctccgaggggaaangccaccctctcctgcagggccagtcagagtgttagcagctacttgcctggtaccngcagaaacatggccaggcctcccgaggctcctcatctatgatgcatccaagacggccacgtgcactcccgagccaggttccagtcggacgtaggtgggtcgtggggaaccaggtacctttcaccgtcctacgaccctagtccacgcacgcctagacgccgtagtaacgttattttcgacgttagttttacttacgttgtacgagtactgtacgtacgaccgtaacggtaccggtacccgtacggtttaccggccgggtaacgggaacccgtaagggtaacgggtaaacgtaaccgtaaaccggtaacgttggtacggtccgttacgaccaacccgtacttcttaccggttccttccgtacgtttccccg

SEQ ID NO: 62216 - DNA, 822 bp, Homo sapiens
  misc_feature: GYAE6OF01B19BF.23.60.F05.1.454.CMB.1.raw
  modified_base (296)..(296): a, c, t, g, unknown or other
  misc_feature (296)..(296): n is a, c, g, or t
tcagacgcgagtatcacgaccggtgctcgatttagtacgtcatcagggaaagggggaggaactgctcagttaggacccagagggaaccatggaagccccagctcagcttctcttcctcctgctactctgctcccagataccaccggagaattgtgttgacacagtctccacgccaccctgttctttcgtcctaccgaaggggaaagacgcccacccttcctcctgccgacgggccagtcgagagttgttagcagtccttacgttacgcccgttacggtaccagaccgaagaaaacngtcggacccgtacgggccctaccccgaacggtcccttcccctactacttaccttagtacgtactacgaccctaaccgtaccccgaaccggaccgggaccctaccggtcggacctacctaccccgacgtaccgttacggttccgaggtcggtacgtagggttcgggtacggtacggtaaccgtagtacctttaccaccgtttcctaccctacctaccgtcgaccgtccgtaacgtccgtaaggtacccgttaccgttaagtaacggttttacgttttacgttaccggttttaaagttttttaaaccttccgtaaccggttcgtaaccgtcggtaacggtacccgtaacgttacccgtaacccggttcccgggttacccccggttacggttacccggggaacggggtaacggaaacccggttaaggggaccgtaaaaccgtaaccggtaaaccgggtccggtttagggcccgtacgaccgtacccgtacctttgttaccgtttactacctttacgcccctttccccgg

SEQ ID NO: 62217 - DNA, 729 bp, Homo sapiens
  misc_feature: GYAE6OF01CNFN7.23.60.F05.1.454.CMB.1.raw
  modified_base (203)..(203): a, c, t, g, unknown or other
  misc_feature (203)..(203): n is a, c, g, or t
  modified_base (273)..(273): a, c, t, g, unknown or other
  misc_feature (273)..(273): n is a, c, g, or t
  modified_base (466)..(466): a, c, t, g, unknown or other
  misc_feature (466)..(466): n is a, c, g, or t
tcagacgcgagtatcacgaccggtgctcgatttagtacgtcatcagggaaagggggaggaactgctcagttaggacccagagggaaccatggaagccccagctcagcttctcttcctcctgctactctggctcccagataccaccggagaaattgtgttgacacagtctccagccaccctgtctttgtctccgaaggggaaancgcccaccctctcctgcgagggccagtcagagtgttagcagtctacttagcctggtaccagcaagaaacngtcggaccaggtcctacccgaggtcctcctcattcctatcgactgacctaactaccccgaaacgacggggaccctaacggtcggacctaccgtccccgaacggtcccgtaagggtttccgagggttcgggacgttacggggtcggggttcgtaggggaacctaggttaccttccgaaccttcgtaccaacctntaccgacgtcgaacgtccgtaagacgtaccgtagtaacgttacgttttacgtacgttaagttttaacgttacgttacgtaccgacggtacgtacgggtaccgttaacgaccgtaaccggtccgggtacccgttaccggtttccggggaaccgggtacgggtaaccgggtaagggtaacgtaaacgtaccgaaaacggtacggtggtacggtccgtcgaaccgtaccgtacgttacttaccgtaccttccgttccgttaccccg

SEQ ID NO: 62218 - DNA, 714 bp, Homo sapiens
  misc_feature: GYAE6OF01DYAEN.23.60.F05.1.454.CMB.1.raw
  modified_base (199)..(199): a, c, t, g, unknown or other
  misc_feature (199)..(199): n is a, c, g, or t
  modified_base (288)..(288): a, c, t, g, unknown or other
  misc_feature (288)..(288): n is a, c, g, or t
tcagacgcgagtatcacgaccggtgctcgatttagtacgtcatcagggaaagggggaggaactgctcagttaggacccagagggaaccatggaagccccagctcagcttctcttcctcctgctactctggctcccagataccaccggagaaattgtgttgacacagtctccagccacctgtcttgtctccgaggggaanagccaccctctcctgcagggccagtcagagtgtagcagctacttagcctggtaccagcaagaaacatggccaggcctcccgagcctccnatctatgatgctactacccaagacgggccacgtgacactcccgagcctaggttcagtcggactagggtcggtctgggacaggtaccttcgaccttctaccacctatcgacgcgacgaccgtagacgacccttaggaacttagttttacgactttaaggtttttaactttaacggttcgttaccgtaacggtaccgtaggttaaccgttacgaacccgttaaccgttaccgggtcccccgttaacgggtttcccggggaaccggggtaacgggggtaaacccgtaaaggggtaacggtaaaaccgttaaccggtaaaaacccgggtaacgtttacgggtaacgggtccttaaccgggtaccctaaaccccgttacgttacccgtttaccggtttaacccgtttcccgtaacccgttttaccccccgg

SEQ ID NO: 62219 - DNA, 797 bp, Homo sapiens
  misc_feature: GYAE6OF01CID57.23.60.F05.1.454.CMB.1.raw
  modified_base (150)..(150): a, c, t, g, unknown or other
  misc_feature (150)..(150): n is a, c, g, or t
  modified_base (505)..(505): a, c, t, g, unknown or other
  misc_feature (505)..(505): n is a, c, g, or t
tcagacgcgagtatcacgaccggtgctcgatttagtacgtcatcagggaaagggggaggaactgctcagttaggacccagagggaaccatggaagccccagctcagcttctcttcctcctgctactctcggctccagactaccaccgganaaattgtgttagacacagtcctccacgcccacccgttgttctttgacctaccggaaagggggaaacgcgacccaaccccttctccgtacgcgacggccaggtacaggtagtaggtacgcacgtccttagtacgcctaggaccagacaagtaaacagtcggaccaggaccctacccgaggcccttacctactactacaattgactacgacctactaacccgaacgaccgggtaacctacggcggacccaaacgttccccgaacgtaacggtacggtttcggaacggtcgggtacgtaggggttaccggtacggtagggaaccgtaagtaacccttcgaaccttcgtacccacgtanacgtaaccgacgtaccgtactacggtaacgtaccgttaaggtaagtttacgttacgttaacgttaagttttaacttacgttacgtacggtacgtacgtaaccgtacggtaacgtaaccgttaccggtaaccggttacccgttaacgggtttacccgggaacggggtacgggtaaaccggtaaagggtaaccgtaaaaccggtaaacgtaaaaccggacggttacgggtaacgtcccggtacgaaccgttaacctacgttaccgttaccgtttaactccgtaacccttccccg

SEQ ID NO: 62220 - DNA, 738 bp, Homo sapiens
  misc_feature: GYAE6OF01EJFY2.23.60.F05.1.454.CMB.1.raw
tcagacgcgagtatcacgaccggtgctcgatttagtacgtcatcagggaaagggggaggaactgctcagttaggacccagagggaaccatggaagccccagctcagcttctcttcctcctgctactctggctcccagataccaccggagaaattgtgttgacacagtctccagcccaccctgttctttgtctccgaggggaaagagcccaccctctcctgcagggccagtcagagtgttagcagctacttacgcctggtaccagcaagaaacagtcggaccacggcctacccgaggccttcctacattctatgatgacactaccgaacgacggaccacgtcgacactcccgagtccgtaggttcaggtcggcgtagggtcgggtacgtcgggaactacggtacctttaccgaccttacctaccgaaccctacgtaccgacgaccgaaccggtaccgtaacggacgtacccgttaaggtaacgtttaacgtttttacgtaacgttttaacgtttttaacgtttaccgtttacggtaccgtacggtacgtacggtacggttaaccgtaaccgtaacccggttaccgggtaccccgtttacgggtttaccggggaccgggtaacggggaacccggtaaagggtaacggtaaaacgtaaaccgtaaaccgggtacgttagggtacggtccgtacgaccctacgtactttacgttacgtttaccgttccgtaccgttaccccg

SEQ ID NO: 62221 - DNA, 642 bp, Homo sapiens
  misc_feature: GYAE6OF01C678L.23.60.F05.1.454.CMB.1.raw
  modified_base (165)..(165): a, c, t, g, unknown or other
  misc_feature (165)..(165): n is a, c, g, or t
  modified_base (198)..(198): a, c, t, g, unknown or other
  misc_feature (198)..(198): n is a, c, g, or t
  modified_base (233)..(233): a, c, t, g, unknown or other
  misc_feature (233)..(233): n is a, c, g, or t
  modified_base (306)..(306): a, c, t, g, unknown or other
  misc_feature (306)..(306): n is a, c, g, or t
  modified_base (515)..(515): a, c, t, g, unknown or other
  misc_feature (515)..(515): n is a, c, g, or t
  modified_base (605)..(605): a, c, t, g, unknown or other
  misc_feature (605)..(605): n is a, c, g, or t
tcagacgcgagtatcacgaccggtgctcgatttagtacgtcatcagggaaagggggaggaactgctcagttaggacccagagggaaccatggaagccccagctcagcttctcttcctcctgctactctggcctccagactaccaccggagaaattgtgttgacanagtctccagccaccctgtcttgctcgagggaangccacctctcctgcgagggccagtcagtagtgtanctaggtctacttagccgtaggtacagacaagaaactagtcggacctacggcctacccgaggtacctcccctanacgttacgtatcgggtatcgacctaactcccgaaaggcggaccacgtaggaccacgtcccgacgtcctaggtccgaggtcgtcgaagggttcgggtacgtagggaaccttcggtaccttacctaccgttactacccaaccgtatccgacgacgtacgaccgtacacggtactagtaacgtatttggacttaggtttacttacgtcgtanacgtcaagggtactcgtacgacgtccgtacgtacgttacgggacggaaggtacgtacggtagtaaactacggaaacgtcgtaggtaccgngtacacgactacgtcgtagtcccttgtacttacccgg

SEQ ID NO: 62222 - DNA, 672 bp, Homo sapiens
  misc_feature: GYAE6OF01D46R2.23.60.F05.1.454.CMB.1.raw
  modified_base (209)..(209): a, c, t, g, unknown or other
  misc_feature (209)..(209): n is a, c, g, or t
  modified_base (244)..(244): a, c, t, g, unknown or other
  misc_feature (244)..(244): n is a, c, g, or t
  modified_base (509)..(509): a, c, t, g, unknown or other
  misc_feature (509)..(509): n is a, c, g, or t
  modified_base (644)..(672): a, c, t, g, unknown or other
  misc_feature (644)..(672): n is a, c, g, or t
tcagacgcgagtatcacgaccggtgctcgatttagtacgtcatcagggaaaggggctggagtgggtgggtttgattagaagtaaaagttatgggtgggacaaacaaaaatcgccgcgtctgtggaaggcagattcaacatctacaaaggaaatgacttccaacaagtgtccgcctatctgactaaatgaacacgacctaagaaaaccgnggacaacgagggcgtagtaatttacgtggtaacgngacagttacttttcgtcggttcgggggttccgggacctccccctaagttctttgaacgttacggtcggggaccgaacggtaccctcggtacctaccggtctccctcgtacgccctacccgtaaccgaaccggggcccctaacggtttcccggttccccgttccccccgtcgggtacccctacccccttacccgtaacccgaaacggccgtaccgttaccccgttcgggaccgggggccaaacgggccgggcccggttaccccggnggtccgttcggcccgttacgggtaaccgaacggttaaccttaccgttacgaaccttaccggtcgtaccggttcgcgggtaaccgggccgggtcgtacgggaaccggtacggtccgaacgtagtacggctgatcgnnnnnnnnnnnnnnnnnnnnnnnnnnnnn

SEQ ID NO: 62223 - DNA, 847 bp, Homo sapiens
  misc_feature: GYAE6OF01CRUXU.23.60.F05.1.454.CMB.1.raw
  modified_base (170)..(170): a, c, t, g, unknown or other
  misc_feature (170)..(170): n is a, c, g, or t
  modified_base (214)..(214): a, c, t, g, unknown or other
  misc_feature (214)..(214): n is a, c, g, or t
tcagacgcgagtatcacgaccggtgctcgatttagtacgtcatcagggaaagggggaggaactgctcagttaggacccagagggaaccatggaacgccccagctcagcttctcttcctcctgctactctggcctaccagactaccgaccggagtaaattgtgttgacacngtcctccacgcctaccctgttctttcgtctccgaaggggaaacncgccctacccgtcgtccgtaggcggacgggtccaagtccgagggtagttacggttacgctaacgtacctttaaccgttacggacccgtagggtaaccctaggtaacgaaacggtaaacgaacgtccgggacccagggcccttaccccgaacggtcctaccgtacttaacgtcttaaacgttggaaccgttagtcccgtaacgtaacccggtaacccggaccggggtcccgtaaccggacgggtaccccttaaccgtaccccccgaacgggaccccgggtttaaggttaaccgggaaccgggttggacccggtaagggggttcggttacggggtaaccggacggttaacctaactttacccgacgttaacctaccacggtactacgacgtacacggtacctacgacgtcgttaagtagttacgttggtactttacgttattacgcggtactacgtacgtacgccggttaactacccggtaccgttacccggtccggttaccggttacggggaccgggtaacgggtaacgtaacgggaaacgttacgaaaccgttaagggtacccggttagtacgggtcccttaacgtacccgagtaaccggtttcttacttaccgttacccttccggtaccccc

SEQ ID NO: 62224 - DNA, 735 bp, Homo sapiens
  misc_feature: GYAE6OF01C8JNV.23.60.F05.1.454.CMB.1.raw
  modified_base (216)..(216): a, c, t, g, unknown or other
  misc_feature (216)..(216): n is a, c, g, or t
  modified_base (330)..(330): a, c, t, g, unknown or other
  misc_feature (330)..(330): n is a, c, g, or t
  modified_base (393)..(393): a, c, t, g, unknown or other
  misc_feature (393)..(393): n is a, c, g, or t
tcagacgcgagtatcacgaccggtgctcgatttagtacgtcatcaggggaaaggggggaggaactgctcagttaggacccaggagggaaccatggaagccccagctcagcttctcttcctcctgctactctcggcctcccagactaccgaccggagtaaattgtgttgacacagtcctccagccctacccttgtctttgacctccggaaggggaancgccctaccctctcgtgcgagggccagtcaggtgtgtagctagtaccttacgttcgccgtaggtaccagacaagaactagtcggacccgacgcctcccgaggtccctacctctntcgttactgtactacgccgtaactacccggaacggaccggtacccacggtacggaccctaccncccggaacgcccgttaggttcgaggttcggacgttagggtccgggtacgtcggggaactacgtcccttacgacctcgtaccacctagtcgtaacggccaacgtcgtaaggaccgtccgttaagtacgttttatttcggtaacttttggtttaaccttagttccggtaacgtctaagggtccggtaacggttaccgtaaccggtacccgttccggttacccggtacgggtttacggggaacccgggagggtaaacccggtagggtaacgaaacgttaccggaagtaccggttgggaccgttacggcgaaccttacgtcgttcggttactctccgtcgttcccg

SEQ ID NO: 62225 - DNA, 695 bp, Homo sapiens
  misc_feature: GYAE6OF01BD3GD.23.60.F05.1.454.CMB.1.raw
  modified_base (279)..(279): a, c, t, g, unknown or other
  misc_feature (279)..(279): n is a, c, g, or t
  modified_base (311)..(311): a, c, t, g, unknown or other
  misc_feature (311)..(311): n is a, c, g, or t
tcagacgcgagtatcacgaccggtgctcgatttagtacgtcatcagggaaagggggaggaactgctcagttaggacccagagggaaccatggaagccccagctcagcttctcttcctcctgctactctggctcccagactaccaccggagaaattgtgttgacacagtctccagcccacccttgttctttgtctccgaggggaaagcgcccaccctctccgtgccgacgggccagtcagagtgttagcagctactagcctaggtaccagacaagaaacngtacggcccaaggcctcccgaggccttccctnacgttctatgactcgcctaatacccaaacggcgggaccacgtcggctaccgtccacgtcctaggttcaggtcggacgagggttcgggtcctagggaacctacgttaccttccacgttccaccgaacctagtccgacgccgtacgaccggtaacgtcggtaccgtagtaacgttagtttacgtacgtttaaggttttaacttaccgttacgtacgtaacgttaaccgttacgtaaccgttaaccgttacggttaaccgttacggtttaacccgggacggtaacggggtaaccgacggtacgtaggtacgtacgtaaccgaacgtacggtacttcgggacggtctacggtacctaccgttacgttaccgtcgttccttacgtcccg

SEQ ID NO: 62226 - DNA, 992 bp, Homo sapiens
  misc_feature: GYAE6OF01ATCXU.23.60.F05.1.454.CMB.1.raw
  modified_base (215)..(215): a, c, t, g, unknown or other
  misc_feature (215)..(215): n is a, c, g, or t
tcagacgcgagtatcacgaccggtgctcgatttagtacgtcatcagggaaagggggaggaactgctcagttaggacccagagggaaccatggaagccccagctcagcttctcttcctcctgctactctggctccagactaccgacggagtaattgtcgttgacactagtctccacgtccctaccttgttctttcgtcctaccggaaggggaaacnccgccctacccctctccgtgaccggacggcctaaggtacaggtaagttggttacgccgtacgtaccttaacgttacgtccgttacggtaacccgagaaccgtaaacgtaaaactcggtccgggacccgtaacgggtcccctaccccggtacgggtcccttccgtacttacctacgtaagttcgggtaactcgtaccctaacgtaacccggaaccggtaccggggtaccctaacgggtaccggactaaccccgtaccccggtaaaccggttcccgtaacggggttaccggacgggttaccgggtaccggtttacgggggttcccggggttaacgtaccggggtaaaccgttaacccgttaacccggtttacccgaacgttttccccgaaacccgtaacctacggttacccgaacgtaccggtaaccgtaccgttaacgtacggttaccggtacggttaaacgtttacggtttacggttacgtttaacgtttttaaccggttacgttacgttaaccggaccggttacgtaaaccgggttacgtaaccgtaacccggttaccgggttaaccccggttacccggtttaaccgggttaacccggggtacggtaaaccggggttaaaccgggttaaacgggtaaacggttaaacccggtaaacccgggaaacgggtttacccgtaccgggttacgggtaacccggtttacccgaaacccggttccgggttaactttccccgggttaacttttacccgttaaccccgttccccgtttaaccccg

SEQ ID NO: 62227 - DNA, 758 bp, Homo sapiens
  misc_feature: GYAE6OF01CYRP9.23.60.F05.1.454.CMB.1.raw
  modified_base (330)..(330): a, c, t, g, unknown or other
  misc_feature (330)..(330): n is a, c, g, or t
tcagacgcgagtatcacgaccggtgctcgatttagtacgtcatcagggaaagggggaggaactgctcagttaggacccagagggaaccatggaagccccagctcagtcttcctccttcctcctgctactcgtggcctcccagactaccgaccggaagtaaattgtgttagacacagtcctaccagcccacccttggttcctttcgtccgtaccggaaggggaaaacgacgacccaccccgttctccgtcgacgagggccaggtcgaaggtagttcgttagactagaccttacgttacggccgtaggtaaccgagaccgaaagtaaaccgngtacggaccgaaggccctacccgacggtctaccactatacgtagtcgaagtcactaacaaccgaacggaccgggacctaacgcggaccactaccccgagtaccgtaagttccgaggtggacgtaggggttcgtacgacggacacgtcctacacctcaacacactacgacgacgacgaccgtagacgtacgtacgtaagttacgtttacgtactttagtttaacgtacgtcgtaacgtaacgacgtacggtaacgttaaccggaaccgtacccggtaaccggtcccgttaacgggtaccgggaacgggaacgggtaaaccggtaagggtaaacgaaaaccgtaaaccgggaaaaccgtcgggtaagggtacggactaccgaaccgtacctacgtttacgttacgtacctttccgtacccgttaccccgg

SEQ ID NO: 62228 - DNA, 790 bp, Homo sapiens
  misc_feature: GYAE6OF01D28AQ.23.60.F05.1.454.CMB.1.raw
  modified_base (233)..(233): a, c, t, g, unknown or other
  misc_feature (233)..(233): n is a, c, g, or t
  modified_base (280)..(280): a, c, t, g, unknown or other
  misc_feature (280)..(280): n is a, c, g, or t
  modified_base (775)..(775): a, c, t, g, unknown or other
  misc_feature (775)..(775): n is a, c, g, or t
tcagacgcgagtatcacgaccggtgctcgatttagtacgtcatcagggaaagggggaggaactgctcagttaggacccagagggaaccatggaagccccagctcagcttctcttcctcctgctactctgcctcccagactaccgaccggaagtaaattgtgttgacactagtcctacccacgggggggccctacccttgttctttgtcctaccggaaggggaaagaccgcccncccttcctaccgtcgacgaccggccgagtacgagtagttgttacganacgtacttacgttacgtccgttacggtaccgagaacaagaaactagttacggccgtacggtccctcccgacgtacctcctctaactccttagtgtaacgtcgtacacctaccgaaccggaccgggtacccaccggtacggtacctaacccgtaccccgtaaccggaccggttaccggttaggacggtacgggtcggacgggtttacgggccggttacgggtacgtaaccgttacccgttacccacctttcccgtaaccctaacccgtacttccgacgaaccgttacccgacgttaccgggactacccggttagtttaatttatttaccggttattttacggttttaccgttatcgttaacgcgtaccgttacgaggtccaaccggtacgtcccggggttaccttacggtaccgggacgggttacaacggggtaagtaaacggacaaacccggtaagtaccgttgtccggacgtccactacgtctttcgtaccttntaccgtcttaccccg

SEQ ID NO: 62229 - DNA, 539 bp, Homo sapiens
  misc_feature: GYAE6OF02GZGZA.23.60.F05.1.454.CMB.1.raw
  modified_base (267)..(267): a, c, t, g, unknown or other
  misc_feature (267)..(267): n is a, c, g, or t
tcagacgcgagtatcacgaccggtgctcgatttagtacgtcatcagggaaagggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtgttagcagctacttagcctggtaccagcagaaacntggccaggctccaggctcctcatctatgatgcatccaacagggccactggcatcccagccaggttcagtggcaggtgggtctgggacagcttcactctacaccatcagcagcctagacgcctagaagtattttgctagtttattacttgtcagcagcgtagcaacgtcggccctacgtttcgggcggacgggaccgaagggtacggaagtcgaaacggtaacgtaggtacggcgtaggaccaccgtacgttcctcgttccttacacttcccg

SEQ ID NO: 62230 - DNA, 556 bp, Homo sapiens
  misc_feature: GYAE6OF02HN1M9.23.60.F05.1.454.CMB.1.raw
  modified_base (268)..(268): a, c, t, g, unknown or other
  misc_feature (268)..(268): n is a, c, g, or t
  modified_base (307)..(307): a, c, t, g, unknown or other
  misc_feature (307)..(307): n is a, c, g, or t
tcagacgcgagtatcacgaccggtgctcgatttagtacgtcatcagggaaagggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtgttagcagctacttagcctggtaccagcaagaaacntggccaggctccaggctcctcatctatgatgcatccaanaggccacgtggcatcccagccaggttcagtgcaggtgggtctgggacagacttcactctacacatcagcacgcctagacgcctagaagtattttagacttagtttaacttacgttgtcagcagcgtaagactaacgtcggaccctacgtttcggacgggtaacggaaccgaagggtacggaacgtacgaaacggtaacgtggtaggacgtacgaccgaccgtacgtccgttacgttacttcagttcccg

SEQ ID NO: 62231 - DNA, 614 bp, Homo sapiens
  misc_feature: GYAE6OF02J3IZO.23.60.F05.1.454.CMB.1.raw
  modified_base (202)..(202): a, c, t, g, unknown or other
  misc_feature (202)..(202): n is a, c, g, or t
  modified_base (466)..(466): a, c, t, g, unknown or other
  misc_feature (466)..(466): n is a, c, g, or t
  modified_base (579)..(579): a, c, t, g, unknown or other
  misc_feature (579)..(579): n is a, c, g, or t
  modified_base (582)..(583): a, c, t, g, unknown or other
  misc_feature (582)..(583): n is a, c, g, or t
  modified_base (587)..(587): a, c, t, g, unknown or other
  misc_feature (587)..(587): n is a, c, g, or t
  modified_base (589)..(614): a, c, t, g, unknown or other
  misc_feature (589)..(614): n is a, c, g, or t
tcagacgcgagtatcacgaccggtgctcgatttagtacgtcatcagggaaagggcgtggagtgggtgggtttgattagaagtaaagttatggtggacaacaaatacgccgcgtctgtggaaggcagattcaacatctacaaagaaatgacttccaacaagtcgtcgcctatctgacaaatgaacacgtcctaagaaaaccgnggtacacgaggtcgtagttattacgtggtacgagcagtactttctcggtcgggttaccgggactccccaagttctttacggacctacggtcggggaccctaacggggtaaccctggtacccaccgttcctccgtacgaccgcccctacccgaacgtaccgggtccctacgttcccggtccccttccccgtagacccctaccccttcgaccgaacgtccgacccgtaccgtcgggcggggaccaccggtccggcccgggttcccngggtccctaccgggtcctacgggttaaccaacggttacccttacctcccgtacgttaccgtcccggcgtcgtacggcgggccggtcgtacggaccgacggtccgacagtcgcncgnntcantnnnnnnnnnnnnnnnnnnnnnnnnnn

SEQ ID NO: 62232 - DNA, 519 bp, Homo sapiens
  misc_feature: GYAE6OF02GRH61.23.60.F05.1.454.CMB.1.raw
tcagacgcgagtatcacgaccggtgctcgatttagtacgtcatcagggaaagggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtgttagcagctacttagcctggtaccagcagaaacatggccaggctccaggctcctcatctatgatgcatccaacagggccactggcatcccagccaggttcagtggcagtggtctggacagacttcactctcacatcagcagcctagacgcctagaagtatttgctagtttattacttgtcagcagtcgtagcgaacgtcgacctacgtttcggcggtacggaccgaaggtagacgtacgaaacggaacgtagtcggcgtgacaccagtcctcgtcttctattcccg

SEQ ID NO: 62233 - DNA, 551 bp, Homo sapiens
  misc_feature: GYAE6OF02GAHD0.23.60.F05.1.454.CMB.1.raw
  modified_base (202)..(202): a, c, t, g, unknown or other
  misc_feature (202)..(202): n is a, c, g, or t
tcagacgcgagtatcacgaccggtgctcgatttagtacgtcatcagggaaagggggaggaactgctcagttaggacccagagggaaccatggaagccccagctcagcttctcttcctcctgctactctggctcccagataccaccggagaaattgtgttgacacagtctccagccaccctgtctttgtctccaggggaaagngccaccctctcctgcagggccagtcagagtgttagcagctacttagcctggtaccagcagaaacatggccaggctcccaggctcctcatctatgatgcatccaacagggccacgtggcactcccagccaggttcagtggcaggtgggtctgggacagacttcactctcaccatcagcagcctagacgcctagaagtagttttgacgttagtttaattacgttgtactagcagcgtagacaacgtcgtccctacgtttcgggcggtacgggaaccgagggtaggaagtacgaaacggtaacgtggtacggcgtcgacgtaccgacgtccgtagttccttcgtacttcccg

SEQ ID NO: 62234 - DNA, 529 bp, Homo sapiens
  misc_feature: GYAE6OF02HX5IZ.23.60.F05.1.454.CMB.1.raw
  modified_base (201)..(201): a, c, t, g, unknown or other
  misc_feature (201)..(201): n is a, c, g, or t
  modified_base (306)..(306): a, c, t, g, unknown or other
  misc_feature (306)..(306): n is a, c, g, or t
  modified_base (362)..(362): a, c, t, g, unknown or other
  misc_feature (362)..(362): n is a, c, g, or t
tcagacgcgagtatcacgaccggtgctcgatttagtacgtcatcagggaaagggggaggaactgctcagttaggacccagagggaaccatggaagccccagctcagcttctcttcctcctgctactctggctcccagataccaccggagaaattgtgttgacacagtctccagccaccctgtctttgtctccaggggaaangccaccctctcctgcagggccagtcagagtgttagcagctacttagcctggtaccagcagaaacatggccaggctcccaggctcctcatctatgatgcatccaancggccatgcatcccagccaggtcagtggcaggtgggtctgggacagacttcactcncacatcagcacgcctaagcgcctagaagtattttgacttagtttattactgtcagcagtcgtagactacgtcgcctacgtttcgggcggagggaccgaagggtagaacacggaaaccgaacgttcggaggtctcgaccacgtatcttcggtacttaccgtattcccg

SEQ ID NO: 62235 - DNA, 590 bp, Homo sapiens
  misc_feature: GYAE6OF02F0PYE.23.60.F05.1.454.CMB.1.raw
  modified_base (204)..(204): a, c, t, g, unknown or other
  misc_feature (204)..(204): n is a, c, g, or t
  modified_base (263)..(263): a, c, t, g, unknown or other
  misc_feature (263)..(263): n is a, c, g, or t
  modified_base (271)..(271): a, c, t, g, unknown or other
  misc_feature (271)..(271): n is a, c, g, or t
tcagacgcgagtatcacgaccggtgctcgatttagtacgtcatcagggaaagggggaggaactgctcgagttaggacccagacgggaaccatggaagccccagctcagcttctcttcctcctgctactctggctcccagataccaccggagaaagttgtgttgacacagtctccagccaccctgtctttgtctccaggggaaanagccaccctctcctgccagggccagtccagagtgttagcagctacttagcctggtaccngcagaacntggccaggctcccaggcctcctcatctatcgatgctataccaacgacggggcctaacgtgggaccacggtccccgacgccgtagggttccaggtgggctaggtcgggtctagggacagacttcactctccaccatcacgcacgtcctacgcgacctacgtaacttacgtttagacgttagttttaacttacgttgtcagacacgtcgtacgacgtacgtcgacctacgtttcgggacggtacggtaccgaacgggtagaactacgtaacgtaacgtaggtcggcgtcgacgaccagttaccgtcgtacttcgtactccg

SEQ ID NO: 62236 - DNA, 571 bp, Homo sapiens
  misc_feature: GYAE6OF02G31TD.23.60.F05.1.454.CMB.1.raw
  modified_base (201)..(201): a, c, t, g, unknown or other
  misc_feature (201)..(201): n is a, c, g, or t
  modified_base (268)..(268): a, c, t, g, unknown or other
  misc_feature (268)..(268): n is a, c, g, or t
tcagacgcgagtatcacgaccggtgctcgatttagtacgtcatcagggaaagggggaggaactgctcagttaggacccagagggaaccatggaagccccagctcagcttctcttcctcctgctactctggctcccagataccaccggagaaattgtgttgacacagtctccagccaccctgtctttgtctccaggggaaanagccaccctctcctgcagggccagtcagagtgttagcagctacttagcctggtaccagcaagaaacntggccaggctccgaggcctcctcatctatgatgcatccaacgcgggccagtggccactcccgagccctaggttccaggtcggcaggtcgggtctagggacaggtacttcgactctacacctatcagcacgacctagacgcctagaagtatttgacttagtttacttactgtcagtctacgtcgtacgactacgtcgacccgtacgttccgggacggacggaaccgagggtacgaacgtacgtaaacgtacgtaggtacggacgtacggacaccgtagtccgttagtaccttacgtacttcccg

SEQ ID NO: 62237 - DNA, 511 bp, Homo sapiens
  misc_feature: GYAE6OF02IMUKT.23.60.F05.1.454.CMB.1.raw
  modified_base (202)..(202): a, c, t, g, unknown or other
  misc_feature (202)..(202): n is a, c, g, or t
  modified_base (482)..(482): a, c, t, g, unknown or other
  misc_feature (482)..(482): n is a, c, g, or t
tcagacgcgagtatcacgaccggtgctcgatttagtacgtcatcagggaaagggggaggaactgctcagttaggacccagagggaaccatggaagccccagctcagcttctcttcctcctgctactctggctcccagataccaccggagaaattgtgttgacacagtctccagccaccctgtctttgtctccaggggaaagngccaccctctcctgcagggccagtcagagtgttagcagctacttagcctggtaccagcagaaacatggccaggctccaggctcctcatctatgatgcatccaacagggccatggcatcccagccaggttcagtgcagtgggtctgggacagacttcactctcaccatcagcagcctagagcctagaagtattttcgcttaggtttattactgtacagtcagcgtagctaacgtgccctagttcggcggagggaccaagggtcgaatcgaaacggtactgnggctgccactctcgtcgtcttcattcccg

SEQ ID NO: 62238 - DNA, 702 bp, Homo sapiens
  misc_feature: GYAE6OF02JZBMU.23.60.F05.1.454.CMB.1.raw
  modified_base (205)..(205): a, c, t, g, unknown or other
  misc_feature (205)..(205): n is a, c, g, or t
  modified_base (233)..(233): a, c, t, g, unknown or other
  misc_feature (233)..(233): n is a, c, g, or t
  modified_base (303)..(303): a, c, t, g, unknown or other
  misc_feature (303)..(303): n is a, c, g, or t
tcagacgcgagtatcacgaccggtgctcgatttagtacgtcatcagggaaagggggagggaacgtgctcagttaggacccagagggaaccatggaagccccagctcagcttctcttcctcctgctactctggctcccagactaccaccggagaaattgtgttgaccacagtctccagcccaccctgtcttgtctccaggggaaangccaccctctcctgcagggccagtcagngtgttagcagctacttagcctggtaccagccagaacatggccaggcctcccgaggcctccgtcatctagngatgcactaccgaacgtacgggcccactgggaccacgtccccaggaccctagggttccaaggttcgggactacggtggggtactacggggacaggtaccctttagaccgtcttacccgactactcgagctacgctaggaacgtcgtagaagttacgtttcacgtagttttaacttaccgtagttccgaacgtcggtacgtacgttacggtaccctaaccggttacgggaccccttaaccggttttacggggaacccggtaaacggggtaacccgtaacggggttaacgggaaccttacccgaaaaacggggttacctacgggggtactacccgggttacgtaaccgtaaccccgttagtacccgtttagggtaccctttacgttacccgttacccccgg

SEQ ID NO: 62239 - DNA, 579 bp, Homo sapiens
  misc_feature: GYAE6OF02H2HJ6.23.60.F05.1.454.CMB.1.raw
  modified_base (201)..(201): a, c, t, g, unknown or other
  misc_feature (201)..(201): n is a, c, g, or t
  modified_base (267)..(267): a, c, t, g, unknown or other
  misc_feature (267)..(267): n is a, c, g, or t
tcagacgcgagtatcacgaccggtgctcgatttagtacgtcatcagggaaagggggaggaactgctcagttaggacccagagggaaccatggaagccccagctcagcttctcttcctcctgctactctggctcccagataccaccggagaaattgtgttgacacagtctccagccaccctgtctttgtctccaggggaaanagccaccctctcctgcagggccagtcagagtgttagcagctacttagcctggtaccagcagaaacntggccaggcctcccgaggcctcctcatctatgatgcatccaacgcgggccacgtggcactcccagccaggttcaggtggctaggtgggtctggggacaggtacttcactctacacctatcagcagcctagacgctagaagtatttcgacttagtttattactgtactagcagcgtagacaacgtcggaccctacgtttccgggacgggaacgggaccgtaagggtacggaacgtaaccgaaacggtaacgttaggtacgggtcctacggaccgtaccgacgttccgttacggttcctttacgactttccccg

SEQ ID NO: 62240 - DNA, 696 bp, Homo sapiens
  misc_feature: GYAE6OF02GY55D.23.60.F05.1.454.CMB.1.raw
  modified_base (205)..(205): a, c, t, g, unknown or other
  misc_feature (205)..(205): n is a, c, g, or t
  modified_base (270)..(270): a, c, t, g, unknown or other
  misc_feature (270)..(270): n is a, c, g, or t
tcagacgcgagtatcacgaccggtgctcgatttagtacgtcatcagggaaagggggaggaactggctcgagttaggacccagagggaaccatggaagccccagctcagcttctcttcctcctgctactctggctcccagataccaccggagaaagttgtggttgacacagtctccagccaccctgtctttgtctccaggggaaangccaccctctcctgcagggccagtcagagtgtagcagctacttagcctggtaccagcaagaaacntggccaggcctccaggcctcctcatctatgattgcataccgaaacgacgggcccacgtgggaccaacgtccccgacgtcctaaggttccaggtgggccgtaagggtcggggtcctaggggacctacggtactttaccgacctccgtacccaaccctaagtccgaacgacctacggtacccctacggtaccggaccccgttaaggaaaccgttacgtttttacggacgtttaacggttttaacttttaaccgttcgggttaacctaacggccgtaacggtaccgttacgaccgtaacgtccggtacccgttacggtttccgggacgggtaacggaacccgtaagggtacgaaactccgaaaacggtcgtacggtcggtacgtacgacgtaaccgtacgttccgttacgtaccttcgacgttaccccg

SEQ ID NO: 62241 - DNA, 653 bp, Homo sapiens
  misc_feature: GYAE6OF02JN4HU.23.60.F05.1.454.CMB.1.raw
  modified_base (198)..(198): a, c, t, g, unknown or other
  misc_feature (198)..(198): n is a, c, g, or t
  modified_base (207)..(207): a, c, t, g, unknown or other
  misc_feature (207)..(207): n is a, c, g, or t
  modified_base (262)..(262): a, c, t, g, unknown or other
  misc_feature (262)..(262): n is a, c, g, or t
  modified_base (403)..(403): a, c, t, g, unknown or other
  misc_feature (403)..(403): n is a, c, g, or t
tcagacgcgagtatcacgaccggtgctcgatttagtacgtcatcagggaaagggggaggaactgctcagttaggacccagagggaaccatggaagccccagctcagcttctcttcctcctgctactctggctcccagataccaccggagaaattgtgttgacacagtctccagccacctgtctttgctccaggggaangccaccctntcctgcagggccagtcagagtgtagcagctacttagcctggtaccagcagaaacntcggccaggctcccgaggctcctcatcctatcggatgcctactccgaacgagggcccacgtggacactccccaagcccgtaggttcaggtcgactagggtcgggtctaggggaccaggtacgttcacgttcctcgaacctntaccgacgctacgccgtagacgacctaggaacgttattttaggaccttaaggtttactttacgttagttaccgtaacgtcgacggtcgttacgtacctaaccgtacggtaccctacggtttaccgggaccggaacgggtaaccgaacgggttacggaacgtaccgtaaacggtaaccggttacggacgggtacctacggaccgtaacccgtagttaccgttaccggttaccgttacgtaccgtttccccg

SEQ ID NO: 62242 - DNA, 551 bp, Homo sapiens
  misc_feature: GYAE6OF02GAH63.23.60.F05.1.454.CMB.1.raw
tcagacgcgagtatcacgaccggtgctcgatttagtacgtcatcagggaaagggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtgttagcagctacttagcctggtaccagcagaaacatggccaggcctcccaggctcctcatctatgatgcatccaacgagggccacgtggcatcccagccaggttcagtggcaggtgggtctgggacagacttcactctcaccatcagcagcctagacgtcctagaagtattttgactagtttattacttgtacgagcaggcgtagcaactcggccctacgtttccgggacggacgggaccgaagggtacggtaatacgaaacggtaacgtaggtacggtccgtagaccgacctacgtccgttcgtcttactacttcccg

SEQ ID NO: 62243 - DNA, 513 bp, Homo sapiens
  misc_feature: GYAE6OF02FZLVD.23.60.F05.1.454.CMB.1.raw
  modified_base (201)..(201): a, c, t, g, unknown or other
  misc_feature (201)..(201): n is a, c, g, or t
  modified_base (307)..(307): a, c, t, g, unknown or other
  misc_feature (307)..(307): n is a, c, g, or t
  modified_base (384)..(384): a, c, t, g, unknown or other
  misc_feature (384)..(384): n is a, c, g, or t
tcagacgcgagtatcacgaccggtgctcgatttagtacgtcatcagggaaagggggaggaactgctcagttaggacccagagggaaccatggaagccccagctcagcttctcttcctcctgctactctggctcccagataccaccggagaaattgtgttgacacagtctccagccaccctgtctttgtctccaggggaaangccaccctctcctgcagggccagtcagagtgttagcagctacttagcctggtaccagcagaaacatggccaggctcccaggctcctcatctatgatgcatccaacngggccactggcatcccagccaggttcagtggcagtgggtctgggacagacttcactctcaccatcagcagcctagcnctgaagtatttgctagtttatactgtcagtcagtcgtagcaacgtgccctacgtttcggcggacgggaccaagggtagaatacgaaacggtaacgtgtaggctgccacctatcgtagtcttcattcccg

SEQ ID NO: 62244 - DNA, 560 bp, Homo sapiens
  misc_feature: GYAE6OF02HD2R8.23.60.F05.1.454.CMB.1.raw
  modified_base (201)..(201): a, c, t, g, unknown or other
  misc_feature (201)..(201): n is a, c, g, or t
tcagacgcgagtatcacgaccggtgctcgatttagtacgtcatcagggaaagggggaggaactgctcagttaggacccagagggaaccatggaagccccagctcagcttctcttcctcctgctactctggctcccagataccaccggagaaattgtgttgacacagtctccagccaccctgtctttgtctccaggggaaanagccaccctctcctgcagggccagtcagagtgttagcagctacttagcctggtaccagcagaaacatggccaggctcccaggctcctcatctatgatgcatccaacagggccactggcactcccagccaggttcagtgcagtggtctgggacagtacttcactctcaccatcagcacgcctagacgcctagaagtatttgactagtttattacttgtcagtcacgacgtagactacgtcggaccctacgtttcgggacgggtacgggaaccgaagggtacggaacgtacgaaacggtaacgtacggtagggtactacggaccgtaaccgtagttccgtgttaccttactacgttccccg

SEQ ID NO: 62245 - DNA, 571 bp, Homo sapiens
  misc_feature: GYAE6OF02JJU2Y.23.60.F05.1.454.CMB.1.raw
  modified_base (202)..(202): a, c, t, g, unknown or other
  misc_feature (202)..(202): n is a, c, g, or t
  modified_base (311)..(311): a, c, t, g, unknown or other
  misc_feature (311)..(311): n is a, c, g, or t
  modified_base (397)..(397): a, c, t, g, unknown or other
  misc_feature (397)..(397): n is a, c, g, or t
  modified_base (406)..(406): a, c, t, g, unknown or other
  misc_feature (406)..(406): n is a, c, g, or t
tcagacgcgagtatcacgaccggtgctcgatttagtacgtcatcagggaaagggggaggaactgctcagttaggacccagagggaaccatggaagccccagctcagcttctcttcctcctgctactctggctcccagataccaccggagaaattgtgttgacacagtctccagccaccctgtctttgtctccgaggggaaanagcccaccctctcctgcagggccagtcagagtgttagcagctacttagcctggtaccagcaagaaacatggccaggcctccaggctcctcatctatgatgcatccaacncgggccacgtggacatccccagcctagggttccaggtggcaggtggtctgggacagtacttcactctcaccatcagcagctagacncctagagtntttgctagtttattactgtcagtcagtcgtagactacgtcgtaccctacgtttcggacgggtaacggaccgtaagggtaggtaacgtaccgaaacggtaaccgtggtacggtacctaggtaccctaacgtacgttaccgttcggttacctttctaccgttacccg

SEQ ID NO: 62246 - DNA, 721 bp, Homo sapiens
  misc_feature: GYAE6OF02H0FR0.23.60.F05.1.454.CMB.1.raw
  modified_base (201)..(201): a, c, t, g, unknown or other
  misc_feature (201)..(201): n is a, c, g, or t
  modified_base (268)..(268): a, c, t, g, unknown or other
  misc_feature (268)..(268): n is a, c, g, or t
tcagacgcgagtatcacgaccggtgctcgatttagtacgtcatcagggaaagggggaggaactgctcagttaggacccagagggaaccatggaagccccagctcagcttctcttcctcctgctactctggctcccagataccaccggagaaattgtgttgacacagtctccagccaccctgtctttgctacgaggggaaancgccaccctctcctgcagggccagtcagagtgtagcagctacttagcctggtaccagacaagaaacngtaggccaggcctacccgaggccttacctctatactaatcgatcgactaactacccgaaacgacgggtaccaacgtcggaccacgttaccccgaagtacccgtaggttccgaacggttcgggacgtacgggttggggtccgtaggggaactaggtaccttacgaccttccgtaccgaacctaagtccgtaacgaccaacgtaccgttaacggacgtccgtaaggtaaacgtttacgttttacggacctttaagttttaacgttacgtacgtaccgaagtacgagtacgtaacgaccgaacgtccgtacccgttacggtttaccggggaacgggtaacggaaccggtaagggtaaccggtaaacgtaacctaaaccgggtaaagtcgggtacggtaccgttaacggtaccaccgttacgtaactttccggttacctttacgtaccgtttacccg

SEQ ID NO: 62247 - DNA, 541 bp, Homo sapiens
  misc_feature: GYAE6OF02GMJC2.23.60.F05.1.454.CMB.1.raw
  modified_base (201)..(201): a, c, t, g, unknown or other
  misc_feature (201)..(201): n is a, c, g, or t
tcagacgcgagtatcacgaccggtgctcgatttagtacgtcatcagggaaagggggaggaactgctcagttaggacccagagggaaccatggaagccccagctcagcttctcttcctcctgctactctggctcccagataccaccggagaaattgtgttgacacagtctccagccaccctgtctttgtctccaggggaaanagccaccctctcctgcagggccagtcagagtgttagcagctacttagcctggtaccagcagaaacatggccaggcctccaggcctcctcatctatgatgcataccaacgagggccacgtggaccaactccccagcctaagggttccaggtggctagggtgggtactggggacaggtacttcacttcctcacctatacagcacgcctagacgctagtagtatttgctagtttattactgtcagcagcgtagcaacgtcgcctacgttcggacggacggacgaagggtagaatacgaaacgtactagtcgactacgacacgtagtcgtagtcttcattcccg

SEQ ID NO: 62248 - DNA, 621 bp, Homo sapiens
  misc_feature: GYAE6OF02H6EJK.23.60.F05.1.454.CMB.1.raw
tcagacgcgagtatcacgaccggtgctcgatttagtacgtcatcagggaaagggggaggaactgctcagttaggacccagagggaaccatggaagccccagctcagcttctcttcctcctgctactctggctcccagataccaccggagaaattgtgttgacacagtctccagccaccctgtctttgtctccgaggggaagagccaccctctcctgcagggccagtcagagtgttagcagctacttagcctggtaccagcagaaacagtggccgaggcctacccgaggtctcctcatctatgatgacacaccgaacgacggccacgtggccactaccccagccgtagggttcaggtcgggctacgggtgggtcgtagggaacacggtccttacactcctaccacctatccacgtcacgcctaagacgcgtagtaagtacttttgacttaagtttactttacgtagtactagctacggtcgtagaccgtaccgtaccggtacctaccggtttacgggaccgggtacggaaccgtaagggtaagaacgtacggaaacgtacgtacggtacggaccgttacgaccctacgtacttaccgtcgttaccttccgtacctttccccg

SEQ ID NO: 62249 - DNA, 624 bp, Homo sapiens
  misc_feature: GYAE6OF02IPPHX.23.60.F05.1.454.CMB.1.raw
  modified_base (203)..(203): a, c, t, g, unknown or other
  misc_feature (203)..(203): n is a, c, g, or t
  modified_base (232)..(232): a, c, t, g, unknown or other
  misc_feature (232)..(232): n is a, c, g, or t
  modified_base (294)..(294): a, c, t, g, unknown or other
  misc_feature (294)..(294): n is a, c, g, or t
  modified_base (393)..(393): a, c, t, g, unknown or other
  misc_feature (393)..(393): n is a, c, g, or t
tcagacgcgagtatcacgaccggtgctcgatttagtacgtcatcagggaaagggggagggaactgctcagttaggacccagagggaaccatggaagccccagctcagcttctcttcctcctgctactctggctcccagataccaccggagaaattgtgttgacacagtctccagccaccctgtctttgtctccgaggggaaanagccaccctctcctgcagggccagtcagngtgttagcagctacttagcctggtaccagcaagaaacatcggccaggcctccgaggctcctnactctatgatgacacgtaccaagcggccacgtggcactcccagcctaggttcacggtgacaggtggtcagggacagtacttcgaccttctaccaccgtntccgagacacgcctaggaccgtcctagtaaccgttcgtttcggtacggttttactaacgttgtaaccaaacgtaaccgtacctaacgttcggtacccttccgttacgtttaccgggacgtttacccgggaccgtaacgggtaaccgaaggtacgaaacgttacgaacgtacggtccggtggaccgtacgaccgactacgttacgtgttacccgttatacccgttctacccg

SEQ ID NO: 62250 - DNA, 623 bp, Homo sapiens
  misc_feature: GYAE6OF02I1VH5.23.60.F05.1.454.CMB.1.raw
  modified_base (202)..(202): a, c, t, g, unknown or other
  misc_feature (202)..(202): n is a, c, g, or t
  modified_base (291)..(291): a, c, t, g, unknown or other
  misc_feature (291)..(291): n is a, c, g, or t
tcagacgcgagtatcacgaccggtgctcgatttagtacgtcatcagggaaagggggaggaactgctcagttaggacccagagggaaccatggaagccccagctcagcttctcttcctcctgctactctggctcccagataccaccggagaaattgtgttgacacagtctccagccaccctgtctttgtctccgaggggaaanagcccaccctctcctgcagggccagtcagagtgttagcagctacttagcctggtaccagcaagaacatggccaggcctccaggcctccncatctatgatgcatccaacgcgggccagtcggcactcccagccaggttccaggtcggctagggtcgggtctggggaactaggtacttcgactccgtacacccgtatccgagctacgaccgtacggacgcccttaggaacgttagttttacgaccgttagttttaacttacgtcggttactacgtacgtaggtacgtacgtacgtaacgtcggtacccttacgtttccgggacgggtaacgggtaaccgtaagggtacggaagtaccgaaaacgtacgtacggtaggtacgtacgaccgacctagttaccgttcggtccttacgaccttcccg

SEQ ID NO: 62251 - DNA, 586 bp, Homo sapiens
  misc_feature: GYAE6OF02HMZ2P.23.60.F05.1.454.CMB.1.raw
  modified_base (270)..(270): a, c, t, g, unknown or other
  misc_feature (270)..(270): n is a, c, g, or t
  modified_base (316)..(316): a, c, t, g, unknown or other
  misc_feature (316)..(316): n is a, c, g, or t
  modified_base (387)..(387): a, c, t, g, unknown or other
  misc_feature (387)..(387): n is a, c, g, or t
tcagacgcgagtatcacgaccggtgctcgatttagtacgtcatcagggaaagggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcgacgggccagtcagagtgttagcagctacttagcctggtaccagcaagaaacngtcggccaggctccgaggctcctcatctatcgatcgcatccaacgngggccacgtggctatcccagccaggttcaggtcggcaggttcgggtctaggggactagtacttcaccttcnccactatcacgcacgcctagacgccgtagaagttagtttagacttaagtttacttactgtacagtcagtcgtagactaacgtcggaccctacgtttcgggccggacgggtaccgaagggtaggaaacgtacgaaacggtaacgttcggtacggtccgtacgacctaccgtacgtccgttcgtaccttgtaccgttcccg

SEQ ID NO: 62252 - DNA, 635 bp, Homo sapiens
  misc_feature: GYAE6OF02I1C0M.23.60.F05.1.454.CMB.1.raw
  modified_base (200)..(200): a, c, t, g, unknown or other
  misc_feature (200)..(200): n is a, c, g, or t
  modified_base (209)..(209): a, c, t, g, unknown or other
  misc_feature (209)..(209): n is a, c, g, or t
  modified_base (228)..(228): a, c, t, g, unknown or other
  misc_feature (228)..(228): n is a, c, g, or t
  modified_base (235)..(235): a, c, t, g, unknown or other
  misc_feature (235)..(235): n is a, c, g, or t
tcagacgcgagtatcacgaccggtgctcgatttagtacgtcatcagggaaagggggaggaactgctcagttaggacccagagggaaccatggaagccccagctcagcttctcttcctcctgctactctggctcccagataccaccggagaaattgtgttgacacagtctccagccaccctgtctttgctccaggggaaangccaccctntcctgcagggccagtcagngtgttancagctacttagcctggtaccagcagaaacatggccaggcctccgaggctcctcatctatgatgcatccaacacgggccagtcggcacgtccagccctaggttccagtggctaggtcgggtcgtggggacagtacttcgacctctaccaccatcagcacgctagacgcctagaagtacgttttgacgttagttttaactttagttcgttaccgtacgtactagggtacgttaacggacctaaccggtcgggtaccccttaacgtttccggggaaccgggtaaacgggtaacccgtaagggtacgggaaactaccgaaaccgggtaacgttacggttacggaccggtcgaacgttaacccgtacgttaccgttacggttacctttacctaccgtttaccccg

SEQ ID NO: 62253 - DNA, 698 bp, Homo sapiens
  misc_feature: GYAE6OF02JMN0Z.23.60.F05.1.454.CMB.1.raw
  modified_base (200)..(200): a, c, t, g, unknown or other
  misc_feature (200)..(200): n is a, c, g, or t
  modified_base (267)..(267): a, c, t, g, unknown or other
  misc_feature (267)..(267): n is a, c, g, or t
  modified_base (289)..(289): a, c, t, g, unknown or other
  misc_feature (289)..(289): n is a, c, g, or t
  modified_base (296)..(296): a, c, t, g, unknown or other
  misc_feature (296)..(296): n is a, c, g, or t
tcagacgcgagtatcacgaccggtgctcgatttagtacgtcatcagggaaagggggaggaacgtgctcagttaggacccagagggaaccatggaagccccagctcagcttctcttcctcctgctactctggctcccagataccaccggagaaattgtgttgacacagtctccagccacctgtcttgtctccaggggaaangccaccctctcctgccagggccagtcagagtgttagcagctacttagcctggtaccagcaagaaacngtggccaggcctccaggctccnactctangatgcacgtcccaacgacgggccacgtcggacctacgtaccccaggtacccgtaagggttccaacggttcggaccgtagggttcggggtaccgttcgggaactacggtaccttcgactccgtacgacctatcgacgcgtacgcctaaggctacgtaggaacttatttcgacgtttagtttaacttacgtcgtacagtccgtaaggtcgttacgaccgtaaccgttcggaacccgttaccggtttccggggaacgggtaaaccgggtaaccggtaaacggggttaacggtaaaccgtaaccggtaaaccggttacggttagggttaaccggtaccgttacggaacccgtaaccgttacggtttcccgttacggttacccttttacggtaacccctttacccgg

SEQ ID NO: 62254 - DNA, 574 bp, Homo sapiens
  misc_feature: GYAE6OF02JQNZH.23.60.F05.1.454.CMB.1.raw
  modified_base (197)..(197): a, c, t, g, unknown or other
  misc_feature (197)..(197): n is a, c, g, or t
  modified_base (526)..(526): a, c, t, g, unknown or other
  misc_feature (526)..(526): n is a, c, g, or t
  modified_base (530)..(530): a, c, t, g, unknown or other
  misc_feature (530)..(530): n is a, c, g, or t
  modified_base (535)..(536): a, c, t, g, unknown or other
  misc_feature (535)..(536): n is a, c, g, or t
  modified_base (538)..(538): a, c, t, g, unknown or other
  misc_feature (538)..(538): n is a, c, g, or t
  modified_base (540)..(543): a, c, t, g, unknown or other
  misc_feature (540)..(543): n is a, c, g, or t
  modified_base (545)..(546): a, c, t, g, unknown or other
  misc_feature (545)..(546): n is a, c, g, or t
  modified_base (548)..(565): a, c, t, g, unknown or other
  misc_feature (548)..(565): n is a, c, g, or t
  modified_base (567)..(574): a, c, t, g, unknown or other
  misc_feature (567)..(574): n is a, c, g, or t
tcagacgcgagtatcacgaccggtgctcgatttagtacgtcatcagggaaaggggctggagtgggtgggtttgattagaagtaaaagttatggtgggacaacaaaatacgccgcgtctgtggaaggcagattcaacatctcaaagaaatgattccacaagtgtcgcctatctgcaaatgaacagcctagaaaaccgnggacacaggcgtgtattactgtacgagcagtatttctcgttgggttcgggactccccatactttcgactacgtggggaccacgggaaccctggtccaccgtctcctcacgcctccaccgaacggcccagtccggtccctccccgtggccacccctccctccgaacgcgcctacccgtcggtacgggggccacgacggccgggtcccgtgggccctcggtcccgtggtaccgaaacgggtaccttaccgttaccacgttaacccgtccgtccgttcgtcggaacggtcccggggtcgtacgggacggaaccgggccggacctaggtacgnccgngtcgnngngnnnngnngnnnnnnnnnnnnnnnnnncnnnnnnnn

SEQ ID NO: 62255 - DNA, 668 bp, Homo sapiens
  misc_feature: GYAE6OF02IZGJQ.23.60.F05.1.454.CMB.1.raw
  modified_base (201)..(201): a, c, t, g, unknown or other
  misc_feature (201)..(201): n is a, c, g, or t
  modified_base (210)..(210): a, c, t, g, unknown or other
  misc_feature (210)..(210): n is a, c, g, or t
  modified_base (266)..(266): a, c, t, g, unknown or other
  misc_feature (266)..(266): n is a, c, g, or t
  modified_base (286)..(286): a, c, t, g, unknown or other
  misc_feature (286)..(286): n is a, c, g, or t
tcagacgcgagtatcacgaccggtgctcgatttagtacgtcatcagggaaagggggaggaactgctcagttaggacccagagggaaccatggaagccccagctcagcttctcttcctcctgctactctggctcccagataccaccggagaaattgtgttgacacagtctccagccaccctgtctttgtctccaggggaaangccaccctntcctgcagggccagtcagagtgttagcagctacttagcctggtaccagcagaaacntggccaggctccaggctccnatctatgatgctactccgaacgacgggcccacgtcggacctacgtccccgaggtcccgtaagggttccaggtcggactagggttcgggtctaggggactacggtacttcgaccttccgtacaacctagtccgacgtccgaacgtaccgtagacgtaccgtaggaaacgttacgttttacggacgttaaggttttaacgttacgttcggttaccgtaacgtccgtaacggtaccggttaacgaccgtaaccggtccggtacccgttacggtttccgggacgggtaacgggtaccgtaagggtacggtaacgtacgaaacggtacgtacggtacggtacgtacgacctacgtacttccgttacgttaccttacgtacttacccg

SEQ ID NO: 62256 - DNA, 571 bp, Homo sapiens
  misc_feature: GYAE6OF02I7XBA.23.60.F05.1.454.CMB.1.raw
  modified_base (202)..(202): a, c, t, g, unknown or other
  misc_feature (202)..(202): n is a, c, g, or t
  modified_base (416)..(416): a, c, t, g, unknown or other
  misc_feature (416)..(416): n is a, c, g, or t
tcagacgcgagtatcacgaccggtgctcgatttagtacgtcatcagggaaagggggaggaactgctcagttaggacccagagggaaccatggaagccccagctcagcttctcttcctcctgctactctggctcccagataccaccggagaaattgtgttgacacagtctccagccaccctgtctttgtctccaggggaaagngccaccctctcctgcaggccagtcagagtgttagcagctacttagcctggtaccagcagaaacatggccaggctcccaggcctcctcatctatgatgcatcccaacgacggccactggcaactcccagcctaggttccagtcggataggtggggtctgggacacgacttcactctacaccatcgagcagacctagacgcctagaagtgtttacncgttaagtttattactgttacagctaagtcgtagactaacgtcggtccctacgtttccgggacggtaacggaacgtaagggtacgaagtaccgaaacggtactaggtcggctacggaccgtaccgacttacgtggttaccttacgacttaccccg

SEQ ID NO: 62257 - DNA, 732 bp, Homo sapiens
  misc_feature: GYAE6OF02HDE7H.23.60.F05.1.454.CMB.1.raw
  modified_base (270)..(270): a, c, t, g, unknown or other
  misc_feature (270)..(270): n is a, c, g, or t
  modified_base (291)..(291): a, c, t, g, unknown or other
  misc_feature (291)..(291): n is a, c, g, or t
tcagacgcgagtatcacgaccggtgctcgatttagtacgtcatcagggaaagggggaggaactgctcagttaggacccagagggaaccatggaagccccagctcagcttctcttcctcctgctactctggctcccagataccaccggagaaattgtgttgacacagtctccagccaccctgtctttgtctccgaggggaaagagccaccctctcctgcagggccagtcagagtgttagcagctacttagcctaggtaccagcaagaaacntggccaggctcccaggctccnatctatgatgcactaccaacgcgggccctaacgtggaccaactccccgagtcccgtaggtttccaggtcggacctaagggttcgggtacgtggggaacctaggtaccttccgacctccgtaccaaccgtactaccgaagccctaacggaccccttaaggacgtacccgttaaggaaacgtttacgttttcgaaccgtttaaggtttttaactaaccggttcgtaccgaacggtaacctacgggtacgtaacggtaccgtaacccgtacgggtacccctttaacgggtttaccggggaccggggtaacggtaaaccgggtaaacggtaacgggtaaacctaaccggaaaaccgggttcggttagggtccggtaacgttccggaacccgtacccgttagttaccgttaccgggttacctttccggtaacctttaccccccggg

SEQ ID NO: 62258 - DNA, 716 bp, Homo sapiens
  misc_feature: GYAE6OF02JWM28.23.60.F05.1.454.CMB.1.raw
tcagacgcgagtatcacgaccggtgctcgatttagtacgtcatcagggaaagggggaggaactgctcagttaggacccagagggaaccatggaagccccagctcagcttctcttcctcctgctactctggctcccagataccaccggagaaattgtgttgacacagtctccagccaccctgtctttgtctccgaggggaaagagccaccctctcctgcacgggccagtcagagtgttagcagctacttagcctggtaccagacaagaaacatcggaccaggcctcccgaggcctcctcactctatgatcgaccataccaacgacggcctacgtcggacctaccgtcccgaacgccgtacggttcacggtcggacgtacgggttcgggtcgtacgggacacggtaccttacgtacccgttccgtaccctaaccctagtaccgtaaccgtccacggtacccgttaacggaccgtaccgttaaggtaacgttacgttttacggactttaggttttactttaacgtcgttaacgtacgtacgtaccgggtacttacgaccgttaccgtaccggtaccccgttacggttccgggacgggtacgggaaccgtagggttaaccgaacgtaaccgtaaaccggtaacggttacggttacggtaccgtaccggtaccgtaacgttacgtaccgttacggtttaccttaccgtaccgtttaccccg

SEQ ID NO: 62259 - DNA, 450 bp, Homo sapiens
  misc_feature: GYAE6OF02I38Q0.23.60.F05.1.454.CMB.1.raw
  modified_base (195)..(195): a, c, t, g, unknown or other
  misc_feature (195)..(195): n is a, c, g, or t
  modified_base (431)..(432): a, c, t, g, unknown or other
  misc_feature (431)..(432): n is a, c, g, or t
  modified_base (434)..(450): a, c, t, g, unknown or other
  misc_feature (434)..(450): n is a, c, g, or t
tcagacgcgagtatcacgaccggtgctcgatttagtacgtcatcagggaaaggggctggagtgggtgggtttgattagaagtaaaagttatggtgggacaacaaaatacgccgcgtctgtggaaggcagattcaacatctcaagaaatgattccacaagtgtcgcctatctgcaaatgaacagcctgaaaaccgnggacacaggcgtgtattactgtacgagcagattttctctggttcggggatcccccactactttgactacgtggggccagggaaccctggtcaccgtctcctcagcctccaccaagggcccatcggtcttccccctggcaccctcctccaagacgcacctctggggcacagcggccctggctgcctggtcaaggactactccatactcgcgtctgagcgggctggcaaggcgcatgnngnnnnnnnnnnnnnnnnn

SEQ ID NO: 62260 - DNA, 645 bp, Homo sapiens
  misc_feature: GYAE6OF02H0FUY.23.60.F05.1.454.CMB.1.raw
  modified_base (205)..(205): a, c, t, g, unknown or other
  misc_feature (205)..(205): n is a, c, g, or t
  modified_base (270)..(270): a, c, t, g, unknown or other
  misc_feature (270)..(270): n is a, c, g, or t
  modified_base (294)..(294): a, c, t, g, unknown or other
  misc_feature (294)..(294): n is a, c, g, or t
tcagacgcgagtatcacgaccggtgctcgatttagtacgtcatcagggaaagggggaggaactgctcagttaggacccagagggaaccatggaagccccagctcagcttctcttcctcctgctactctggctcccagataccaccggagaaattgtgttgacacagtcctccagcccaccctgtctttgtctaccgaggggaaancgccaccctctcctgcagggccagtcagagtgttagcagctattagcctggtaccagcagaaacngtcggccaggcctccaggctcctnatctatgatgctataccgaacgacggccaacgtcgacactcccagccgtacggttccaggtacggcgtagggtgggtcgtaggggaacctaggtacctttacccgacttcccgtaccgaacctcgtacacgtcaccgtcgagtacgactagaacgttactttgacgtttatttacttcgttagtacagtacgagtacgtacgacgtaacgccgttacccgtacgtttacgggacgggtaaccgggacgtaacgggtaagtaaccgtaagtaaaccggtaacgttaggtaccggtacgtaccgactacccgtacgttccgttagtttacccgttcttaccgtttacccccgg

SEQ ID NO: 62261 - DNA, 696 bp, Homo sapiens
  misc_feature: GYAE6OF02ITA46.23.60.F05.1.454.CMB.1.raw
  modified_base (200)..(200): a, c, t, g, unknown or other
  misc_feature (200)..(200): n is a, c, g, or t
  modified_base (227)..(227): a, c, t, g, unknown or other
  misc_feature (227)..(227): n is a, c, g, or t
  modified_base (262)..(262): a, c, t, g, unknown or other
  misc_feature (262)..(262): n is a, c, g, or t
  modified_base (287)..(287): a, c, t, g, unknown or other
  misc_feature (287)..(287): n is a, c, g, or t
  modified_base (416)..(416): a, c, t, g, unknown or other
  misc_feature (416)..(416): n is a, c, g, or t
  modified_base (478)..(478): a, c, t, g, unknown or other
  misc_feature (478)..(478): n is a, c, g, or t
tcagacgcgagtatcacgaccggtgctcgatttagtacgtcatcagggaaagggggaggaactgctcagttaggacccagagggaaccatggaagccccagctcagcttctcttcctcctgctactctggctcccagataccaccggagaaattgtgttgacacagtctccagcccacctgtctttgtctccgagggaangccacctctcctgcagggccagtcagngtgtagcagctactagctaggtaccagcagaaacngtggaccaggcctccgaggcctccncatcgtatggatcgacactccgaagcgggccactcgggactacgtcccgagcccgtaggtccaggtcgacgagggtcgggttacgtacggggactcggtaccctttacgaaccttccgtaccaaccgtntaccgacggaccacggtacccgtaagggtccgtaccggttagaaacgtttcgtttaccggtntttaacggttttactttaaccgttggttaaccgtacgtacgaccggttcggttaacgtaccggtacgttcccgggacccttacggttccggggaaccgggtaacggaaccgggtaaggtaaccggtaacgtaacccggtaacgttaaaccggttcggaacgggtctacggtacccaacgtacgttccgttaccggttcttaccgtaccgtttaccccg

SEQ ID NO: 62262 - DNA, 662 bp, Homo sapiens
  misc_feature: GYAE6OF02GNXTS.23.60.F05.1.454.CMB.1.raw
  modified_base (201)..(201): a, c, t, g, unknown or other
  misc_feature (201)..(201): n is a, c, g, or t
tcagacgcgagtatcacgaccggtgctcgatttagtacgtcatcagggaaagggggaggaactgctcagttaggacccagagggaaccatggaagccccagctcagcttctcttcctcctgctactctggctcccagataccaccggagaaattgtgttgacacagtctccagccaccctgtctttgctccgaggggaaangccaccctctcctgcagggccagtcagagtgttagcagctacttagcctggtaccagcaagaaacatggccaggcctcccgaggcctcctcatctatgatgcatccaacgacggccacgtggacctactcccagcccgtaggttcaggtggctagggttcgggtcgtagggaacacggtacctttcaccgttcctacaaccctataccgacgaccacggtaccgtaacggacgtaccgtaggtaaacgttacttttacggaccttaaggttttaacgttaccgttaggtaccgtaaggtcctaacggtacgttaacgaacctaaccgtaccggtacccgttacgtttccgggacgggtaaacgggaacccgtaagggtacggtaaacgtaaccgaaacggtaacgtaggtacggcgtacgtaccaccgtacgttccgttacgttaccttcgtaccttcccg

SEQ ID NO: 62263 - DNA, 606 bp, Homo sapiens
  misc_feature: GYAE6OF02F93X2.23.60.F05.1.454.CMB.1.raw
  modified_base (202)..(202): a, c, t, g, unknown or other
  misc_feature (202)..(202): n is a, c, g, or t
  modified_base (433)..(433): a, c, t, g, unknown or other
  misc_feature (433)..(433): n is a, c, g, or t
tcagacgcgagtatcacgaccggtgctcgatttagtacgtcatcagggaaagggggaggaactgctcagttaggacccagagggaaccatggaagccccagctcagcttctcttcctcctgctactctggctcccagactaccaccggagaaattgtgttgacacagtctccagccaccctgtctttgctccgaggggaaangcccaccctctcctgcagggccagtcagatgttagcagctacttagctggtaccagcagaacatggccaggctcccgaggctcctcatctatcgatgcactccaacgacgggtccacgtcgacactcccagcctaggttcaggtcggactaggttcggggtctagggacaggtaccttccgaacgttcctacacctatcgagcacgtcgtacgacgtacctagtaacgttntttgacctttaagtttacttacgttcgtacacgtctaggtacgtacgacgtaccgtcgtacccgtaacgtttccgggacggtacggaacgtaaggggtagtaacgtacgaaacggtacgtgtacggtaccgtgaccctacgtcttaccgtacggttcttacgtacttaccccg

SEQ ID NO: 62264 - DNA, 635 bp, Homo sapiens
  misc_feature: GYAE6OF02GR196.23.60.F05.1.454.CMB.1.raw
tcagacgcgagtatcacgaccggtgctcgatttagtacgtcatcagggaaagggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcgagggccagtcagagtgtagcagctacttagcctggtaccagcaagaaacatggccaggcctcccgaggcctcctcatcctatgatgacactacccaacgacgggccacgtggactactcccagtcctaggttcaggtggacgtagggtgggtcgtagggacagtacttcactctaccacctatcgacgacgacgtaccgtagacgtacgtagtaacgttagtttacgacgtttagttttaacgttacgtgttccacgtcgtacgtacggtacgacctacggtccgtacccgttacggtttccgggacgggtaacgggaacgtaagggttaaggaacgtaaccgtaaaccggtaacggttacggtacggtaccgtacgaccaacgttcgttaccgttcgttccttccgtacttccccg

SEQ ID NO: 62265 - DNA, 705 bp, Homo sapiens
  misc_feature: GYAE6OF02F1KL1.23.60.F05.1.454.CMB.1.raw
  modified_base (202)..(202): a, c, t, g, unknown or other
  misc_feature (202)..(202): n is a, c, g, or t
  modified_base (231)..(231): a, c, t, g, unknown or other
  misc_feature (231)..(231): n is a, c, g, or t
  modified_base (259)..(259): a, c, t, g, unknown or other
  misc_feature (259)..(259): n is a, c, g, or t
  modified_base (269)..(269): a, c, t, g, unknown or other
  misc_feature (269)..(269): n is a, c, g, or t
  modified_base (290)..(291): a, c, t, g, unknown or other
  misc_feature (290)..(291): n is a, c, g, or t
  modified_base (296)..(296): a, c, t, g, unknown or other
  misc_feature (296)..(296): n is a, c, g, or t
tcagacgcgagtatcacgaccggtgctcgatttagtacgtcatcagggaaagggggaggaactgctcagttaggacccagagggaaccatggaagccccagctcagcttctcttcctcctgctactctggctcccagataccaccggagaaattgtgttgacacagtctccagccaccctgtctttgtctccgaggggaaangcccaccctctcctgcagggccagtcagngtgttagcagctacttagcctggtaccngcaagaaacntggccaggcctccgagctccnntctangatgcactaccaagcggccagtgcacgtcccagccgtaggttcaggtcggcgtaggtcgggtcgtagggactagtaccttcgacttccgtacaacccgtatacgacgaccgacgtaccgtaacggtacgtaccgttaaggtaacgtttacttttacggaccttttaagttttaacgttacttacggttacgtaacgtacgtacggtaccgttaacgaccgtaaccgttaccggtaccccgtttaccgggttcggggaaccggtaaccggggtaaccgtaaagggggttaaccgtaaacgtaaccgtaaaaccgggttacggttacgggtaccggtacccgtaacgtaccgtaaccggtttacgttaccggtttacggtttaccctttaccggttaccctttacccccgg

SEQ ID NO: 62266 - DNA, 700 bp, Homo sapiens
  misc_feature: GYAE6OF02G5PLE.23.60.F05.1.454.CMB.1.raw
tcagacgcgagtatcacgaccggtgctcgatttagtacgtcatcagggaaagggggaggaactgctcagttaggacccagagggaaccatggaagccccagctcagcttctcttcctcctgctactctggcctcccagataccaccggagaaattgtgttgacacagtcctccagcccaccctgttcttttgtctccgaagggggaaagcgcccacccttctccctgcgacgggccagtcagagtgttagcagctacttagcctaggtaccagcaagaaacagtcggaccctaaggcctacccgaggtccctcctacattctatgatcgctactacccgaacgtcgggaccctacgtcgggacctaccgtaccccgaggacccgtagggtttaccaggtcgggctaaggggttcgggtcgtagggactaggttaccttcaaccgttcctaccgacctagtcgacgaccgtacgtaccgtaaggaccgtccgtaggtaaacgttagtttacgtacttaggttttaacttacgttgtaccgtacgtacgtacgtacgtacgtaccgtacgtaccgtacccgttacggttcgggaccgggtacgggtaacgtaagggtaacgtaacgtacgtaaacggacggttacgtacggtaccgtacgacgtaccgtattccgttacgttacttaccgtcgttaccccgg

SEQ ID NO: 62267 - DNA, 598 bp, Homo sapiens
  misc_feature: GYAE6OF02HFOZT.23.60.F05.1.454.CMB.1.raw
  modified_base (169)..(169): a, c, t, g, unknown or other
  misc_feature (169)..(169): n is a, c, g, or t
  modified_base (236)..(236): a, c, t, g, unknown or other
  misc_feature (236)..(236): n is a, c, g, or t
  modified_base (243)..(243): a, c, t, g, unknown or other
  misc_feature (243)..(243): n is a, c, g, or t
  modified_base (266)..(266): a, c, t, g, unknown or other
  misc_feature (266)..(266): n is a, c, g, or t
  modified_base (274)..(274): a, c, t, g, unknown or other
  misc_feature (274)..(274): n is a, c, g, or t
  modified_base (278)..(278): a, c, t, g, unknown or other
  misc_feature (278)..(278): n is a, c, g, or t
  modified_base (284)..(284): a, c, t, g, unknown or other
  misc_feature (284)..(284): n is a, c, g, or t
  modified_base (319)..(319): a, c, t, g, unknown or other
  misc_feature (319)..(319): n is a, c, g, or t
tcagacgcgagtatcacgaccggtgctcgatttagtacgtcatcagggaaagggggagggaactgctcagttaggacccagagggaaccatggaagccccagctcagctctcttcctctgctactctggctcccagataccaccggagaattgtgttagacacagtccnccagccctaccctgtctttcgtctaccgaggggaagacgccaccctctccagcgaggcctagtcagngtgtagnagctactcgctgacagcagaacntgcagtcnccgngctccncatctatgaatcgacatacccgagaacggccacgngtaccacgcctagccgtagtcgacgtggactagggtggttacgacgggactaaggtcctttcaaccgtcctaccaacgtactacgacgacgtacgtacctacgagtcctaaggaggttactttcgaagttacgttaacgtttctacgtacaagtcgaattcggaacacgtaccgtgaccctacgggttacggacggaaggaacccgtaggtagaaccgttacgaacgtaaccggtgtacgcgtacgacaccgtatcccgttacgtttcgtctatcccgg

SEQ ID NO: 62268 - DNA, 801 bp, Homo sapiens
  misc_feature: GYAE6OF02FL373.23.60.F05.1.454.CMB.1.raw
  modified_base (203)..(203): a, c, t, g, unknown or other
  misc_feature (203)..(203): n is a, c, g, or t
  modified_base (231)..(231): a, c, t, g, unknown or other
  misc_feature (231)..(231): n is a, c, g, or t
  modified_base (266)..(266): a, c, t, g, unknown or other
  misc_feature (266)..(266): n is a, c, g, or t
  modified_base (268)..(268): a, c, t, g, unknown or other
  misc_feature (268)..(268): n is a, c, g, or t
tcagacgcgagtatcacgaccggtgctcgatttagtacgtcatcagggaaagggggaggaactgctcagttaggacccagagggaaccatggaagccccagctcagcttctcttcctcctgctactctggctcccagataccaccggagaaattgtgttgacacagtctccagccaccctgtctttgtctccgaggggaaagngccaccctctcctgcagggccagtcagngtgttagcagctacttagctggtacagcagaaacngnggccaggcctccgaggctcccgtctactctagtgagtcgacaactcccgaaacgtacggggacccctacgtacgggcctaaccgtcccccgaaggtaccccgtacgggtttaccgacgggtgggtaccgtaagggttcggggtaccggtacgggggtaacgtaacggtaccgttttcaacccgttccgtacccgtaaacccgtacgttacgaccgtacgtaaccggtaccgtaaacggtaccggtacccgttaagggtaaacggtttactttttacgggacgttttaacggttttaactttacgttacggtacccgtaacgtaccgtaacgggaccgttaaccggaacgttaacccggtaccggtaccccgttacgggtttaccggggtaaccgggtaacggggtaaacccggtaaggggttaacggtaaccgtaaccggtaaacggtaacggtacgggttaacggtccgttaacggaccgttaacctacggttacccgttcggttacccgttaccgttaccgttacccccgg

SEQ ID NO: 62269 - DNA, 695 bp, Homo sapiens
  misc_feature: GYAE6OF02HAPGU.23.60.F05.1.454.CMB.1.raw
  modified_base (200)..(200): a, c, t, g, unknown or other
  misc_feature (200)..(200): n is a, c, g, or t
  modified_base (270)..(270): a, c, t, g, unknown or other
  misc_feature (270)..(270): n is a, c, g, or t
tcagacgcgagtatcacgaccggtgctcgatttagtacgtcatcagggaaagggggaggaactgctcagttaggacccagagggaaccatggaagccccagctcagcttctcttcctcctgctactctggctcccagataccaccggagaaattgtgttgacacagtctccagccacctgtctttgctccgaggggaaangcccaccctctcctgcgagggccagtcagagttgttagcagctacttagcctaggtaccagcaagaaacngtacggccaggcctcccgaggtcctcctcatcctagtgacttgcactccgaacgacggccacgtggacctactacccgagacccgtaagggttcaacggttcggactgggtcgggttcgagggaccgtaagtacctttacgacccttccgtaccaaccctataccgtaacgcctacggtacctaacggtaccgtccgtaggtaaacgtttagttttacgtaccgtttaacgttttaagtttaccgtagttcgacgtcgtacggtacgtaacgtaccgtaacgttccgtacccggttacgttaccgggacgggtaaccggtaccggtaagggtacgtaacgtaaccgtaaacggtaacggtaggttacggaccgtaccgtacgtaaccgtcgttaccgttacgtttccttacgtacccgttccccg

SEQ ID NO: 62270 - DNA, 737 bp, Homo sapiens
  misc_feature: GYAE6OF02HQND1.23.60.F05.1.454.CMB.1.raw
  modified_base (235)..(235): a, c, t, g, unknown or other
  misc_feature (235)..(235): n is a, c, g, or t
tcagacgcgagtatcacgaccggtgctcgatttagtacgtcatcagggaaagggggaggaactgctcagttaggacccagagggaaccatggaagccccagctcagcttctcttcctcctgcctactctggctcccagataccaccggagaaattgtgttgacacagtcctccagccaccctgtctttgtctccgaggggaaagacgccaccctctcctgcgagggccagtcagngtgttagcagtctattacgcgtcggtaccagcaacgaaatagtggtacacggcctacccgaggtctcccgtctactccgtatacgaatcgtacctaagtcccgaaacgaccgggtaccaacggtcggacctacgttacccgacgaccgtacggtttacagggtccggtacggaggggttcgggtcggtacggggaaccgttacgtaaccgtttcgtaaaccttccttaacccgaaccgtaacgtacccgtaggaaccacgtaaccggtaacggtaccggtacggttacggaaacggtttacgtttacggtacgttaaaggttttacttacgttcggtactacgcgtacgtacggtaacggacgtaaccgtacggtacccgttaccgggtttccggaacgggtaaccggaaccgggtaggttaacgaacgttacggtaaacgtacggtaggtgtaccgtacgtacctacgtagttccgttcggttacctcgttccgttacccg

SEQ ID NO: 62271 - DNA, 715 bp, Homo sapiens
  misc_feature: GYAE6OF02FYWE4.23.60.F05.1.454.CMB.1.raw
  modified_base (274)..(274): a, c, t, g, unknown or other
  misc_feature (274)..(274): n is a, c, g, or t
tcagacgcgagtatcacgaccggtgctcgatttagtacgtcatcagggaaagggggaggaactgctcagttaggacccagagggaaccatggaagccccagctcagcttctcttcctcctgctactctggctcccagataccaccggagaaattgtgttgacacagtctccagcccaccctgtctttgtctccgaggggaaagcgccaccctctcctgccgagggccagtcagagtgttagcagcttacttagcctaggtaccagcaagaaacngtggccaggcctcccgaggctcctcatcgtatgatcgctactaccgaacgacgggaccacgtggaccactacccgagtcccgagggtttccaggttggaccgtaggggttcgggtacgtaggggactaaggtaccctttcgaacctttccgtacccgaccctaacgtccgtaacgaccaccgtaccgtaacggaccgtaccgtaaggtaaacgttacgtttaccgacggtttaagttttaacgttaccgttcgtaccgtaacggtactacgggtacgtaacgtacgtaaacccggttcgtacccccggttacggtttaccggggacggaaccgggtaacccgtaaggggttaacggaacgtaaccggaaacggtaacgttcgggtacgtacgttaccgacctaccgttacttccgttcgttacccttacgtaccttcccgg

SEQ ID NO: 62272 - DNA, 664 bp, Homo sapiens
  misc_feature: GYAE6OF02IIKGK.23.60.F05.1.454.CMB.1.raw
tcagacgcgagtatcacgaccggtgctcgatttagtacgtcatcagggaaagggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcgagggccagtcagagtgttagcagctacttagcctggtaaccagacagaaacagtggaccaggcctcccgaggcctcctcatctatggactcgcactaccaacgtagggacccacgtcggacactccgagtccgtaaggtccaggttggcgtagggtcgggtctaggggacaggtaccttcgacctcgtacaaccgtatacgacgcctagaccgtagtaaccgtccgtaagtaacgttcgttttagcgttaacgttttattaccgtcgttagacgttccgaagtaccggttacaccgtaaccgtccggtaccccttagtttaccggggaccggacggtaaccggtaagggttaacggtaaactaccggtaaaacggtacgtacggtacggtaaccgttcgaaccgtcctacggttacgtaccggtttcttaccgtcgtttacccccg

SEQ ID NO: 62273 - DNA, 732 bp, Homo sapiens
  misc_feature: GYAE6OF02JKNA6.23.60.F05.1.454.CMB.1.raw
  modified_base (201)..(201): a, c, t, g, unknown or other
  misc_feature (201)..(201): n is a, c, g, or t
  modified_base (229)..(229): a, c, t, g, unknown or other
  misc_feature (229)..(229): n is a, c, g, or t
  modified_base (266)..(266): a, c, t, g, unknown or other
  misc_feature (266)..(266): n is a, c, g, or t
tcagacgcgagtatcacgaccggtgctcgatttagtacgtcatcagggaaagggggaggaactgctcagttaggacccagagggaaccatggaagccccagctcagcttctcttcctcctgctactctggctcccagataccaccggagaaattgtgttgacacagtctccagccaccctgtctttgctccgaggggaaangccaccctctcctgcagggccagtcagngtgttagcagctacttagcctggtaccagcagaaacngtcggccaggtcctcccgaggcctacctcatctatggatcgcactccaaacgcgggccacgtcggccacgtccccagacccgtaggttccaacggtggaccgtagggttcgggtacgtacggggacctagtaccctttacgaccttacctaccgtaacccaagttccgtaacggaccgtaacggtacccgtaacggtacggtacccgttacggtaaacggttacgtttttacggaacgttacgttttaaccgtttacgttacgtacgtacgtacgtaacggtaccggttacgaccgtaaccgttcggtccccgttaaccggttttccggggaccggggtacgggtaaaccggtaacgggtaacggtaacgtaaccggtaaaccggtaacggttacgggtacggtccggtacgaacccgtaccgtacggttaccgttacggttaccttaccgttaccgttaccccgg

SEQ ID NO: 62274 - DNA, 768 bp, Homo sapiens
  misc_feature: GYAE6OF02GKQF4.23.60.F05.1.454.CMB.1.raw
  modified_base (200)..(200): a, c, t, g, unknown or other
  misc_feature (200)..(200): n is a, c, g, or t
  modified_base (258)..(258): a, c, t, g, unknown or other
  misc_feature (258)..(258): n is a, c, g, or t
  modified_base (295)..(295): a, c, t, g, unknown or other
  misc_feature (295)..(295): n is a, c, g, or t
  modified_base (442)..(442): a, c, t, g, unknown or other
  misc_feature (442)..(442): n is a, c, g, or t
tcagacgcgagtatcacgaccggtgctcgatttagtacgtcatcagggaaagggggaggaactgctcagttaggacccagagggaaccatggaagccccagctcagcttctcttcctcctgctactctggctcccagataccaccggagaaattgtgttgacacagtctccagccaccctgtctttgctccgagggaagngccaccctctcctgcgaggccagtcagagtgttagcagtctacttagcctaggtaccngacaagaaacagtcggaccaggcctaccgaggctccncatctatgattgacctagtacccgtaacgacgggacccacgtacggacctaacgttcccgagacccgtaggtccgaaggttcggacgtacgggtcgggtacgtagggaactacgtacttaccgaccgtactaccgacctagtacganccgacgtacctaaggtaccgtcgtaaaggtaagtttacgtttacgacgttttaacggtttttaacgtaccgttaggtaccgtaaggtaccgttaacgggttaaccggtaacgtacccgttaaacggtttcccgggtaaccccgtttaccggggttaccggggggaaccgggttaaacgggtaaaccggttaaacggggtaaccggttaaacctaaacccgggtaaacggtaaacgtttcggggtaacccgttaacggtaccgtaacccgttaacgtacggtttacccgttagtttaacccggtttaccctcggtttaaccccccgg

SEQ ID NO: 62275 - DNA, 732 bp, Homo sapiens
  misc_feature: GYAE6OF02JVVE8.23.60.F05.1.454.CMB.1.raw
  modified_base (111)..(111): a, c, t, g, unknown or other
  misc_feature (111)..(111): n is a, c, g, or t
  modified_base (206)..(206): a, c, t, g, unknown or other
  misc_feature (206)..(206): n is a, c, g, or t
  modified_base (266)..(266): a, c, t, g, unknown or other
  misc_feature (266)..(266): n is a, c, g, or t
tcagacgcgagtatcacgaccggtgctcgatttagtacgtcatcagggaaagggggaggaactgctcagttaggacccagagggaaccatggaagccccagctcagcttcncttcctcctgtctactctggcctcccaggataccaccggagaaattgtgttgacacagtctccagccaccctgttcttcgtctccgaggggaaanagccaccctctcctgcagggccagtcagtagtgttacgctagctacttagcctggtaccngacagaaactgtcggccaggtcctccgaggcctaccgtcagtacctagtcgtatccggataccgtaccaaaacggcggtacctaccgtacggtaccaaaccgttccccgaacggtccctaaagggttccaaggtcgggacgtaagggtaccgggtactacgggacctaacggttcctcgtaaacgcccttacacctaacggtaccgaacggacgaccgtactaacgggtacgtaccttacggtaaacgttacgttttagggtaacgttacgttttaacgtttaacgttagtaccgtaacggtcgaacggttcggtaagtaacccgtaaccgttaccgggtaccttaacccggttacggggaaccgggttaacggaacccgtaagttaaccgggaactaacggtaaccttacggtacggtacgacgttacgacccgtactacttcgtacgttcgtacctgttacccg

SEQ ID NO: 62276 - DNA, 651 bp, Homo sapiens
  misc_feature: GYAE6OF02FM2ZN.23.60.F05.1.454.CMB.1.raw
  modified_base (204)..(204): a, c, t, g, unknown or other
  misc_feature (204)..(204): n is a, c, g, or t
  modified_base (226)..(226): a, c, t, g, unknown or other
  misc_feature (226)..(226): n is a, c, g, or t
  modified_base (232)..(232): a, c, t, g, unknown or other
  misc_feature (232)..(232): n is a, c, g, or t
  modified_base (271)..(271): a, c, t, g, unknown or other
  misc_feature (271)..(271): n is a, c, g, or t
  modified_base (295)..(295): a, c, t, g, unknown or other
  misc_feature (295)..(295): n is a, c, g, or t
tcagacgcgagtatcacgaccggtgctcgatttagtacgtcatcagggaaagggggaggaactgctcagttaggacccagagggaaccatggaagccccagctcagcttctcttcctcctgctactctggctcccagataccaccggagaaattgtgttgacacagtctccagccaccctgtctttgtctccgaagggggaaangcccaccctctcctgcaggccngtcagngtgttagcagtctacttagcctggtaccagcaagaaacntggccaggcctcccgaggcctctnatctatcgatgcactccgaaacgcggcctagcggcactcccagccgaggttcaggtgacagggtcggttcggagggtactagtaccttccgacttcctacaacctatccagtaccgacgtaccgtacggacgtccctagggtaagtttatttcgacgttttacggtttaacttacgttcgtaacgtatcggaacgttacgtacgaccgtaccgttccgggaccctttacggttacgggtaaccggaacgggtaaacgtaacggggtaacgttaaaccgaacgtaaaccggacgttaggtacggtccgtactacccgtactacgttcctaccggtttattacccctcgtttaccccg

SEQ ID NO: 62277 - DNA, 697 bp, Homo sapiens
  misc_feature: GYAE6OF02II1ME.23.60.F05.1.454.CMB.1.raw
  modified_base (276)..(276): a, c, t, g, unknown or other
  misc_feature (276)..(276): n is a, c, g, or t
  modified_base (364)..(364): a, c, t, g, unknown or other
  misc_feature (364)..(364): n is a, c, g, or t
tcagacgcgagtatcacgaccggtgctcgatttagtacgtcatcaggggaaagggggaggaactgctcagttaggacccagagggaaccatggaacgccccagctcagcttctcttcctcctgctactctggctcccagataccgaccggagaaaattgtgttggacacagtcctccagcccacctgttctttgtctccgagggaaagcgccaccctctcctgcagggccagtcagtacgtgttagcagctactagcctgtaccaagcaagaaacntacggacctaggcctacccgaggcctcctcatcgtaatcgaattcggacctataccaaacgtcgggcctaacgtggaactacgacccngacccgtaggttccaggtacgacggtaggtgggtaccgtgggaccaaggttctaccgtaacgtactaccaactacgttaccgacgtccgtacgtacccgtaaggaacgttccgtaaggtaaacgttacgttttcggtaaccttaacggttttaacttaaccgttggtaccgttagaccgtaacggtcgtaaacgtacgtaaacccgtccggtaacccttacgttaccggggtacggaaacgggtaacccgtaagggttaacgaactacggaaacggtcgtacgtaggtacgtacgtaccacgtaccttcggtatttaccgtctaccttcccgg

SEQ ID NO: 62278 - DNA, 745 bp, Homo sapiens
  misc_feature: GYAE6OF02G0F4Q.23.60.F05.1.454.CMB.1.raw
  modified_base (208)..(208): a, c, t, g, unknown or other
  misc_feature (208)..(208): n is a, c, g, or t
  modified_base (218)..(218): a, c, t, g, unknown or other
  misc_feature (218)..(218): n is a, c, g, or t
tcagacgcgagtatcacgaccggtgctcgatttagtacgtcatcagggaaagggggaggaactgctcagttaggacccagagggaaccatggaagccccagctcagcttctcttcctcctgctactctggctcccagataccaccggagtaaattcggtagttgacacagtctccgagcccaccttgtctttgtactccgagggaaancgccaccctntccgtgcgtacgggccagtcgagtgtagttacgctagacttactacggtccgttacggtaccagtacgaagaaactggtcggaccgtaacggtcccttaccgacggtaccctccgtacgtaacttacgtatacggtagtaccgtaccgtaactacccggtaaacggtccggaccgtaaacggtcggtaaccctacgggtacccctaacggtacgttaccggttacgtaagggttaccggacggttaccgggttacgggggttacctcggggtaaaacccttagggtaacccttaccgtaacccgtcttaaacccaccgttaagtaccgtacgacgtacgtacgtacgtacgtacgtacgtagttacgttagtacgttacgttacttacggggggtcttacgtacgtacgtacgtaccgtacgtacgtacgtcgtacgtacgtcgtacggacggtacgtagtacgacgtacgtaacgtacgtagtacgtcgtacgtacgtacgtcgtacgttctcgtactacgtaccg

SEQ ID NO: 62279 - DNA, 770 bp, Homo sapiens
  misc_feature: GYAE6OF02G4B4L.23.60.F05.1.454.CMB.1.raw
  modified_base (111)..(111): a, c, t, g, unknown or other
  misc_feature (111)..(111): n is a, c, g, or t
  modified_base (207)..(207): a, c, t, g, unknown or other
  misc_feature (207)..(207): n is a, c, g, or t
  modified_base (215)..(215): a, c, t, g, unknown or other
  misc_feature (215)..(215): n is a, c, g, or t
  modified_base (219)..(219): a, c, t, g, unknown or other
  misc_feature (219)..(219): n is a, c, g, or t
  modified_base (265)..(265): a, c, t, g, unknown or other
  misc_feature (265)..(265): n is a, c, g, or t
  modified_base (277)..(277): a, c, t, g, unknown or other
  misc_feature (277)..(277): n is a, c, g, or t
  modified_base (462)..(462): a, c, t, g, unknown or other
  misc_feature (462)..(462): n is a, c, g, or t
tcagacgcgagtatcacgaccggtgctcgatttagtacgtcatcagggaaagggggaggaactgctcagttaggacccagagggaaccatggaagccccagctcagcttcncttcctcctgctactctggctcccagataccaccggagaaaacttgtgttaggacacgagtcctccgagcccacctgtctttagctccgagggaangccacctntccngcagggccagtcagatcgttagcagtcttacgtagcctggtaaccngaccaggaactntcggaccagcctccgaaggcctccgtacactccgtatgactacgcctagtacccgtaaggaccgggtacctagggtaccggaccctacgtaccccgagggtaccgttaaggtccggaaggtccgggtacgtaggggtccgggttacggtagggaccctagggtaccctttaaccgcgtttaaccnccggtaaccgtactaccggtaaccgtcggtaaccccggttacgtaaccgggaccgttacgtaaccggggttaatttaccggtttaccgtacgtttaacgtttaactacccgttaggacgttacccggtagtaccgggtaacgttaaccggtaccgtaacggttcccggtacccggttaccggttacgggaaccgggtaacggtacgggtaacgtacgtacggtaacccgtacggtaacttacgggacgttacgggtaccaacggtccgtttaacggtccgttaacggtttctaccgtccttaaccccg

SEQ ID NO: 62280 - DNA, 723 bp, Homo sapiens
  misc_feature: GYAE6OF02F5HCK.23.60.F05.1.454.CMB.1.raw
  modified_base (202)..(202): a, c, t, g, unknown or other
  misc_feature (202)..(202): n is a, c, g, or t
tcagacgcgagtatcacgaccggtgctcgatttagtacgtcatcagggaaagggggaggaactgctcagttaggacccagagggaaccatggaagccccagctcagcttctcttcctcctgctactctggctcccagataccaccggagaaattgtgttgacacagtctccagccaccctgtctttgtctccgaggggaaangccacccgtctcctgcagggccagtcagagtgtagcagctacttagcctggtaccagcaagaaacatggaccaggcctcccgaggtctcctacatctatgatcgcactaccgaaacgacggggtccacgtcgggacctaacgtccccaggtaccctaaggttccaaggttcggaccgtaagggttcgggggtcttagggggaactaacggtacctttaccgaaccgtttcctacccgaaccctagtaccgaacggaccacgtacccgtaagaccgtaccgtaacggtaagttaacgttttacggactttaacggttttaacttacgttacggtaccgtacgtacgaacggtaccgtaacgaccttaaacgtccgtacccgttacgtttaccgggacgggaaccgggtaaccgtaaagggtacggtaaacgtaaccgtaaaacggtacgttaacggtcgggtaaccgtacgtaacccgtaccgtacgttaccgttacgtaccgtttactacccgttaccccg

SEQ ID NO: 62281 - DNA, 644 bp, Homo sapiens
  misc_feature: GYAE6OF02GFW3G.23.60.F05.1.454.CMB.1.raw
  modified_base (277)..(277): a, c, t, g, unknown or other
  misc_feature (277)..(277): n is a, c, g, or t
tcagacgcgagtatcacgaccggtgctcgatttagtacgtcatcagggaaagggggaggaactgctcagttaggacccagagggaaccatggaagccccagctcagcttctcttcctcctgctactctggctcccagataccaccggagaaattgtgttgacacagtctccagccaccctgttctttgtctccgaaggggaaagacgccaccctctcctgcgagggccagtcagagtgttacgcagcttacttacgccgtggtaccagcaagaaacngtcggaccgaggcctccgaggtcctccgtcacttctagtcgatcgcactaccgaacggacggccacgtcggcctacgtccccgagaccgtaggttccgaaggttcggacgtaacgggttggggtacgtggggaactaacggtacctttccgtaacttccgtaacctaccgtaactcgaacgcgtaacggaccgtagacggtaccgttaagtaagtttacgttttcgacgtttaagttttaactacgttcgtacagtcgtagacgtcgacgtacgtccgtaccgttacggttcggaacgggtacgtacggaacggtagactacgaaggtcgtggtacgctacgtagacctgtctgtctactcgttccc

SEQ ID NO: 62282 - DNA, 668 bp, Homo sapiens
  misc_feature: GYAE6OF02F6EA9.23.60.F05.1.454.CMB.1.raw
  modified_base (203)..(203): a, c, t, g, unknown or other
  misc_feature (203)..(203): n is a, c, g, or t
  modified_base (274)..(274): a, c, t, g, unknown or other
  misc_feature (274)..(274): n is a, c, g, or t
  modified_base (298)..(298): a, c, t, g, unknown or other
  misc_feature (298)..(298): n is a, c, g, or t
  modified_base (656)..(656): a, c, t, g, unknown or other
  misc_feature (656)..(656): n is a, c, g, or t
tcagacgcgagtatcacgaccggtgctcgatttagtacgtcatcagggaaagggggaggaactgctcagttaggacccagagggaaccatggaagccccagctcagcttctcttcctcctgctactctggctcccagataccaccggagaaattgtgttgacacagtctaccagccaccctgtctttagctccgaggggaaangccaccctctccgtgcgagggcctagtccagagtgttacgcagctacttagcctggtaccagcaagaaacntggcctaggcctaccgagcctccncatctatggatcgctaactacccgaagacgggccctacgtcggtaccaccgttcccgagtacccgtaggttccaagtcggactagggtcggtacgtaggacagtacgttcacgttcctacgacctatacgtacgacgacgtaccgtaacggacgtccgtagtaacgttagtttcgacgttaagtttacgttacgttcgtactacgcgtaacgtacgacgtacgtaaccgtccggtacctacggtttcgggacggtaaacggtaaccgtaacgggtaggtaaaccgacgaaaaccggttacggtaggttaccggtactaccggtacctaacggtacttacgttacggtttaccgttacnccgtttacccgg

SEQ ID NO: 62283 - DNA, 560 bp, Homo sapiens
  misc_feature: GYAE6OF01BLPCM.18.70.G04.1.454.CMB.1.raw
  modified_base (289)..(289): a, c, t, g, unknown or other
  misc_feature (289)..(289): n is a, c, g, or t
  modified_base (422)..(422): a, c, t, g, unknown or other
  misc_feature (422)..(422): n is a, c, g, or t
tcagtacgagtatgcacgaccggtgctcgatttagtgtagtgtgaagggaaaggggacccaacaaccacatccctcctgagaagcccccagagcacaactccttaccatggactggacctggaggatcctctttttggtggcagcagccacaggtgcccactcccaggtccagcttgtgcagtctggggctgaggtgaagagcctggggcctcagtgaaggtttcctgcaagacttctggatactccttcacttagtttttcatcctattggctgcgccaggccccganaaggcttgagtgggtggatggatcaacgctgtcaatggtctacaactaaaatattacactagtaagttgacgagggcaaggagtacacctaattacgtaggacacatccgacgaagaacagcctacataggancgtgagcagcctgatatctagaacgacacgtctagtaattattacgtgtacgacgtaggtatttacggcgtaaggttgggaagtcggttaccttaacgtactaacttactactactagtcggtacgtcggtaacgggg

SEQ ID NO: 62284 - DNA, 509 bp, Homo sapiens
  misc_feature: GYAE6OF01BO2E6.18.70.G04.1.454.CMB.1.raw
tcagtacgagtatgcacgaccggtgctcgatttagtgtagtgtgaagggaaaggggacccaacaaccacatccctcctgagaagcccccagagcacaactccttaccatggactggacctggaggatcctcttttggtggcagcagccacaggtgcccactcccaggtccagcttgtgcagtctggggctgaggtgaagaagcctggggcctcagtgaaggtttcctgcaagacttctggatactccttcactagtttttcatccattggctgcgccaggcccccggacaaaggcttgagtgggtgggatggatcaacgctgtcaatggtctcacaaaatattcacagaagttgcagggcagagtcacattactagggacacatccgcgagaacagcctacatggagctgagcagcctgatatctgaagacacggctgtatattactgtgcgaggattgcaggtggagtagtccttatactactactactacatggacgtcgtacgggg

SEQ ID NO: 62285 - DNA, 509 bp, Homo sapiens
  misc_feature: GYAE6OF01EXHK8.18.70.G04.1.454.CMB.1.raw
  modified_base (287)..(287): a, c, t, g, unknown or other
  misc_feature (287)..(287): n is a, c, g, or t
  modified_base (331)..(331): a, c, t, g, unknown or other
  misc_feature (331)..(331): n is a, c, g, or t
  modified_base (339)..(339): a, c, t, g, unknown or other
  misc_feature (339)..(339): n is a, c, g, or t
  modified_base (399)..(399): a, c, t, g, unknown or other
  misc_feature (399)..(399): n is a, c, g, or t
  modified_base (406)..(406): a, c, t, g, unknown or other
  misc_feature (406)..(406): n is a, c, g, or t
  modified_base (492)..(492): a, c, t, g, unknown or other
  misc_feature (492)..(492): n is a, c, g, or t
tcagtacgagtatgcacgaccggtgctcgatttagtgtagtgtgaagggaaagggacccaacaaccacatccctcctgagaagcccccagagcacaactccttaccatggactggacctggaggatcctcttttggtggcagcagccacaggtgcccactcccaggtccagcttgtgcagtctggggctgaggtgaagaagcctggggcctcagtgaaggtttcctgcaagacttctggatactccttcactagtttttctatccattggctgcgccaggccccganaaaggcttgagtgggtgggatggatcaacgctgtcaatggtctnacaaaatnttcacagaagttgcagggcagagtcacattactagggacacatccgcgagaacagcctanactgganctgagcagcctgatatctgaagacacggctgtatattactgtgcgaggattgcagtggagtagtccttactactactactaactanatcggacgtgtacgggg

SEQ ID NO: 62286 - DNA, 511 bp, Homo sapiens
  misc_feature: GYAE6OF01B44ZC.18.70.G04.1.454.CMB.1.raw
  modified_base (399)..(399): a, c, t, g, unknown or other
  misc_feature (399)..(399): n is a, c, g, or t
tcagtacgagtatgcacgaccggtgctcgatttagtgtagtgtgaagggaaaggggacccaacaaccacatccctcctgagaagcccccagagcacaactccttaccatggactggacctggaggatcctcttttggtggcagcagccacaggtgcccactcccaggtccagcttgtgcagtctggggctgaggtgaagaagcctggggcctcagtgaaggtttcctgcaagacttctggatactccttcactagttttctatccattggctgcgccaggccccggacaaaggcttgagtgggtgggatggatcaacgctgtcaatggtctcacaaaatattcacagaagttgcagggcagagtcacattactagggacacatcgcgagaacagcctanatggagctgagcagcctagatatctagaagacacggctgtattattactgtgcgaggattgctaggtgagtattccttactactactactactacatggtcgtcgtacgggg

SEQ ID NO: 62287 - DNA, 509 bp, Homo sapiens
  misc_feature: GYAE6OF01ESX1V.18.70.G04.1.454.CMB.1.raw
tcagtacgagtatgcacgaccggtgctcgatttagtgtagtgtgaagggaaaggggacccaacaaccacatccctcctgagaagcccccagagcacaactccttaccatggactggacctggaggatcctctttttggtggcagcagccacaggtgcccactcccaggtccagcttgtgcagtctggggctgaggtgaagaagcctggggcctcagtgaaggtttcctgcaagacttctggatactccttcactagtttttctatccattggctgcgccaggccccggacaaaggcttgagtgggtgggatgggatcaacgctgtcaatggtctcacaaaatattcacagaaagttgcagggcagagtcacattactagggacacatccgcgagaacagcctacatggagctgagcagcctgatatctgaagacacggctgtatattactgtgcgaggattgcagtggagagttccttatactactactactacatggcgtcgtagggg

SEQ ID NO: 62288 - DNA, 739 bp, Homo sapiens
  misc_feature: GYAE6OF01CN9JB.18.70.G04.1.454.CMB.1.raw
  modified_base (396)..(396): a, c, t, g, unknown or other
  misc_feature (396)..(396): n is a, c, g, or t
tcagtacgagtatgcacgaccggtgctcgatttagtgtagtgtgaagggaaaggggacccaacaaccacatccctcctgagaagcccccagagcacaactccttaccatggactggacctggaggatcctctttttggtggcagcagccacaggtgcccactcccaggtccagcttgtgcagtctggggctgaggtgaagaagcctggggcctcagtgaaggtttcctgcaagacttctggatactccttcacttagtttttctatcctattggctgcgccacggccccgacaaaggcttgagtgggtgggatggatcaacgctgtcaatggtctacaacaaaatattacaacagaagttgacagggcagagtcacagttactaggacacatccgngaagaacagacctaacagtaggacgtactaggacgcgaacgacccgttagaacttaacgttaccgtaggtaaaacgaccgtaaccgggtaccttagggttaaactttaagtttaaccgttaggtagggtaacccggtaaggggttaacgttttacgggacccgttaaggggttaacggggtaaaacggttaaccgggttttaaccccgtttttaaaacccgtttaaaaccccgtttaaaacccgtttaaacccccggttttaaacccgtttaaaacccggtaacggtttttaacccggggggtaaacccgggttttacccggggtttaaaacccggggggggg

SEQ ID NO: 62289 - DNA, 519 bp, Homo sapiens
  misc_feature: GYAE6OF01CQK43.18.70.G04.1.454.CMB.1.raw
tcagtacgagtatgcacgaccggtgctcgatttagtgtagtgtgaagggaaaggggacccaacaaccacatccctcctgagaagcccccagagcacaactccttaccatggactggacctggaggatcctcttttggtggcagcagccacaggtgcccactcccaggtccagcttgtgcagtctggggctgaggtgaagaagcctggggcctcagtgaaggtttcctgcaagacttctggatactccttcactagttttctatccattggctgcgccaggcccccggacaaaggcttgagtgggtgggatggatcaacgctgtcaatggtctcacaaaatattcacagaagttgacagggcagagtcacctaatactagggacacatccgacgagaacagacctacataggagctgagcagcctgatatctgaagacacggctgtatattactgtgcgtaggattggcgaggtggagtagtaccttactactactactactacatcggcgtgtacgggg

SEQ ID NO: 62290 - DNA, 576 bp, Homo sapiens
  misc_feature: GYAE6OF01CKLDW.18.70.G04.1.454.CMB.1.raw
  modified_base (341)..(341): a, c, t, g, unknown or other
  misc_feature (341)..(341): n is a, c, g, or t
tcagtacgagtatgcacgaccggtgctcgatttagtgtagtgtgaagggaaaggggacccaacaaccacatccctcctgagaagcccccagagcacaactccttaccatggactggacctggaggatcctctttttggtggcagcagccacaggtgcccactcccaggtccagcttgtgcagtctggggctgaggtgaagaagcctggggcctcagtgaaggtttcctgcaagacttctggatactccttcactagtttttctatccattggctgcgccaggccccgacaaaggcttgagtgggtgggatggatcaacgctgtcaatggtctcacaaaatnttacacagaagttgcagggcagagtcacatactaggacacatccgcgaagaacacgcctacagtggagctaggacgcagcctgatatcgtagaaacgacgaacgggtctagtaattagttacgtggtaggcgaagggtattacggacgtaggttagggaggttaacgtttaccctttaaactaccgtttaactaccgttaacctaactagttacgggtacggttcgtaacggggg

SEQ ID NO: 62291 - DNA, 526 bp, Homo sapiens
  misc_feature: GYAE6OF01BFZ01.18.70.G04.1.454.CMB.1.raw
  modified_base (276)..(276): a, c, t, g, unknown or other
  misc_feature (276)..(276): n is a, c, g, or t
  modified_base (287)..(287): a, c, t, g, unknown or other
  misc_feature (287)..(287): n is a, c, g, or t
  modified_base (517)..(517): a, c, t, g, unknown or other
  misc_feature (517)..(517): n is a, c, g, or t
tcagtacgagtatgcacgaccggtgctcgatttagtgtagtgtgaagggaaaggggacccaacaaccacatccctcctgagaagcccccagagcacaactccttaccatggactggacctggaggatcctcttttggtggcagcagccacaggtgcccactcccaggtccagcttgtgcagtctggggctggaggtgaagaagcctggggcctcagtgaaggtttcctgcaagacttctggatactccttcacttagttttcatccattggctgcncaggccccganaaggcttgagtgggtggatggatcgaacgctgtcaatggtctcaacaaaatattcaacagaagttgcagggcagagtcacattacagggacacatccgacgaagaaacgcctaacataggagctgagtcagcctgatatcagaagacacggctagtatattacgtgtgcgtaggtatgacgtagtggagtacgtaccttactactactactaactacagttagacgttgngggaaacgg

SEQ ID NO: 62292 - DNA, 542 bp, Homo sapiens
  misc_feature: GYAE6OF01ALD70.18.70.G04.1.454.CMB.1.raw
  modified_base (292)..(292): a, c, t, g, unknown or other
  misc_feature (292)..(292): n is a, c, g, or t
  modified_base (336)..(336): a, c, t, g, unknown or other
  misc_feature (336)..(336): n is a, c, g, or t
  modified_base (345)..(345): a, c, t, g, unknown or other
  misc_feature (345)..(345): n is a, c, g, or t
tcagtacgagtatgcacgaccggtgctcgatttagtgtagtgtgaagggaaaggggacccaacaaccacatccctcctgagaagcccccagagcacaactccttaccatggactggacctggaggatcctctttttggtggcagcagccacaggtgcccactcccaggtccagcttgtgcagtctggggctgaggtgaagaagcctggggcctcagtgaaggtttcctgcaagacttctggatactccttcacttagtttttctatccattggctgcgccaggcccccgganaaaggcttgagtgggtgggatggatcaacgctgtcaatggtctnaacaaaatnttcacagaagttgcagggcagagtcacattacagggacacatccgacgagaacagcctacatggagctgagcagcctgatatctgaagacgacggctagtatattactgtgacgaggtattggacgtaggtgggagtacggttacccttaactacttactaacctaactacagtcgggtaacgttcggtaacggggg

SEQ ID NO: 62293 - DNA, 536 bp, Homo sapiens
  misc_feature: GYAE6OF01EK0MO.18.70.G04.1.454.CMB.1.raw
  modified_base (288)..(288): a, c, t, g, unknown or other
  misc_feature (288)..(288): n is a, c, g, or t
tcagtacgagtatgcacgaccggtgctcgatttagtgtagtgtgaagggaaagggacccaacaaccacatccctcctgagaagcccccagagcacaactccttaccatggactggacctggaggatcctctttttggtggcagcagccacaggtgcccactcccaggtccagcttgtgcagtctggggctgaggtgaagaagcctggggcctcagtgaaggtttcctgcaagacttctggatactccttcactagtttttcatccattggctgcgccaggccccgganaaaggcttgagtgggtgggatgggatcaacgctgtcaatggtctcaacaaaatattcacagaagttgcagggcagagtcacattactagggacacatccgcgagaacagacctacatcggagctgagcagcctgatatctagaagacacgggctaggtattattactgtcgcgaggtattgcaggttggagtaggttacctttacgtacttactaaccttaactactatcggtacgtcgtaacggggg

SEQ ID NO: 62294 - DNA, 734 bp, Homo sapiens
  misc_feature: GYAE6OF01C0C55.18.70.G04.1.454.CMB.1.raw
  modified_base (214)..(214): a, c, t, g, unknown or other
  misc_feature (214)..(214): n is a, c, g, or t
  modified_base (227)..(227): a, c, t, g, unknown or other
  misc_feature (227)..(227): n is a, c, g, or t
  modified_base (238)..(238): a, c, t, g, unknown or other
  misc_feature (238)..(238): n is a, c, g, or t
  modified_base (249)..(249): a, c, t, g, unknown or other
  misc_feature (249)..(249): n is a, c, g, or t
  modified_base (295)..(295): a, c, t, g, unknown or other
  misc_feature (295)..(295): n is a, c, g, or t
tcagtacgagtatgcacgaccggtgctcgatttagtgtagtgtgaagggaaaggggacccgaacaaccacatccctcctgagaagcccccagagcacaactccttaccatggactggacctggaggatcctcttttggtggcagcagccacaggtcgcccactcccaggtccagcttgtgcagtctggggctgaggtgaagaagcctgggcctnagtgaagtttccngcaagacttcnggatactcttnacttagtttttctatcctattggctgtcgccgacggcccccggaanaaaggccttgaagtgggtagggatggatcaacgctggtcaatggtactacaacgaaaatattacactaagtagttacgacaggggactaagacgtacaaccgtaattaacgtaacgggacaaccgagtaccgaccgtaaggaacacggtaccccttaacgagtaggggaacgtaccgtagggaacgccaacggtaccgtaggtaacttaacgttaccgttaggaaacgaaacccgtacgggtaacctttagggtaaacttttacgttaaaccgttgggtttaacgaccggggttaagggtaaagtttcgggtaaccgtaagggttacggggtaaacgtaacgggtttaccccttaaacttaacccggttaaaccttaacccgttaaaccgttaacgaaccgtttacgggtaaaccccggttaggtttaaaccggggggg

SEQ ID NO: 62295 - DNA, 656 bp, Homo sapiens
  misc_feature: GYAE6OF01D1X0O.18.70.G04.1.454.CMB.1.raw
  modified_base (289)..(289): a, c, t, g, unknown or other
  misc_feature (289)..(289): n is a, c, g, or t
tcagtacgagtatgcacgaccggtgctcgatttagtgtagtgtgaagggaaagggacccaacaaccacatccctcctgagaagcccccagagcacaactccttaccatggactggacctggaggatcctctttttggtggcagcagccacaggtgcccactcccaggtccagcttgtgcagtctgggctgaggtgaagaagcctggggcctcagtgaaggtttcctgcaagacttctggactactccttcacttagtttttcatccattggctgcgccacgccccgganaaaggcttgagtgggtggatggatcaacgctgtacaatggtctacaacaaaatacttacaacaagtaagttgacgagggtacaggaacgtccaactaagtttaaccgtaagggaacaactacgttacccggacgtaacggaaacctacgacccttaacgtaagtcgggaagtcccgtagacggtaccacggtccctagataacgtacgtaggaaacgacgaacgggtcttaggtaattaacgtttaccgtggtacgacggtaggtacgttagcgtaaggtcgggtaacgtacgttaaccccgtttaataccgttaaccttaaaccgtacttaaccaggttaccgggtaacgttcgggtaaccggggg

SEQ ID NO: 62296 - DNA, 527 bp, Homo sapiens
  misc_feature: GYAE6OF01AS72D.18.70.G04.1.454.CMB.1.raw
  modified_base (333)..(333): a, c, t, g, unknown or other
  misc_feature (333)..(333): n is a, c, g, or t
  modified_base (382)..(382): a, c, t, g, unknown or other
  misc_feature (382)..(382): n is a, c, g, or t
  modified_base (446)..(446): a, c, t, g, unknown or other
  misc_feature (446)..(446): n is a, c, g, or t
tcagtacgagtatgcacgaccggtgctcgatttagtgtagtgtgaagggaaaggggacccaacaaccacatccctcctgagaagcccccagagcacaactccttaccatggactggacctggaggatcctctttttggtggcagcagccacaggtgcccactcccaggtccagcttgtgcagtctggggctgaggtgaagaagcctggggcctcagtgaaggtttcctgcaagacttctggatactcttcacttagtttttctatccattggctgcgccaggccccggacaaaggcttgagtgggtgggatggatcaacgctgtcaatggtcncacaaaatattcacagaagttgcagggcagagtcacatactagggacanatccgacgagaacagcctaacgatggaagctagagcgacgcctagatatctagaagacgacggntagtatattactgtagacgaggtattggctaggcggagagttcctactactactactaactacatcggcgtcggtacgggg

SEQ ID NO: 62297 - DNA, 540 bp, Homo sapiens
  misc_feature: GYAE6OF01DB6FW.18.70.G04.1.454.CMB.1.raw
  modified_base (322)..(322): a, c, t, g, unknown or other
  misc_feature (322)..(322): n is a, c, g, or t
tcagtacgagtatgcacgaccggtgctcgatttagtgtagtgtgaagggaaaggggacccaacaaccacatccctcctgagaagcccccagagcacaactccttaccatggactggacctggaggatcctctttttggtggcagcagccacaggtgcccactcccaggtccagcttgtgcagtctggggctgaggtgaagagcctggggcctcagtgaaggtttcctgcaagacttctggatactccttcactagtttttctatccattggctgcgccaggcccccggacaaaggcttgagtgggtgggatggatcaacgcngtcaatggtctacaacaaaatattcacagaagttgcaaggggcagagtcaccaattactagggacacactccgcgaagaacagcctacataggagctagagcgagccctgatatctagaagacgacggctgttaatattactgtgcgaggtattgcgaggtggagtagttccttaataacttaactactaactaacattacggcgttcgtaacggggg

SEQ ID NO: 62298 - DNA, 523 bp, Homo sapiens
  misc_feature: GYAE6OF01DDAK8.18.70.G04.1.454.CMB.1.raw
  modified_base (450)..(450): a, c, t, g, unknown or other
  misc_feature (450)..(450): n is a, c, g, or t
tcagtacgagtatgcacgaccggtgctcgatttagtgtagtgtgaagggaaaggggacccaacaaccacatccctcctgagaagcccccagagcacaactccttaccatggactggacctggaggatcctcttttggtggcagcagccacaggtgcccactcccaggtccagcttgtgcagtctggggctgaggtgaagaagcctggggcctcagtgaaggtttcctgcaagactctggatactccttcactagttttctatccattgctgcgccaggccccggacaaaggcttgagtgggtgggatggatcaacgctgtcaatggtctcaacaaaatattacacagaagttgcagggcagagtcacattactagggacacatccgacgagaacagacctacaatggagctgagcagcctgatatctgaagacacggctagtatattacngtgcgagtattgctaggtggtagagttccttaacgtacctaactactactaacatcggacgttcgtaacgggg

SEQ ID NO: 62299 - DNA, 545 bp, Homo sapiens
  misc_feature: GYAE6OF01ECIHR.18.70.G04.1.454.CMB.1.raw
  modified_base (405)..(405): a, c, t, g, unknown or other
  misc_feature (405)..(405): n is a, c, g, or t
  modified_base (423)..(423): a, c, t, g, unknown or other
  misc_feature (423)..(423): n is a, c, g, or t
tcagtacgagtatgcacgaccggtgctcgatttagtgtagtgtgaagggaaaggggacccaacaaccacatccctcctgagaagcccccagagcacaactccttaccatggactggacctggaggatcctctttttggtggcagcagccacaggtgcccactcccaggtccagcttgtgcagtctggggctgaggtgaagaagcctggggcctcagtgaaggtttcctgcaagacttctggatactccttcacttagtttttctatccatttggctgcgccaggcccccggacaaaggcttgagtgggtgggatggatcaacgctgtcaatggtctcacaaaatatcacagaagttgcagggcagagtcaccattactagggacacatccgcgagaacagcctanagtggagctgagcagtcngacaccgtgacgacgacgccgtactattactgtgacgagacgccgacgaatagtagtggtagacaaaggtgttggtcgtttggttttggtttacgggccggttagtaacgtcggtaccgggg

SEQ ID NO: 62300 - DNA, 683 bp, Homo sapiens
  misc_feature: GYAE6OF01CL1LV.18.70.G04.1.454.CMB.1.raw
tcagtacgagtatgcacgaccggtgctcgatttagtgtagtgtgaagggaaaggggacccaacaaccacatccctcctgagaagcccccagagcacaactccttaccatggactggacctggaggatccttcttttggtggcagcagccacaggtgcccactcccaggtccagcttgtgcagtctggggctgaggtgaagaagcctggggcctcgagtgaaggtttcctgacaagacttctggatactccttcacttagttttctatccattggctgcgccacggcccccggacaaaggcttgaggtgggtgggatggactcaacgctgtacaatggtctacaacaaaatattacaacagaagttgacgagggcagacgtcacatttacgagggacacactaccgacgaacaacgagacctaacagtggagctaggacgacgacggcctaggtaactactacgttaggaaacgaaccgaaccgggtaccttaggtttaaacgttaacgtttaaccgttagggtacggtaccgggaagggttagtttacggaccggtaaagggtttcggggaaacgttaacggttacccccgtttaaaactttaacccgttaaacccttaaacccgtttaaacttaaacccgtaaaggttcgggtaaacccgggtttcgggtaaacccgggggg

SEQ ID NO: 62301 - DNA, 616 bp, Homo sapiens
  misc_feature: GYAE6OF01A6GRD.18.70.G04.1.454.CMB.1.raw
  modified_base (436)..(436): a, c, t, g, unknown or other
  misc_feature (436)..(436): n is a, c, g, or t
tcagtacgagtatgcacgaccggtgctcgatttagtgtagtgtgaagggaaaggggacccaacaaccacatccctcctgagaagcccccagagcacaactccttaccatggactggacctggaggatcctctttttggtggcagcagccacaggtgcccactcccaggtccagcttgtgcagtctggggctgaggtgaagaagcctggggcctcagtgaaggttttcctgcaagacttctggatactccttcacttagtttttctatcctattggctgcgccacggccccggacaaaggcttggaggtgggtgggatggatcaacgctgtcaagtggtctacaacaaaattattacacaagtaagttgacagggcagagtcacctattacgtagggacacagtccgacgaagaaccacgacctaacgagtagggancgtagacgcagtcctgtaactagtacgtagaacgacacggtacttagttaacttaatttacgttggtacgtacggtaggtagttcggacgtagggtagggtaagtacgtttacccgttaacttaaccttaccttaaaccgttacttaacgtaagttcgggtacgtcgggttaaccggggg

SEQ ID NO: 62302 - DNA, 588 bp, Homo sapiens
  misc_feature: GYAE6OF01DB2YQ.18.70.G04.1.454.CMB.1.raw
  modified_base (290)..(290): a, c, t, g, unknown or other
  misc_feature (290)..(290): n is a, c, g, or t
  modified_base (407)..(407): a, c, t, g, unknown or other
  misc_feature (407)..(407): n is a, c, g, or t
tcagtacgagtatgcacgaccggtgctcgatttagtgtagtgtgaagggaaaggggacccaacaaccacatccctcctgagaagcccccagagcacaactccttaccatggactggacctggaggatcctctttttggtggcagcagccacaggtgcccactcccaggtccagcttgtgcagtctggggctgaggtgaagaagtctggggcctcagtgaaggtttcctgcaagacttctggatactccttcactagtttttctatccattggctgcgccacggccccganaaagctgagtgggtgggatggatcaacgctgtcaatggtctcaacaaaatattcaacagaagttgacgtagggcagagtcacgtattacaggaacacatccgcgaagaccagcctanaatggagctagagcagcctagatatacgtagaagaccgacggtcttaggtaacttatttaccgtaggttcggacggtaaggtatttacgggccgtaagggtcgggaagtaacggtttccctttaaaccttacttaacttaacctttactaactagttcgggaaccttcgggtaaacggggg

SEQ ID NO: 62303 - DNA, 561 bp, Homo sapiens
  misc_feature: GYAE6OF01DGB90.18.70.G04.1.454.CMB.1.raw
  modified_base (292)..(292): a, c, t, g, unknown or other
  misc_feature (292)..(292): n is a, c, g, or t
  modified_base (411)..(411): a, c, t, g, unknown or other
  misc_feature (411)..(411): n is a, c, g, or t
  modified_base (418)..(418): a, c, t, g, unknown or other
  misc_feature (418)..(418): n is a, c, g, or t
  modified_base (472)..(472): a, c, t, g, unknown or other
  misc_feature (472)..(472): n is a, c, g, or t
tcagtacgagtatgcacgaccggtgctcgatttagtgtagtgtgaagggaaaggggacccaacaaccacatccctcctgagaagcccccagagcacaactccttaccatggactggacctggaggatcctctttttggtggcagcagccacaggtgcccactcccaggtccagcttgtgcagtctggggctgaggtgaagaagcctggggcctcagtgaaggtttcctgcaagacttctggatactccttcacttagtttttctatcctattggctgcgccaggccccgganaaggcttgagtgggtgggatggatcaacgctgtcaatggtctacaacaaaatattacaacagaagttgcgaggcagagtcactattactagggacacatccgacgagaacagaccctanagtggancgtagagcagcctagatactctaggaacgacgacggtacttagtattaattacnggttacgacgaggtattgactaggtggtagtagttaccctttataccttaacttaactactaacgtagtcgggtacgtcggtaacgggg

SEQ ID NO: 62304 - DNA, 625 bp, Homo sapiens
  misc_feature: GYAE6OF01AV3LX.18.70.G04.1.454.CMB.1.raw
tcagtacgagtatgcacgaccggtgctcgatttagtgtagtgtgaagggaaaggggacccaacaaccacatccctcctgagaagcccccagagcacaactccttaccatggactggacctggaggatcctctttttggtggcagcagccacaggtgcccactcccaggtccagcttgtgcagtctggggctgaggtgaagaagcctggggcctcagtgaaggtttcctgcaagacttctggatactccttcactagtttttcatccattggctgcgccacggccccggacaaaggcttgaggtgggtgggagtggatcgaacgctgtcaatggtctacaacaaaatacttacaacagtaagttgcgagggcagagtcactattacgtaggacacatccgacgacgaacacgacctaacgatgggaagctacggacgtaccgaacgtccctaggtaactatacgtagaaacggtaacacgggtacttagttaacttaacgtttacgttaggtacggacgggtaaggtaacgttcgggacgtaagggttggaacggttacgttaccctttaacgtaacttaaccgttacctaaactactaagttacgggtacggtcgtaacgggggg

SEQ ID NO: 62305 - DNA, 538 bp, Homo sapiens
  misc_feature: GYAE6OF01CQ0J3.18.70.G04.1.454.CMB.1.raw
  modified_base (270)..(270): a, c, t, g, unknown or other
  misc_feature (270)..(270): n is a, c, g, or t
  modified_base (286)..(286): a, c, t, g, unknown or other
  misc_feature (286)..(286): n is a, c, g, or t
  modified_base (329)..(329): a, c, t, g, unknown or other
  misc_feature (329)..(329): n is a, c, g, or t
  modified_base (338)..(338): a, c, t, g, unknown or other
  misc_feature (338)..(338): n is a, c, g, or t
  modified_base (386)..(386): a, c, t, g, unknown or other
  misc_feature (386)..(386): n is a, c, g, or t
tcagtacgagtatgcacgaccggtgctcgatttagtgtagtgtgaagggaaaggggacccaacaaccacatccctcctgagaagcccccagagcacaactccttaccatggactggacctggaggatcctcttttggtggcagcagccacaggtgcccactcccaggtccagcttgtgcagtctggggctgaggtgaagaagcctggggcctcagtgaaggtttcctgcaagacttctggatactccttcactagttttctatccattgntgcgccggccccgganaaaggctgagtgggtggatggatcaacgctgtcaagtggtctnaacaaaatntacacagaagttgcgagggcagagtcacattactagggacacatccgngagaacagacctacaatggaagctagagcagcctgatatctagaagacacggtctgtaatattactgtagcgtagattgcgtagtagggataggttacccttaactaccgttactaactacttacgagttggaccgttcgtaggggaaaccg

SEQ ID NO: 62306 - DNA, 689 bp, Homo sapiens
  misc_feature: GYAE6OF01CU4V0.18.70.G04.1.454.CMB.1.raw
  modified_base (228)..(228): a, c, t, g, unknown or other
  misc_feature (228)..(228): n is a, c, g, or t
  modified_base (358)..(358): a, c, t, g, unknown or other
  misc_feature (358)..(358): n is a, c, g, or t
tcagtacgagtatgcacgaccggtgctcgatttagtgtagtgtgaagggaaaggggacccaacaaccacatccctcctgagaagcccccagagcacaactccttaccatggactggacctggaggatccttctttttggtggcagcagccacaggtgcccactcccaggtccagcttgtgcagtctggggctgaggtgaagagcctggggcctcagtgaaggtttccngacaagacttctggataccttccttcacttagttttctatccattggctgcgccacggcccccggacaaggcttaggaggtggggtgggagtggatcaacgctagtactaatcggtctacaactaaaatnttacactagtaagttgcgagggcagagtcaacctattacgtagggacacactccgacgaacgaacacgaccctaacgagtacggaacgcgtaggacgaccgacggtccctagaacttacgttaccgtaacggaaacgaccggtaaccggtcgttaaggttaacttaacgtttacttagggttacggtacgggtaacggttaagtttacggacgttaggtagggaaacggtttaccggttaaccccgtttaacgttaaacccttaaccgtttaaccttaaaccgttaacgtacggttaacgggtaacccgggttcggttaaacccggggggg

SEQ ID NO: 62307 - DNA, 621 bp, Homo sapiens
  misc_feature: GYAE6OF01C4SAX.18.70.G04.1.454.CMB.1.raw
  modified_base (293)..(293): a, c, t, g, unknown or other
  misc_feature (293)..(293): n is a, c, g, or t
tcagtacgagtatgcacgaccggtgctcgatttagtgtagtgtgaagggaaaggggacccaacaaccacatccctcctgagaagcccccagagcacaactccttaccatggactggacctggaggatccttcttttggtggcagcagccacaggtgcccactccccaggtccagcttgtgcagtctggggctgaggtgaagaagcctggggcctcagtgaaggtttcctgcaagacttttggatactccttcacttagttttctatccattggctgcgccacggcccccgganaaacggcttgagtgggtgggatgggatcaacgctgtcaatggtctcaacaaatatacacagaagttgcagggcagatacacattacagggacacgatccgagacgaacacgcctaacagtggacgtctaggacgtcgagcccgtagtaactattaccgtaggaaacgaacgaccgggtacttaggttaacttaacgtttaccgtggttacggaccgggttaggtaacgtttgggaaccgtagggtgggtaaacgtacgtttacccgtttaactaaaccgttacttaaccgtaactaaccgtatgggtaaccgtgtacggggaaaccgg

SEQ ID NO: 62308 - DNA, 631 bp, Homo sapiens
  misc_feature: GYAE6OF01CWGW2.18.70.G04.1.454.CMB.1.raw
tcagtacgagtatgcacgaccggtgctcgatttagtgtagtgtgaagggaaaggggacccaacaaccacatcccctcctgagaagcccccagagcacaactccttaccatggactggacctggagatcctcttttggtggcagcagccacaggtgcccactcccaggtccagcttgtgcagtcttgggctgaggtgaagagcctggggcctcgagtgaaggtttcctgcaagacttctggatactccttcacttagttttctatccattgctgcgccaggccccgacaaggcttgaggtgggtgggagtggatcgaacgctgtcaatggtctacacaaaatattacactagacgttagctagggacagacgtacaacctattacgtagggacacgtactcgacgaagaacacgaccttaacgagtcggtaagtacgtaggacgacctaacggtccctagtaacttagtacgttagaaacggtaccaagggtaccttgttaacgtatttaccgtagtaggcggtagtacgttggacgtaggtggtaacgtacggtttacccttaacttaacccgttaaccgttacttaacccttaacgtaacgttaccgggttacggtcggtaaaccggggg

SEQ ID NO: 62309 - DNA, 525 bp, Homo sapiens
  misc_feature: GYAE6OF01D6PZL.18.70.G04.1.454.CMB.1.raw
  modified_base (290)..(290): a, c, t, g, unknown or other
  misc_feature (290)..(290): n is a, c, g, or t
  modified_base (334)..(334): a, c, t, g, unknown or other
  misc_feature (334)..(334): n is a, c, g, or t
  modified_base (356)..(356): a, c, t, g, unknown or other
  misc_feature (356)..(356): n is a, c, g, or t
  modified_base (404)..(404): a, c, t, g, unknown or other
  misc_feature (404)..(404): n is a, c, g, or t
  modified_base (513)..(513): a, c, t, g, unknown or other
  misc_feature (513)..(513): n is a, c, g, or t
tcagtacgagtatgcacgaccggtgctcgatttagtgtagtgtgaagggaaaggggacccaacaaccacatccctcctgagaagcccccagagcacaactccttaccatggactggacctggaggatcctctttttggtggcagcagccacaggtgcccactccccaggtccagcttgtgcagtctggggctgaggtgaagaagcctggggcctcagtgaaggtttcctgcaagacttctggatactccttcactagtttttctatccattggctgcgccaggccccganaaaggcttgagtgggtgggatggatcaacgctgtcaatggtctnacaaaatattcacagaagttgnagggcagagtcacattacgtagggacacatccgacgagaacagcctanacgtggagctgagcagcctgatatctagaagacaacggctagtatattactgtgcgaggattgcagtggagtagttccttaactactacttaactactaacagttcggngtcgtaacgggg

SEQ ID NO: 62310 - DNA, 766 bp, Homo sapiens
  misc_feature: GYAE6OF01DXXYD.18.70.G04.1.454.CMB.1.raw
tcagtacgagtatgcacgaccggtgctcgatttagtgtagtgtgaagggaaaggggacccaacaaccacatccctcctgagaagcccccagagcacaactccttaccatggactggacctggaggatcctctttttggtggcagcagccacaggtgcccactcccaggtccagcttgtgcagtctggggctgaggtgaagaagcctggggcctcagtgaaggtttcctgcaagtacttctggatacctccttcacttagtttttctatcctattggcttgccgccacggccccggaacaaaggcttgacggtgggtgggatgggatacgaacgcgtgtacaagtggtacttacaaactaaaattacttcaacaaggtaaagtttcgacgagggacaaggtacgtaccaaccgtaattaacgtaaggggtaaccaaccgacttaccccgggacgtaaacggaaacccgacggtaccctaacgtaaggtacgggtaacgacgttaggaacgacgaacggtcccttagtaattactacgttaaggaaacgaccgaacggctttaggtttaattaacgttttaccgtaggttggaccgggtaagggttaactttgggaccgttaagggttacggggaaacggttaccggttttaaccccggtttaaactttaaaaccccgttttaaacccgttaaaccccgtttaaacctttaaaccggtaagttttaaccgggggtaaccccgggtttcgggttaaaacccgggggggg

SEQ ID NO: 62311 - DNA, 569 bp, Homo sapiens
  misc_feature: GYAE6OF01ECYX2.18.70.G04.1.454.CMB.1.raw
  modified_base (290)..(290): a, c, t, g, unknown or other
  misc_feature (290)..(290): n is a, c, g, or t
  modified_base (450)..(450): a, c, t, g, unknown or other
  misc_feature (450)..(450): n is a, c, g, or t
tcagtacgagtatgcacgaccggtgctcgatttagtgtagtgtgaagggaaaggggacccaacaaccacatccctcctgagaagcccccagagcacaactccttaccatggactggacctggaggatcctctttttggtggcagcagccacaggtgcccactcccaggtccagcttgtgcagtctggggctgaggtgaagagcctggggcctcagtgaaggtttcctgcaagacttctggatactccttcacttagtttttcatcctattggctgcgccacggccccganaaggcttgaggtgggtgggatggatcgaacgctgtcaagttggtctacaacaaaatattacaacagaagttgcgaggggcagacgtacactattacgtagggacacatccgacgaagaacacgacctacagttaggagacgtagacgcgacgcctagatntcgtagaacgacacggtcttagttaacttatttacgtggtagcggtaggtattggcgtaggtggagtagttcccttaactaccttactaacttactaacagtacggcgtcggtacgggg

SEQ ID NO: 62312 - DNA, 649 bp, Homo sapiens
  misc_feature: GYAE6OF01C1W35.18.70.G04.1.454.CMB.1.raw
  modified_base (291)..(291): a, c, t, g, unknown or other
  misc_feature (291)..(291): n is a, c, g, or t
tcagtacgagtatgcacgaccggtgctcgatttagtgtagtgtgaagggaaaggggacccaacaaccacatccctcctgagaagcccccagagcacaactccttaccatggactggacctggaggatccttcttttggtggcagcagccacaggtgcccactcccaggtccagcttgtgcagtctggggctgaggtgaagaagcctggggcctcagtgaaggtttcctgcaagacttctggatactccttcacttagtttttctatccattggctgcgccacggccccganaagcttgagtgggtgggatggatcaacgtctgtcaatggtctacaacaaaatattacacaagaagttgacgagggcaggagtaccaacctaagttacgtaagggaaccacgtaacgtcccggacgaaggtaaaccaggaccccttaacaagttacggaaggtccttagggacgcgaacggtccctaggacttactacgtaggaaacgacgaaccgggtcttagttaacgttagtttacgtagtaggtccggtaaggtagttcgacgtagggtagggtaacgtacgtttaaccctttaaccttaacttaaccgttaaccttaaacttaactaggttacggaccggttcggtaacggggg

SEQ ID NO: 62313 - DNA, 582 bp, Homo sapiens
  misc_feature: GYAE6OF01DWO7C.18.70.G04.1.454.CMB.1.raw
  modified_base (294)..(294): a, c, t, g, unknown or other
  misc_feature (294)..(294): n is a, c, g, or t
  modified_base (424)..(424): a, c, t, g, unknown or other
  misc_feature (424)..(424): n is a, c, g, or t
  modified_base (471)..(471): a, c, t, g, unknown or other
  misc_feature (471)..(471): n is a, c, g, or t
tcagtacgagtatgcacgaccggtgctcgatttagtgtagtgtgaagggaaaggggacccaacaaccacatccctcctgagaagcccccagagcacaactccttaccatggactggacctggaggatcctctttttggtggcagcagccacaggtgcccactcccaggtccagcttgtgcagtctggggctgaggtgaagaagcctggggcctcagtgtaaggtttcctgcaagtacttctggatactccttcacttagtttttctatccattggctgcgccacggccccgganaaaggcttgaggtgggtgggagtggatcgaacgctgtcaatggtctacaacaaattattacaacagtaagttgacgagggcagagtacacctattacgagggacacatccgacgaagaaccagacctaanagtggagtctagagcaacgcctagacttatcgtagaacgacgacgtntagttatattacgtgtaggacgaggtattcgacgaggttggtaagtacgttaccctttaacttaaccttaacttaccttaacgttaacagtcgggtagttcggtaacgggg

SEQ ID NO: 62314 - DNA, 649 bp, Homo sapiens
  misc_feature: GYAE6OF01D7G29.18.70.G04.1.454.CMB.1.raw
  modified_base (229)..(229): a, c, t, g, unknown or other
  misc_feature (229)..(229): n is a, c, g, or t
  modified_base (305)..(305): a, c, t, g, unknown or other
  misc_feature (305)..(305): n is a, c, g, or t
tcagtacgagtatgcacgaccggtgctcgatttagtgtagtgtgaagggaaaggggacccaacaaccacatccctcctgagaagcccccagagcacaactccttaccatggactggacctggaggatccttctttttggtggcagcagccacaggtgcccactcccaggtccagcttgtgcagtctggggctgaggtgaagagccgtggggcctcgagtgaggtttccngcaagtacttcgtggattaccttcctttctactttagtttttctacttcctattggctgccgccaccggccccganaaggtcttaggaggtgggtagggagtggatacgaacgctgtacaagtcggtctacaaactaaaattacttacaacgaagtaagttcggacgtagggacaaggtacgtacctaaccgtaacgttaacgtacgggaactaccgtacgtaccggacgaagtaacgacgaccctagagtcggagtaccgtaggacgacgtacggtcctagtattacgtacgtaagaacgaccgacggtacttaaggtatttacgttacgtcggtaggacgtaggtagtgacgtagggtcgtacgtacttaccgttactaacttacgtacttactacgagttcggcgttcggtacgggg

SEQ ID NO: 62315 - DNA, 607 bp, Homo sapiens
  misc_feature: GYAE6OF01CLEVT.18.70.G04.1.454.CMB.1.raw
  modified_base (291)..(291): a, c, t, g, unknown or other
  misc_feature (291)..(291): n is a, c, g, or t
  modified_base (492)..(492): a, c, t, g, unknown or other
  misc_feature (492)..(492): n is a, c, g, or t
tcagtacgagtatgcacgaccggtgctcgatttagtgtagtgtgaagggaaaggggacccaacaaccacatccctcctgagaagcccccagagcacaactccttaccatggactggacctggaggatcctctttttggtggcagcagccacaggtgcccactcccaggtccagcttgtgcagtctggggctgaggtgaagaagcctggggcctcagtgaaggtttcctgcaagacttctggatactccttcacttagttttctatccattggctgcgccaggcccccgganaaaggcttggaggtggggtgggatggatcaacgctgtcaatggtctacaacaaaatattacacagtaagttgacgagggcagagtcactatactagggacacatccgagagaacagacctacagtggagctagacgacacgcctagatatctagaacgacgacggtacttagtaacttatttacgtgtaggacgtaaggtntttacggacgtagggtagggtacggtaacgtttacccttttaacgttaaccttaaaccgttaacccgttaacttaacgtaaggttaccgggtacggttccggttaaacggggggg

SEQ ID NO: 62316 - DNA, 733 bp, Homo sapiens
  misc_feature: GYAE6OF01D225B.18.70.G04.1.454.CMB.1.raw
  modified_base (230)..(230): a, c, t, g, unknown or other
  misc_feature (230)..(230): n is a, c, g, or t
tcagtacgagtatgcacgaccggtgctcgatttagtgtagtgtgaagggaaaggggacccaacaaccacatccctcctgagaacgcccccagagcacaactccttaccatggactggacctggaggatccttcttttggtggcagcagccacaggtgcccactcccaggtccagcttgtgcagtcgtggggctgaggtgaagagccgtggggctgagtgtaaggtttccngcaagacttctaggtattaccttccttctaacgtttagtttttctattcctagttcggctgccgtccgaccgggcccccggaagaaacggtcttaggaggtggggtggtaagtgggactcgaacggtcttcgtacgtaagtcggttactacctaaaataaaacttacttacgaacgtaaggtaaacgttggacgtaaggggccaaggtaccgttaccaaccgttaagttaaaccggtaagggaaccctacgtaaccgtaccggacggaaagaacccgacgtaacccgttaagacgttagggaactcggtaagacgaccgacgtccgtagaacttagtacgtaaggaagtacgaccggttataggttaacttaagttaccgtggtacggtacgtaagggttacttggtacgtaagggtgggtaacgttacgtttaccttaaacgttaacccttaacgttaactaaccgttacgaggtttaccgggacgttcgggtaaacggggg

SEQ ID NO: 62317 - DNA, 563 bp, Homo sapiens
  misc_feature: GYAE6OF01DZU3D.18.70.G04.1.454.CMB.1.raw
  modified_base (302)..(302): a, c, t, g, unknown or other
  misc_feature (302)..(302): n is a, c, g, or t
tcagtacgagtatgcacgaccggtgctcgatttagtgtagtgtgaagggaaaggggacccaacaaccacatcccctcctgagaagcccccagagcacaactccttaccatggactggacctggaggatcctcttttggtggcagcagccacaggtgcccactcccaggtccagcttgtgcagtctggggctgaggtgaagaagcctggggcctcagtgaaggtttcctgcaagacttctggatacctccttcacttagtttttcatcctattggctgcgccacggccccgacaaggcttagnggtgggtgggatggatcaacgctagtcaagtggtctacaactaaaatacttcaacaagtaagttgacgaggcagagtcactattacgtaggacacgatccgagaacgaacacgcctaacagtaggagtctagacgcagcctagactatctagaagacgacggtactagtattaactttacgtagtgacggtagtattgacgtaggtaggagtacgttaccttataacctactacttactacagttcggacgtggtacgggg

SEQ ID NO: 62318 - DNA, 546 bp, Homo sapiens
  misc_feature: GYAE6OF01BAY27.18.70.G04.1.454.CMB.1.raw
  modified_base (289)..(289): a, c, t, g, unknown or other
  misc_feature (289)..(289): n is a, c, g, or t
  modified_base (339)..(339): a, c, t, g, unknown or other
  misc_feature (339)..(339): n is a, c, g, or t
  modified_base (399)..(399): a, c, t, g, unknown or other
  misc_feature (399)..(399): n is a, c, g, or t
  modified_base (471)..(471): a, c, t, g, unknown or other
  misc_feature (471)..(471): n is a, c, g, or t
tcagtacgagtatgcacgaccggtgctcgatttagtgtagtgtgaagggaaaggggacccaacaaccacatccctcctgagaagcccccagagcacaactccttaccatggactggacctggaggatcctctttttggtggcagcagccacaggtgcccactcccaggtccagcttgtgcagtctggggctgaggtgaagaagcctggggcctcagtgaaggtttcctgcaagacttctggatactccttcactagtttttctatccattggctgcgccaggccccganaaggcttgagtggtgggatggatcaacgctgtcaatggtctcacaaaatnttcacagaagttgcagggcagagtcacattactagggacacatccgagagaacagcctanatggagctagagcagtcctagattactctagaacgacgacggcttagtaattattacgtggtcgacgaggtnttggcgtaggtggagtagttaccctttaactaccttaacctacttactactagtcgggtaccgttcggtacgggg

SEQ ID NO: 62319 - DNA, 570 bp, Homo sapiens
  misc_feature: GYAE6OF01D8TNG.18.70.G04.1.454.CMB.1.raw
  modified_base (294)..(294): a, c, t, g, unknown or other
  misc_feature (294)..(294): n is a, c, g, or t
  modified_base (399)..(399): a, c, t, g, unknown or other
  misc_feature (399)..(399): n is a, c, g, or t
  modified_base (423)..(423): a, c, t, g, unknown or other
  misc_feature (423)..(423): n is a, c, g, or t
tcagtacgagtatgcacgaccggtgctcgatttagtgtagtgtgaagggaaagggacccaacaaccacatccctcctgagaagcccccagagcacaactccttaccatggactggacctggaggatcctctttttggtggcagcagccacaggtgcccactcccaggtccagcttgtgcagtctggggctgaggtgaagaagcctggggcctcgagtgaaggtttcctgcaagacttctggatactccttcacttagtttttctatccattggcttgcgccacggcccccgganaaaggcttgagtggggtgggatggatcgaacgctgtcaatggtctacacaaaatattcaacagaagttgcagggcagagtacacattacgtaggacacagtccgngacgaacagacctacgataggganctaggacgcagcctagatatctagaagacacggcttagtattattacgtgtgacggtaggtattggacgtaggtgggaacgtagttaccctttaactaacccgtacttaaccgtaactaccgtaatcgggtaacgttcggtacgggg

SEQ ID NO: 62320 - DNA, 609 bp, Homo sapiens
  misc_feature: GYAE6OF01EMVBD.18.70.G04.1.454.CMB.1.raw
  modified_base (292)..(292): a, c, t, g, unknown or other
  misc_feature (292)..(292): n is a, c, g, or t
tcagtacgagtatgcacgaccggtgctcgatttagtgtagtgtgaagggaaaggggacccaacaaccacatccctcctgagaagcccccagagcacaactccttaccatggactggacctggaggatcctctttttggtggcagcagccacaggtgcccactcccaggtccagcttgtgcagtctggggctgaggtgaagaagcctggggcctcagtgaaggtttcctgcaagacttctggattacctccttcacttagtttttcatccattggctgcgccacggccccganaaggcttgagtgggtgggatggatcgaacgcttgtacaagttggtctacaactaaaattacttacacgaaggtaagttgacgtagggcaggagtaccaacctatttaaccgaagggaccacgtacgtcccgacgtaagaacctacgacctaagagtggagctaggacgcagcctagactagtcgtagaacgacgacgtcgttagtaattacttacgtggtagacggtaaggtacttcggacgtaggtaggacggttacgttaccttacctaacgttacctaacttaactacgtagtcgggtacgtcgggtaacgggg

SEQ ID NO: 62321 - DNA, 592 bp, Homo sapiens
  misc_feature: GYAE6OF01A27D2.18.70.G04.1.454.CMB.1.raw
  modified_base (291)..(291): a, c, t, g, unknown or other
  misc_feature (291)..(291): n is a, c, g, or t
  modified_base (350)..(350): a, c, t, g, unknown or other
  misc_feature (350)..(350): n is a, c, g, or t
  modified_base (407)..(407): a, c, t, g, unknown or other
  misc_feature (407)..(407): n is a, c, g, or t
  modified_base (420)..(420): a, c, t, g, unknown or other
  misc_feature (420)..(420): n is a, c, g, or t
tcagtacgagtatgcacgaccggtgctcgatttagtgtagtgtgaagggaaaggggacccaacaaccacatccctcctgagaagcccccagagcacaactccttaccatggactggacctggaggatcctctttttggtggcagcagccacaggtgcccactcccaggtccagcttgtgcagtctgggctgaggtgagaagcctggggcctcagtgaaggtttcctgcaagacttcgtggatactccttcacttagtttttcatcctattggctgcgccaggcccccgaanaaggcttggagtgggtggatggactcgaacgctgtacaagtcggtctacaactaaaatnttacaacagaagttgacgagggcagagtcacatttacgtaggacacatccgacgaanaacagtccgtaanagtaggagtctagaacgtcagccctagactatctaggaacgacgacggtcttaggtaatacgtttacgttgagggtaccgtaaggtgttaggactaaggggtcggtaaggttacgttacccttaacttactaaccttactaactacgtaagtcggtaaccgtggtaacgggg

SEQ ID NO: 62322 - DNA, 659 bp, Homo sapiens
  misc_feature: GYAE6OF01C2DL7.18.70.G04.1.454.CMB.1.raw
  modified_base (211)..(211): a, c, t, g, unknown or other
  misc_feature (211)..(211): n is a, c, g, or t
  modified_base (225)..(225): a, c, t, g, unknown or other
  misc_feature (225)..(225): n is a, c, g, or t
  modified_base (236)..(236): a, c, t, g, unknown or other
  misc_feature (236)..(236): n is a, c, g, or t
tcagtacgagtatgcacgaccggtgctcgatttagtgtagtgtgaagggaaagggacccaacaaccacatccctcctgagaacgcccccagagcacaactccttaccatggactggacctggagatccttcttttggtggcagcagccacaggtgcccactcccaggtccagcttgtgcagtctgggctgaggtgaagaagcctgggcctnagtgaaggtttccngcaagacttcnggatactccttcacttagtttttcatccattggctgcgccgacggccccggaacaaaggcttgaggtggggtgggaagtggatacgaaccgcgtagtacgtaaagtggtacttacaaactaaaaattataccaacgtaagtaaagttagacgagggcaaaggtacgaccaacctaacgtttaacgtacggaaacgaactaacgaccggacgaacgaaacgacgaaccgtacgaagtacggagtactaggagacacgcgtagaatacgttacgagtaacggaaccgtaacggtaccttaggtaattaacttaccgttaggtcgtaccggaggtattaggcctaagggtacggtaacgtacgttaccttaccgttaaacttaactaacctaaccgtaatagtacggtaccgtcggtaaaccgggg

SEQ ID NO: 62323 - DNA, 626 bp, Homo sapiens
  misc_feature: GYAE6OF01CBX56.18.70.G04.1.454.CMB.1.raw
  modified_base (236)..(236): a, c, t, g, unknown or other
  misc_feature (236)..(236): n is a, c, g, or t
  modified_base (246)..(246): a, c, t, g, unknown or other
  misc_feature (246)..(246): n is a, c, g, or t
  modified_base (537)..(537): a, c, t, g, unknown or other
  misc_feature (537)..(537): n is a, c, g, or t
tcagtacgagtatgcacgaccggtgctcgatttagtgtagtgtgaagggaaaggggacccgaacaaccacatccctcctgagaagcccccagagcgacaactccttaccatggacctggacctggaggatccttcttttggtggcagcagccacaggtcgcccactcccaggtccagcttgtgcagtcgtgggctggaggtgaagaagccgtggggcctcgagtgtaaggtttccngcaagacttntggatactccttcacttagttttctatccattggctgccgcgacggccctcggacaaggctggaggtgggtgggatggatcgaacgtctaggtacaagtcgtctacaactaaaatattacgaacaaggtaagttggacgagggtcaaggacgtacaaccctattaaccggtaaggaaccacgtacgtcccggaagacgaaaccacgaccctaaagagtagggacgtacgagaccgcgtacgcccgttagaacttagtacgagaaccgaccgaggtcttagtattaattcgngtacggagtaggtacttggacaaggttggacgtaggttcccttactaacttaccgtacttaacgtatacggtcggtacggttaccgggg

SEQ ID NO: 62324 - DNA, 598 bp, Homo sapiens
  misc_feature: GYAE6OF01BONHG.18.70.G04.1.454.CMB.1.raw
  modified_base (292)..(292): a, c, t, g, unknown or other
  misc_feature (292)..(292): n is a, c, g, or t
  modified_base (299)..(299): a, c, t, g, unknown or other
  misc_feature (299)..(299): n is a, c, g, or t
  modified_base (301)..(301): a, c, t, g, unknown or other
  misc_feature (301)..(301): n is a, c, g, or t
  modified_base (442)..(442): a, c, t, g, unknown or other
  misc_feature (442)..(442): n is a, c, g, or t
  modified_base (477)..(477): a, c, t, g, unknown or other
  misc_feature (477)..(477): n is a, c, g, or t
tcagtacgagtatgcacgaccggtgctcgatttagtgtagtgtgaagggaaaggggacccaacaaccacatccctcctgagaagcccccagagcacaactccttaccatggactggacctggagatcctcttttggtggcagcagccacaggtgcccactcccaggtccagctgtgcagtctgggctgaggtgaagaacgccgtggggcctcgaggtggtaacggtttcctgacaagtacttctggatacctcttcacttgttttcatcagttgctgcgccacggcccgaanaagctgngnggtggagtgatacgacgtactgtacagtacgtcttacaactaaataactctacaagtaaggttgacggacgacgagtaacgtacgaactactaagtaggacgtacaagtccgacgaagaactacgacgactagtagcgganacgtacgagtcgacgctaagatttaccagaaccgngaccgtagggtatagttaacttcgttaggtggaccggtaagtacggttgacgtaggtagtacggtataccgttacttacgtactaactacgacgttaggccgttagggccggtaaaccggg

SEQ ID NO: 62325 - DNA, 669 bp, Homo sapiens
  misc_feature: GYAE6OF01EHQYW.18.70.G04.1.454.CMB.1.raw
  modified_base (304)..(304): a, c, t, g, unknown or other
  misc_feature (304)..(304): n is a, c, g, or t
  modified_base (471)..(471): a, c, t, g, unknown or other
  misc_feature (471)..(471): n is a, c, g, or t
tcagtacgagtatgcacgaccggtgctcgatttagtgtagtgtgaagggaaagggacccaacaaccacatccctcctgagaagcccccagagcacaactccttaccatggactggacctggaggatcctcttttggtggcagcagccacaggtgcccactcccaggtccagcttgtgcagtcgtggggctgaggtgaagaagccgtggggcctcgagtgaaggtttcctgacaagtacttcgtggataccttccttctactttagtttttcctatcctagttggctgccgccacggccccgaanaacggtcttggaggtggggtggagtggatacgaacgctgactaagtcggtctacaactaaatattacaacgtagtaagttgacgagggactagacgtacaacctagttaacgtaacgggactaacgtacgtacccggacgaagaaccacgtacctaacagtacgganaccgtaggacgacgacgtcctagacttagtacgtaggaacgacgtacggtacgttaggttaattacgttacgtaggtcggtacggtagttagtggacggtaggttaggtacggttaaccgtttaccttaaaccttaacgttaaccgttaaccttaacgttacgaaggttaccgggtaacggttcgggtaaaccggggg

SEQ ID NO: 62326 - DNA, 737 bp, Homo sapiens
  misc_feature: GYAE6OF01A35BG.18.70.G04.1.454.CMB.1.raw
  modified_base (190)..(190): a, c, t, g, unknown or other
  misc_feature (190)..(190): n is a, c, g, or t
  modified_base (562)..(562): a, c, t, g, unknown or other
  misc_feature (562)..(562): n is a, c, g, or t
tcagtacgagtatgcacgaccggtgctcgatttagtgtagtgtgaagggaaagggaccaacaaccacatccctcctgagaacgccccagagcacaactccttaccatggactggacctggaggatcctcttttggtggcagcagccacaggtgcccactcccaggtccagcttgtgcagtctggggctgnggtgaagagccgtggggcctcagtgaaggtttcctgacaagtacttctggatacgtccttcacttagttttctatcctattggcttgcgccgacgggtcccccgaactaaaggtccttggaacgtggggtagggacgtgggactacgaacgcgtgtacaagtcggtctacaataaaacttattcacgaagtacgttagcgacgggcagacggtctaaccagtttacgacgggaactactaagtcccggacgtaacgaacgtaacgccttaacgagttacgggaacgtaccgttagggaaaccgcgtaacgggtacccgttaagggtaacttacgtttacggtaacggaacgtaaccggtacggtaccggttnttaaacggtttacttaacgttacgtagggtacccggtaagggttaccgttaggtaccgggtaaccgggttaaggaccggggttactttaacccttttaaaccggtaccttaaacgtttaaccccgtaaagttaccgtaacggttaggttacccgggttcgggttaaaaccggggg

SEQ ID NO: 62327 - DNA, 686 bp, Homo sapiens
  misc_feature: GYAE6OF01BRIJW.18.70.G04.1.454.CMB.1.raw
  modified_base (140)..(140): a, c, t, g, unknown or other
  misc_feature (140)..(140): n is a, c, g, or t
  modified_base (215)..(215): a, c, t, g, unknown or other
  misc_feature (215)..(215): n is a, c, g, or t
  modified_base (225)..(225): a, c, t, g, unknown or other
  misc_feature (225)..(225): n is a, c, g, or t
  modified_base (235)..(235): a, c, t, g, unknown or other
  misc_feature (235)..(235): n is a, c, g, or t
  modified_base (245)..(245): a, c, t, g, unknown or other
  misc_feature (245)..(245): n is a, c, g, or t
  modified_base (300)..(300): a, c, t, g, unknown or other
  misc_feature (300)..(300): n is a, c, g, or t
  modified_base (344)..(344): a, c, t, g, unknown or other
  misc_feature (344)..(344): n is a, c, g, or t
tcagtacgagtatgcacgaccggtgctcgatttagtgtagtgtgaagggaaaggggacccaacaaccacatccctcctgagaacgcccccagagcacaactccttaccatggactggacctggagatccttctttttggnggcagcagccacgaggtcgcccactccaggtccagcttgtgcagtcgtgggctggaggtgaagagcctgggcctnagtgagttcngcaagtctcngatactcttnattagtttcatctattggctgcgccgacggtccccgagaagtctggaaggtcggnggaatcggataccgaacgtcgtagtacctaaggttcggtactanaaaccgtaaaattcttacgacgtaaggtaagttgacaagggaccaaggtacgtaccaaccttaagttaacgacgggacctaacgtactacccggaacgtaagaaccgtacgtaccgtaacgtagttacgggactaacgacgggagaacctacggtacccgtaagtaactacgttaccgtaaggaaacgtaccgtacgggtaccttaggtaactttaaccggtacgttttacgggaagtaccggttaagttacgaccgggttaggtaacggagttacgtttaaccgtacgttaactaaccgttactaactaacggtatagggtacgtggtacgggtaaaccgg

SEQ ID NO: 62328 - DNA, 741 bp, Homo sapiens
  misc_feature: GYAE6OF01CWO5C.18.70.G04.1.454.CMB.1.raw
  modified_base (306)..(306): a, c, t, g, unknown or other
  misc_feature (306)..(306): n is a, c, g, or t
tcagtacgagtatgcacgaccggtgctcgatttagtgtagtgtgaagggaaaggggacccaacaaccacatccctcctgagaagcccccagagcacaactccttaccatggactggacctggaggatccttcttttggtggcagcagccacaggtgcccactcccaggtccagcttgtgcagtctggggctgaggtgaagaagccgtggggcctcgagtgtaacggtttcctgacaagtacttctggatactccttctacttagtttttctatcctattcggctgccgccgacggacccccggaanaacggtcttaggaggtggggtggagtggatcgaacgctgtacaagtcggtactacaaacgtaaaattacttacaacgtaaggtaagtttcgacgtagggacaaggtacgtaccaaccgtaagtttaaccgtaacgggaaccaacgtacgtacccggacgaaacggtaaccgacgtacccgtaacgaaggttacgggaacgtactacgggaacgacgaacggtcccgttaggaacttacgtaacgtacggaaacgaccgtaccggtacgttaggttaacttacgttaccgttggtacggtacggtaagggttagttacggacgtagggtacgggtaacgttaacccgtttaccctttaaaccgtaaccctttaaaccctactttaaacccgttaacgtacggttacgggtacccggttacgggtaaacccgggggg

SEQ ID NO: 62329 - DNA, 613 bp, Homo sapiens
  misc_feature: GYAE6OF01BTZ2X.18.70.G04.1.454.CMB.1.raw
  modified_base (289)..(289): a, c, t, g, unknown or other
  misc_feature (289)..(289): n is a, c, g, or t
  modified_base (343)..(343): a, c, t, g, unknown or other
  misc_feature (343)..(343): n is a, c, g, or t
tcagtacgagtatgcacgaccggtgctcgatttagtgtagtgtgaagggaaaggggacccaacaaccacatccctcctgagaagcccccagagcacaactccttaccatggactggacctggaggatcctctttttggtggcagcagccacaggtgcccactcccaggtccagcttgtgcagtctggggctgaggtgaagaagcctggggcctcagtgaaggtttcctgcaagcttctggatactccttcacttagtttttcatccattggctgcgccacggccccganaaaggcttgagtgggtgggatggatcaacgctgtcaatggtctacaactaaatnttacacgagtaagttgacagggcagacgtccaactagttacgtaagggacaacgtacgtacccggacgaacggaaaccacggtacccttaacgacgtagggaaacgtcgtaaggacgtacacggtacccgtagaacttatccgttaagaacgtaccgacggtaccttaggttaattaacgttcgtagttcggacgtagtagttcgagtaggtggaacgtcgttaccttaacgtacctactaacttactacgtatcgtacgtcggtagggg

SEQ ID NO: 62330 - DNA, 601 bp, Homo sapiens
  misc_feature: GYAE6OF01AZM1D.18.70.G04.1.454.CMB.1.raw
  modified_base (287)..(287): a, c, t, g, unknown or other
  misc_feature (287)..(287): n is a, c, g, or t
  modified_base (337)..(337): a, c, t, g, unknown or other
  misc_feature (337)..(337): n is a, c, g, or t
  modified_base (345)..(345): a, c, t, g, unknown or other
  misc_feature (345)..(345): n is a, c, g, or t
tcagtacgagtatgcacgaccggtgctcgatttagtgtagtgtgaagggaaagggacccaacaaccacatccctcctgagaagcccccagagcacaactccttaccatggactggacctggaggatcctcttttggtggcagcagccacaggtgcccactcccaggtcccagcttgtgcagtctggggctgaggtgaagaagcctggggcctcagtgaaggtttcctgcaagacttctggatactccttcacttagtttttcatccattgctgcgccaggccccganaagcttgagtggtggatggatcaacgctgtcaatggtctcaactaaaatnttaccaanagtaaagttgacagggtcagacgtcaacctattacgtagggactaacatccgagacgaacagacctacgagttggaagtccgtagacgtcaaggcccgtgtaactagtaccgtaggaaacgacgacggtcttagtaattacgttaactgtcggacgtaaggtcgttggactaggtaggtaggtacgtttaccgttactaaccgttaaccttaaacgttaccttaacggtaatccgggtaacgttcgtaacgggggg

SEQ ID NO: 62331 - DNA, 605 bp, Homo sapiens
  misc_feature: GYAE6OF01EN8YC.18.70.G04.1.454.CMB.1.raw
  modified_base (297)..(297): a, c, t, g, unknown or other
  misc_feature (297)..(297): n is a, c, g, or t
  modified_base (467)..(467): a, c, t, g, unknown or other
  misc_feature (467)..(467): n is a, c, g, or t
  modified_base (469)..(469): a, c, t, g, unknown or other
  misc_feature (469)..(469): n is a, c, g, or t
tcagtacgagtatgcacgaccggtgctcgatttagtgtagtgtgaagggaaaggggacccaacaaccacatccctcctgagaagcccccagagcacaactccttaccatggactggacctggagatcctctttttggtggcagcagccacaggtgcccactcccaggtccagcttgtgcagtctggggctgaggtgaagaagcctgggcctcagtgaaggtttcctgcaagtacttctggattacctccttctacttagtttttctatcctagttggctgccgccacggcccccganaaaggtcgttgaggtgggtggtagtggatacgaacgctgtacaagtggtactacaaacgtaaaatacttacaacgtaagtaaagttcgacgtagggacctagacgttaccaaccgtaattaaccgtaagggacacgacgtcccgaagagaaccagacctacgataggaancngacgcgtacgcctagaatactcgtaaggaacgtacgacggtactacggttattagttacgtgacgtacggagtagtgacgaggtacgagttactacttacacttactacctactactagtcgtacgtggtaacggg

SEQ ID NO: 62332 - DNA, 904 bp, Homo sapiens
  misc_feature: GYAE6OF01C6NWH.18.70.G04.1.454.CMB.1.raw
  modified_base (241)..(241): a, c, t, g, unknown or other
  misc_feature (241)..(241): n is a, c, g, or t
tcagtacgagtatgcacgaccggtgctcgatttagtgtagtgtgaagggaaaggggacccaacaaccacgatccctcctgagaagcccccagagcacaactccttaccatggactggacctggaggatcctcttttggtggcagcagccacaggtgcccactcccaggtcccagcttgtgcagtctggggctgaggtgaagagcctggggcctcgagtgaaggtttcctgcaagtacttcnggtatacttccttctacttagtttttctactcctatttcggcttcggccgtcccgaccgggtcccccggaacgtaaacggtccgtttaggacgggttgggggttaggggacgttaggggaacttccggaaaccggtccgttacggtacctaaaggttcgggtaccttaaccgaaactaaaaagttactttaccgaacgaaggttaaacggtttcggaccggtaaggggtaccgtaaggtacggttacccgaacccgttaagtttacccggtaaggggaaccctaaccgtaccgttaccccgggtacggaaacggtaaaccgaccggtaaccccgttaaccgtaacggttacgggtaacgtaccgttacggtaaccggtcccgtacggtaccccgtaggttaacttaaccgttacgttaacggaaacggtaccgtaaccgggtccgttaacggttaagttttaacgttaaccggtttgggttaccgggtacgggtaaacggggttacgttttacggaaccggttaaggggttacggggtaaaccggttacgggttttaaccccgtttaaacgtttaaaccccgtttaaccgtttaaacccttaaaccgttaacgttaacggtttaccggggtaaaccggggttcgggttaaaacccgggggggg

SEQ ID NO: 62333 - DNA, 565 bp, Homo sapiens
  misc_feature: GYAE6OF01ET9JY.18.70.G04.1.454.CMB.1.raw
  modified_base (289)..(289): a, c, t, g, unknown or other
  misc_feature (289)..(289): n is a, c, g, or t
  modified_base (429)..(429): a, c, t, g, unknown or other
  misc_feature (429)..(429): n is a, c, g, or t
tcagtacgagtatgcacgaccggtgctcgatttagtgtagtgtgaagggaaaggggacccaacaaccacatccctcctgagaagcccccagagcacaactccttaccatggactggacctggaggatcctctttttggtggcagcagccacaggtgcccactcccaggtccagcttgtgcagtctggggctgaggtgaagaagcctggggcctcagtgaaggtttcctgcaagacttctggatactccttcacttagtttttcatccattggctgcgccaggccccganaaaggcttgagtgggtgggatggatcgaacggctgtcaatggtctcaacaaaatattcaacagtaagttgcagggcagagtcacattacgagggacacatccgacgagaacagcctacatggacgctgagcagcctgatntctagaagacacggtctagtattagttacgtgtcgacggtaggtagttggacgtaggttagggaacgtacgtttacccttaacttaaccttaacttaaccttaactaacaagttcgggtacgttcggtaacggggg

SEQ ID NO: 62334 - DNA, 806 bp, Homo sapiens
  misc_feature: GYAE6OF01DCL23.18.70.G04.1.454.CMB.1.raw
  modified_base (302)..(302): a, c, t, g, unknown or other
  misc_feature (302)..(302): n is a, c, g, or t
tcagtacgagtatgcacgaccggtgctcgatttagtgtagtgtgaagggaaaggggacccaacaaccacatccctcctgagaagcccccagagcacaactccttaccatggactggacctggaggatcctcttttggtggcagcagccacaggtgcccactcccaggtccagcttgtgcagtctggggctggaggtgaagaagccgtggggcctcagtgtaaggtttcctgacaagtacttcgtaggatacctccttactacttagtttttctactcctattggctgcgccacggccccganaaaggcttagaggtgggtggatggactcgaacgctagtacgaagtcggtactacaaacgtaaaactacttacaacgtaagtaacgttaggacgaagggactaaggtaactaccgaaccgtaagtttacggtaagggaactaaaccgtacgttacccggacgaacgaaaccgacgaccctaacgacgttacgggacgtacgtaaggacgcgacgtcccgtagaacttaacgtacgtaaggaaacgaacccgtaacgggtaccgtttaaggttaaacgtttaacgtttaaccggttcgggttaacgggtaccgggtaaacggggtttaacgtttacgggtacccggtttaaaggggttccgggggaaaacggttaacggggttttaacccccttttaaaccgttaaaccccgttttaaaccgttaaaccccgttttaaacccgttaaaaccggttaggttttaaacccgggggtaccgggttttacccggggtaaaaccggggggg

SEQ ID NO: 62335 - DNA, 773 bp, Homo sapiens
  misc_feature: GYAE6OF01CLU3V.18.70.G04.1.454.CMB.1.raw
  modified_base (216)..(216): a, c, t, g, unknown or other
  misc_feature (216)..(216): n is a, c, g, or t
  modified_base (231)..(231): a, c, t, g, unknown or other
  misc_feature (231)..(231): n is a, c, g, or t
  modified_base (296)..(296): a, c, t, g, unknown or other
  misc_feature (296)..(296): n is a, c, g, or t
tcagtacgagtatgcacgaccggtgctcgatttagtgtagtgtgaagggaaagggacccaacaaccacatccctcctgagaacgccccagagcacaactccttaccatggactggacctggaggatccttcttttggtggcagcagccacaggtgcccactcccaggtccagcttgtgcagtcgtggggctggaggtgaagaagccgtggggcctnagtgtaaggtttccngcaagtcttctggatactccttcacttagttttctatcctattggctgcgccgacggccccgaanaaggcttggagtgggtggatggactcaacgtctgtacaagtcggtactacaaacaaaattattacaacaaggtaacgttgacgagggacgaagtacgtacaacctaatttaaaccgaacgggaacaacgaagttcccggaacgaaagtaaaccgacgacccctaagaagtcgggaacgtcgaaggaacgtccgaacggtccctaggtaacttaacgtacgtaaggaaaaccggtaccgtaaccggggtacctttaagggttaaactttaagtttaaccggtttagggttacccggaacgggtaaagggttagttaccggtaaacggtagggggttacggggtaaacggtttaacccggtttaacccggttttaaaacccgttaaacccgttttaaaaccctttaaaccgtaaacccgtttaacgtaaacgggtttaccgggggtaaacccgggttccggggttaaaaaccggggggg

SEQ ID NO: 62336 - DNA, 688 bp, Homo sapiens
  misc_feature: GYAE6OF01DT1Q8.18.70.G04.1.454.CMB.1.raw
tcagtacgagtatgcacgaccggtgctcgatttagtgtagtgtgaagggaaaggggacccaacaaccacatccctcctgagaagcccccagagcacaactccttaccatggactggacctggagtatccttctttttggtggcagcagccacaggtgccccactcccaggtccagtcttgtgcagtcgtgggctgaggtgaagacgtccgtgggcctgagtgtaagttcctgacaagtacttcgtgtacttaccttccttctaacttttgttttactactccttagttggtctggcccgtccggaccggaccccggaacgaaaggtcgttaggaggttggggtgggagtggacgtacgaacgtcgtagtactagtcgtactaactaaataaatctacagaagtaacgtgacgacggtacgagtactacgtaaccttaagtacgtacgggaacacgtaacgtccggaacgaacgtaaccgaacgtacctagacgtaggtacgtacgtaggacgtacgacgtactagtaacgttataccgtaagaaccggtacgtaacggtcttaagttaattacgtttaagtggtacgtaggtaagttacgtaggacgttaggacggttaagttcttaaccttaccgtaacttaacgttaaccttaactagtaacgtcggttcggtaacggtaacgggg

SEQ ID NO: 62337 - DNA, 764 bp, Homo sapiens
  misc_feature: GYAE6OF01EEK86.18.70.G04.1.454.CMB.1.raw
  modified_base (290)..(290): a, c, t, g, unknown or other
  misc_feature (290)..(290): n is a, c, g, or t
tcagtacgagtatgcacgaccggtgctcgatttagtgtagtgtgaagggaaaggggacccaacaaccacatccctcctgagaagcccccagagcacaactccttaccatggactggacctggaggatcctctttttggtggcagcagccacaggtgcccactcccaggtccagcttgtgcagtctggggctgaggtgaagagcctggggcctcagtgaaggtttcctgcaagacttctggatactccttcacttagtttttcatccattggctgcgccgacggccccganaaacggcttgagtgggtggatggatacgaacgctgtcaagtggtctacaacaaattatacacaagtaagttgacgaggcagagtaccaactattacgtagggaccaactacgtacccgacgaacgaaccacggtaccctaacgaagttacgggacgacgttacggaacggtaccgtaacggtaccccgttagtaacgttaacgttaacccgtttaaggaaaacccgggtaaccgtaaccggggttactttaacgggtttaaacgttttaaccgtttttaaaccggttgggttacggtaacccggggtaaggggtaacgttttacgggaccggttaagggttacgggggtaaccgtttaacgggtttaaccccctttaaacggttaaacccttttaacccggttaaaccttaacccggtttaaaccgaagggttttacccggggtaacgggttccgggggtttaaacccgggggg

SEQ ID NO: 62338 - DNA, 583 bp, Homo sapiens
  misc_feature: GYAE6OF01AGNHG.18.70.G04.1.454.CMB.1.raw
  modified_base (292)..(292): a, c, t, g, unknown or other
  misc_feature (292)..(292): n is a, c, g, or t
  modified_base (344)..(344): a, c, t, g, unknown or other
  misc_feature (344)..(344): n is a, c, g, or t
tcagtacgagtatgcacgaccggtgctcgatttagtgtagtgtgaagggaaaggggacccaacaaccacatccctcctgagaagcccccagagcacaactccttaccatggactggacctggaggatcctcttttggtggcagcagccacaggtgcccactcccaggtccagcttgtgcagtctggggctgaggtgaagaagcctggggcctcagtgaaggtttcctgcaagacttctggatactccttcacttagtttttctatcctattggctgcgccacggcccccganaaggcttgagtggtggagtggatcacgctgtcaagtggtctcaactaaaatnttcactagaagttgcgaggcagacgtcacattacgtaggacacactccgcgaagaacagtcctaacgagtaggacgtctaggagccagcctgactatcgtagaacgccacggtactgttaatacgtttacttggtacggcgtaagtgttgaccgtagggtacggagtaccttccgttaaaccttacgttaacccttaactaacgttacaaggttacggaccggttcgggtaaacggggg

SEQ ID NO: 62339 - DNA, 914 bp, Homo sapiens
  misc_feature: GYAE6OF01CRGAX.18.70.G04.1.454.CMB.1.raw
tcagtacgagtatgcacgaccggtgctcgatttagtgtagtgtgaagggaaaggggacccgaacaaccacagtccctccgtgacgaagcccccagagctaccaacgtcctttaccattggactggacctggagactcctacttttggtggcagcagccacgaggtgcccactcccgaggttccgtagtcttgtgtacttaaggtcgtcggggctggaggtagagaacgccgtggggcctcgagtcggtaagggtttcctggacgtaagtacgttccgtgggtactacgttccgttactacttacgttttctactcctagttcgctcggccgtacccgtaacgggtacccccggtaacgtaaacggtccgttaggtacggtcggggtcggggtacgtacggaacgtccgaacgggtcgtacgtacggtaagtcgggttacctcgtaaactaaaattacgttaccgaacgtaacggtaacggtttacgaaccggtagggtaccgtaaggtacgttaccgaaccttaacgttaccgtaagggaaccgtaacgtaaccgtacccgtacgaaccgtaacgtaccgtacccgttaaccgaagttaccgggaactaacggtaacggaacgtacccgtaacgtacccgttagtaacgttaacgttaacgttaacggaaaaccgtaccggtaaaccgggtacctttaacgggttaaacgttaacgtttaaccgggttaggttaacccgggtacgggtaacggtttaacgtttccggtaaacgttacgggttaacgggtaaaccgttaaacccggtttaacccgttaaaacggttaacccgttaaacccttaaaccgttaaccgttaaaccggtttacggggtaacccgggttaacgggttccccgggtttaaaacccgggggg

SEQ ID NO: 62340 - DNA, 755 bp, Homo sapiens
  misc_feature: GYAE6OF01DJER6.18.70.G04.1.454.CMB.1.raw
  modified_base (138)..(138): a, c, t, g, unknown or other
  misc_feature (138)..(138): n is a, c, g, or t
  modified_base (234)..(234): a, c, t, g, unknown or other
  misc_feature (234)..(234): n is a, c, g, or t
tcagtacgagtatgcacgaccggtgctcgatttagtgtagtgtgaagggaaagggacccaacaaccacatccctcctgagaacgcccccagagcacaactccttaccatggactggacctggagatccttcttttggnggcagcagccacaggtcgcccactcccgaggtccagcttgtgcagtcgtgggctggaggtgaagacgccgtggggcctcgagtgtaacggtttccngacaagtaccttcgtaggtaacttaccttcctttacgtacttttacgttttttactacttcctagtttcggccgttcggccgacccggacccgggaccccccggtaagtaaacgggtcgttacgggtaagggtggggggtacgggtaggtaggtaacgttaccgaaacggtcttagggtacctaagttcggtaaccttaacgaaaacttaaaattacgttaccaaacgtaagggttaaacgttcggaccggtaagggacgtaacggtaacttaaccggaaacccttaagttaaccggtaacgggaacccacgtaaccgtccggaacgaacgtaacccgagtacccttagacgtggaacgtcgtagacgctagctatagtactcgagaacgcgtagtacgtattaacttagtagtggtaaggtcgtaggtatcgaacggtggtaggtaacgttaccgttaacctttccgtaaagttaacccttacgtacgtataaccgtcgggttacgtcggggtaaacggg

SEQ ID NO: 62341 - DNA, 859 bp, Homo sapiens
  misc_feature: GYAE6OF01BBVVO.18.70.G04.1.454.CMB.1.raw
tcagtacgagtatgcacgaccggtgctcgatttagtgtagtgtgaagggaaaggggacccaacaaccacatcccctcctgagaacgccccagagcacaactccttaccatggactggacctggaggatccttcgttttggtggcagcagccacgaggtcgcccactcccaggtccagtcttgtgctagtcgtgggctaggaggtagaagacgtccgtgggcctcgaggtgtaacggtttcctgacgtaagtaccgttctaggtacttaccttccttactaactttacgttttttccaacttccctagttcgggtcttcggcccgtacccggacccgggaccccccggtaaacgaaacgggtcctttaggggtaacgggtggggggttagggtaacggtttgggacgttaaccgtaaccgtcccgttaggttaaccgtaaggtttcggttaacctaagtaaaactaaaaactttacgttactaaaccgaagttaaacgttcggaacgaaccgggtacgaacggttacgtaacctaaccgttaaagtttaaccgggaaagggaaccctaaactacgtacccggaacgggtaacaaccggtaactaacctaaccgtaggtaggtaaccggtacgacggtaacgacccgtaaggtacccgtaggtaaccgttaaacttcgggaaagtaaccgggtaaccctacgggttacttaacggtttaacttaggtttaacgtaggtacggtacgggtaagttacgttacgcgggttaagggtacggtacgttaacggttaccctttaaacgttacttaacccgtaaacttaacggtaccttaggtccggttacggtcgggtaaacgggg

SEQ ID NO: 62342 - DNA, 751 bp, Homo sapiens
  misc_feature: GYAE6OF01BXK9B.18.70.G04.1.454.CMB.1.raw
  modified_base (528)..(528): a, c, t, g, unknown or other
  misc_feature (528)..(528): n is a, c, g, or t
tcagtacgagtatgcacgaccggtgctcgatttagtgtagtgtgaagggaaaggggacccaacaaccacatccctcctgagaagcccccagagcacaactccttaccatggactggacctggaggatccttctttttggtggcagcagccacaggtgcccactcccaggtccagcttgtgcagtcgtggggctggaggtgaagagccgtggggcctcgagtgtaaggtttcctgacaagtacttcgtaggtacttaccttccttctactttacgtttttctactcctagttggcttcgccgccgacggcccccgaacaaacggtcttaggaggtggggtcggagtggactaccgaacgtcgtcgtactaagttcggtacctacgtaaactaaaagtacttaccaacgaacgtaagttcggacgaacggggacaaggtacgtaccgaactaacgtttacgtaacgggaactaacgtaaccgtccggaccgtaaacgaaccgaaccgtacctaacgaagtacgggtaacncgttaagcgacgtaacgccgttagtaatactacgtaaggaacgtaaccggacgtacgttagttaacttaagtttaccgtggttaccggacggtaaggtcgttacggaccgtagggtaacggttacggtaacggtttacccgttaaaacgttacccgttaaacgttaacccgttaaacttacgtaacccggtaggttaacccgggttcggtaaaacccgggggg

SEQ ID NO: 62343 - DNA, 647 bp, Homo sapiens
  misc_feature: GYAE6OF01EDALG.18.70.G04.1.454.CMB.1.raw
  modified_base (356)..(356): a, c, t, g, unknown or other
  misc_feature (356)..(356): n is a, c, g, or t
tcagtacgagtatgcacgaccggtgctcgatttagtgtagtgtgaagggaaaggggacccaacaaccacatccctcctgagaagcccccagagcacaactccttaccatggactggacctggaggatccttctttttggtggcagcagccacaggtgcccactcccaggtccagcttgtgcagtctggggctgaggtgaagaagcctggggcctcagtgaaggtttcctgcaagacttctggatactccttcactttagtttttcattcctattggcttgccgccacggccccgacaaaggcttgaggtgggtgggatggatcgaacgctgtcaagtcggtctacaactaaaattnttacaacagtaagttgacgagggcaggagtcactagttacgagggacacgactcccggacgaagaaccgacgaccctaacagtaggacgcgtaggacgacctacggaccctagtacttagtcgtacgaagaccgtacggtacgttagttaattaacgtttaccgtaggttcggacggtaaggttagttgacggttaaggtgggtaacgttacgtttaccctttaaccgttaacgttaccttaaaccgttaccttaacgtagttaccggggtacgttcgggtaaaccggggg

SEQ ID NO: 62344 - DNA, 723 bp, Homo sapiens
  misc_feature: GYAE6OF01C4HRQ.18.70.G04.1.454.CMB.1.raw
  modified_base (132)..(132): a, c, t, g, unknown or other
  misc_feature (132)..(132): n is a, c, g, or t
  modified_base (139)..(139): a, c, t, g, unknown or other
  misc_feature (139)..(139): n is a, c, g, or t
  modified_base (231)..(231): a, c, t, g, unknown or other
  misc_feature (231)..(231): n is a, c, g, or t
  modified_base (242)..(242): a, c, t, g, unknown or other
  misc_feature (242)..(242): n is a, c, g, or t
  modified_base (376)..(376): a, c, t, g, unknown or other
  misc_feature (376)..(376): n is a, c, g, or t
tcagtacgagtatgcacgaccggtgctcgatttagtgtagtgtgaagggaaaggggacccaacaaccacatccctcctgagaacgcccccagagcacaactccttaccatggactggacctggagatccttnttttggnggcagcagccacaggtcgccccacctcccaggtcccagtcttgtgcagtcgtgggctgaggtgaagagcgtgggctcgagtgtaacgtttcngacagtacttnggtactacctccttactactttagtttttctacttcctattggctcgccgccgaccggccccggaagaacgtgttacggaggtgggtggtagtggactacgaacgcgtagactaagtcgtactacgaataaatntacagagtaagtgacgaggctagacgtacaactagttacgacggactacgactaccggacgaacgtaacacgtactaagagtaggacgacgtacgaaggtacctaagtcccgtaagtacttaagtaccgtaaggaaaccgtaccggtaacggtttcgttaagttaaacgtttaacgtaccggtttagggtacggttacgggtaaggttacgttcgtaacgggttagggttacgggtaaaccggtttcccgtttaaccgtttaaacccgtttaaccttaaaccgtttaaccgttaacgttaacggaggtttaacccggggtaccgtttaacccgggggaaaccggggg

SEQ ID NO: 62345 - DNA, 596 bp, Homo sapiens
  misc_feature: GYAE6OF01BDBN4.18.70.G04.1.454.CMB.1.raw
  modified_base (180)..(180): a, c, t, g, unknown or other
  misc_feature (180)..(180): n is a, c, g, or t
  modified_base (454)..(454): a, c, t, g, unknown or other
  misc_feature (454)..(454): n is a, c, g, or t
  modified_base (492)..(492): a, c, t, g, unknown or other
  misc_feature (492)..(492): n is a, c, g, or t
  modified_base (522)..(522): a, c, t, g, unknown or other
  misc_feature (522)..(522): n is a, c, g, or t
tcagtacgagtatgcacgaccggtgctcgatttagtgtagtgtgaagggaaaggggacccaacaaccacatccctcctgagaagcccccagagcacaactccttaccatggactggacctggaggatccttctttttggtggcagcagccacaggtgcccactcccaggtccagcttgtncagtctgggctgaggtgaagagcgtggggcctcagtgaaggtttcctgacaagtacttctggataccttccttcacttagtttttctatcctattggctgcgcccgacggccccggaacaacggtcttggaggtggggtgggatgggactcgaacgtcgtcgtacaagtggtctacaaactaaaatattcaacagtaagttgcgtaagggcagacgtacaactattaacgaggaacacacgaccgagaacgaacacgacctaacagtaggacgngtagacgcacgacctagatatcgtagaacgcgaccggntagtaattacgttatggtcgacggtaggtnttcgacgtaggttaggagtacgttacttaactacgttaactacttactaacagtacgtaccggtggtaacgggg

SEQ ID NO: 62346 - DNA, 786 bp, Homo sapiens
  misc_feature: GYAE6OF01APQL3.18.70.G04.1.454.CMB.1.raw
tcagtacgagtatgcacgaccggtgctcgatttagtgtagtgtgaagggaaagggaccaacaaccacatccctcctgagaagccccagagcacaactccttaccatggactggacctggaggatcctcttttggtggcagcagccacaggtgcccactcccaggtccagcttgtgcagtcgtggggctgaggtgaagaagcctggggcctcagtgtaacggtttcctgacgaagtacgttctggactaccttcctttcaccttaggttttttctactcctattcggtcgttcgccgcccgtaaccgggccccccggaacgaaaacgggtccttaggaagggttgggggtagggtagtacgggtattaccgaaaccgtcgttggttacgaaagttcgggttacttaccgaaaactaaaacttaagtttacaaaccgtaaggtaaaggtttcgacggtaagggtaccgaaggtaacgttacccgtaaaccgtaaagttttaaacccgaacgggggtaaaccaccgtaaaacgttccccgggaacgaacgtaaaccgaaccgtacccttaacgaacggttagggaacgaccgttagggaaacgaccgggtaacgtacccgttagtaagttaacctaccggttagaaaacgggtccgaaacgggtacttacgggttaattacgttaacttcggtaacggtcggaagttacgtagtccgagggtagtacggtactttccgttaacacgttaactacttaactaacgtagttacggacgttggtaaccgggg

SEQ ID NO: 62347 - DNA, 612 bp, Homo sapiens
  misc_feature: GYAE6OF01CEA59.18.70.G04.1.454.CMB.1.raw
  modified_base (353)..(353): a, c, t, g, unknown or other
  misc_feature (353)..(353): n is a, c, g, or t
tcagtacgagtatgcacgaccggtgctcgatttagtgtagtgtgaagggaaaggggacccaacaaccacatccctcctgagaagcccccagagcacaactccttaccatggactggacctggaggatcctcttttggtggcagcagccacaggtgcccactcccaggtccagcttgtgcagtctgggctgaggtgaagagcctggggcctcagtgaagtttcctgcaagtacttctggatactccttcacttagtttttctatccattggctgccgccgacggcccccggagaaacggtcttgaggtgggtggatgggatcgaacgctgtacaagtggtactcaacgtaaatnttaccaacgagtaagttgcgagggcagacgtacaactacttacgacgggacactagtcccgagaacgaacacgcctacagtggacgtcgtgacgcacgtcctaggacttagttctaaggtaacgacgtaccgggtacttaggttaactttagttacgttgttcggacggtaaggtagttcggacgtaggtgggtacgttacgttaccttaaccttactaaccttactacgtacgtagtcgggtacgtcggtaaccgggg

SEQ ID NO: 62348 - DNA, 814 bp, Homo sapiens
  misc_feature: GYAE6OF01CI4KS.18.70.G04.1.454.CMB.1.raw
  modified_base (234)..(234): a, c, t, g, unknown or other
  misc_feature (234)..(234): n is a, c, g, or t
tcagtacgagtatgcacgaccggtgctcgatttagtgtagtgtgaagggaaaggggacccaacaaccacatccctcctgagaacgcccccagagcacaactccttaccatggactggacctggaggatccttctttttggtggcagcagccacaggtgcccactcccaggtccagcttgtgcagtcgtgggctgaggtgaagacgccgtggggcctcaggtgtaaggttttccngacaagtcttgtggtactacttccttacactttagttttctactcctattcggctcggccgaccgaccgggacccccggaacgaaacggtcgttaggtacgggttggggtaggggtacggtacggtaacgttaccgaaaccggtcgttacggtacgtaacgttcgggttaccttaccaaaactaaaattacttacaacgtaaggtaagttcggacgacggggaccaaggtacgtaccgtaacctaacgtttaacggtaacgggaaccaccgtaacggtccccggaacggtaaaccgaacgtaaccggtacccttaacgaggttacggacgttaccgtaaggaccgacgtaccgtaccgtacgtaacgttactacgtaacggtaaacggcccgtaacggtaccgttaggttaacttacgtttacggttacgacgggttacggtacggtacgttaggtaccgtaggggttacggtaacggtttacccgttaaccccgttttaaccgttaaccgtttaaacccttaaccgtaaaccgttacgtaacggtttacggggttaccggttacggggtaaaccggggg

SEQ ID NO: 62349 - DNA, 709 bp, Homo sapiens
  misc_feature: GYAE6OF01C5FBA.18.70.G04.1.454.CMB.1.raw
  modified_base (314)..(314): a, c, t, g, unknown or other
  misc_feature (314)..(314): n is a, c, g, or t
tcagtacgagtatgcacgaccggtgctcgatttagtgtagtgtgaagggaaaggggacccaacaaccacatccctcctgagaagcccccagagcacaactccttaccatggactggacctggaggatccttcttttggtggcagcagccacaggtgcccactcccaggtccagcttgtgcagtcgtggggctggaggtgaagaagccgtggggcctcgaggtgtaagggtttcctgaccaaggtacttcgtggatacctccttacgtacttagtttttctatcctaattggctgcgtccacggtcccccggaanaaacggcttgaggtgggtgggatggatcgtaacgctggtcaagtggtactcaaactaaaattacgtcaagtagaacgtttgacgaaggggtccaagtaacggtccaacctaattacgtaacgggacaactacgtccgacgtaacggaacacggacctaacgaagttcggagtcgtagaggactaggtaccctaggtacttacgttcgtaacggaaacgtaaccgaacgggtacctaggtttaaacgttacttttaaccgtaggttagtaccgggttaaggaagttttccggaggttaacgggtagggaacgttacggtttaaccccttttaacgtaaccctttaacttaacctaaccgttaactagttaccgggtacgttaccgggtaacggggg

SEQ ID NO: 62350 - DNA, 597 bp, Homo sapiens
  misc_feature: GYAE6OF01AOXUS.18.70.G04.1.454.CMB.1.raw
  modified_base (282)..(282): a, c, t, g, unknown or other
  misc_feature (282)..(282): n is a, c, g, or t
  modified_base (293)..(293): a, c, t, g, unknown or other
  misc_feature (293)..(293): n is a, c, g, or t
  modified_base (349)..(349): a, c, t, g, unknown or other
  misc_feature (349)..(349): n is a, c, g, or t
tcagtacgagtatgcacgaccggtgctcgatttagtgtagtgtgaagggaaaggggacccaacaaccacatccctcctgagaagcccccagagcacaactccttaccatggactggacctggaggatcctctttttggtggcagcagccacaggtgcccactcccaggtccagcttgtcgcagtctggggctgaggtgaagaagccgtggggcctcagtgaaggtttcctgcaagacttctggatactccttcacttagtttttcatccattggctgcgccncggcccccganaacggcttgaggtgggtgggactggatcgaacgctgtcaatggtctacaacaaatnttcacagtaagttgacgagggacagacgtcacctagttactaggacacatccgagagaacaggcctagagtcggaagtctacgagctacggcctagactagtcgtaggaaacgacgacggtactagttaacttacttacgtgtaggtaccgaggtacttggacgtaggtacgggtacgttagttaccctttacctaaccgttaaccttacgttaaccgtactaggtacgggtaccgtggtaaccgggg

SEQ ID NO: 62351 - DNA, 792 bp, Homo sapiens
  misc_feature: GYAE6OF01DGQ7Y.18.70.G04.1.454.CMB.1.raw
tcagtacgagtatgcacgaccggtgctcgatttagtgtagtgtgaagggaaaggggacccaaacaaccacatccctcctgagaacgcccccagagcacaactccttaccatggactggacctggaggatccttctttttggtggcagcagccacaggtcgcccactcccaggtccagtcttgtgcagtcgtggggctgaggtgaagagccgtggggcctgagtgtaacggtttctgcaagtacttcgtggtatacctccttactactttagtttttactatcctattggcttcgcgccgacggcccccggaacaaaggtcttaggagtcgggtgggatggatacgaacgcttgtactaagtcggttactacaaaactaaaaattactttaacaactaaggaaagtttggacgaagggtacaaggacgttaccaaccgttaattaaccggtaagggacctaacgtaccgttacccggacggaaacgtaaaccaccggtaccctaacgtaacgtagggtaccggtacgtaggacgaccaacggtacccgtaggtaactttacgttaacgaggtaaaccgaacggtaaccgggtacctttagggttaaactttaagtttaccggttaggttaacgggacggttaacggggttaattacgggaacgtaggggttaagggtaaccgtttaaccggtttaccccgtttaaaccgttaacctttaaacccggttaaaccgtttaacgttaaaccttaggggtttaaaccgggtaccgggtttcgggtaaaaccgggggg

SEQ ID NO: 62352 - DNA, 550 bp, Homo sapiens
  misc_feature: GYAE6OF01BK1NM.18.70.G04.1.454.CMB.1.raw
tcagtacgagtatgcacgaccggtgctcgatttagtgtagtgtgaagggaaagggacccaacaaccacatccctcctgagaagcccccagagcacaactccttaccatggactggacctggaggatcctctttttggtggcagcagccacaggtgcccactcccaggtccagcttgtgcagtctggggctgaggtgaagaagcctggggcctcagtgaaggtttcctgcaagacttctggatactccttcacttagtttttctatcctattggctgcgccaggcccccggacaaaggcttgaggtgggtgggagtggatcgaacgctgtcaagtggtctacaacaaaatattacacagaagttgcagggcagatcactatactagggacacatcgacgagaacacgcctaacatggagctgagcagcctgatactctagaagacacggctagtattattacgtggtgacggtaggtattgacgtaggtggaaggtacttacccttactaacttacttaactactacagttcggacggttcgtaacggggg

SEQ ID NO: 62353 - DNA, 873 bp, Homo sapiens
  misc_feature: GYAE6OF01BFT22.18.70.G04.1.454.CMB.1.raw
tcagtacgagtatgcacgaccggtgctcgatttagtgtagtgtgaagggaaaggggacccaacaaccacatcccctcctgagaacgcccccagagcacaactccttaccatggactggacctggaggatccttcttttggtggcagcagccacgaggtcgcccacctcccgacggtccagtcgttgtgcctaggtccggtggggtctggagggtgaagacggccgtggggcctcgagtggtacggtttcctgactaacgtacttcgtaggtacttacctccttatacgtttagtttttacacgttctagttcggtctcggccgccgtaaccgggcccccgaacgtaaggtccgtggtaggtcggggtggtacgtggtactcgtaaccgtcgtacgttaccgtaagtcggtacctaactaaaacgttaaaacttacttaccgaaaggtaacggttaacggttacgacggagggtaacgaggtaacgtaccgtaaacctaacgtttaaaccggaacgggaaccgtaccgtaacggttacccggaacggtaacgaaaccggtaccgtaacccggtaacgtaacggggttacggaaccgtcggtaaggaaccggtccgtaaacggcccgttaacgtaacgttaacgtacggtaaacgggtaactacccggaccgttaacggtttaaccgtaagtttttaacgtaccggttgggtaacggtaccggttaaaggtccgggttaagtaccggaaacgggttttaggggaaccgtttaccgtttaaacccccgttaagtttaaacccccttaaacgggttaacccttaaccggttactaaggggtacccggttaccgggttaaaccggggaaacccggggg

SEQ ID NO: 62354 - DNA, 745 bp, Homo sapiens
  misc_feature: GYAE6OF01E1NQS.18.70.G04.1.454.CMB.1.raw
tcagtacgagtatgcacgaccggtgctcgatttagtgtagtgtgaagggaaagggacccaacaaccacatccctcctgagaagcccccagagcacaactccttaccatggactggacctggaggatccttctttttggtggcagcagccacaggtgcccactcccaggtccagcttgtgcagtcgtggggctggaggtgaagagccgtgggcctgagtgtaaggtttcctgacaagtcttctggataccttccttcactttagtttttctattcctattggcttcgccgccgacggacccccggacgaaacggtcgttggaggtggggttacggggagtggtatacgaaacgcgttcgtactaacgtggtacctacaaacgtaaaaactacttacgacgaagtaacggttgcgacggggtacaggtacggtaccgtaaccgtaagtttaaccggtaagggaacctaaacgtaccgtaccccggacggaaacgaaaccgtaacggtaccccttaacgacggttacgggaacggtacgttaggaacgccgtaacgtccgtaggtaaacttacgttcgtaaaggaaccgtaacgaaccggtaccgtttaacgttaacgttaacttacgtttggtacggtaggtacgggtattacgggagtacgggtaggtaacgtaggttaccctttacgttaaccttaacgttacctaacttacgaagttaccgggtacggtccggtaaacgggggg

SEQ ID NO: 62355 - DNA, 910 bp, Homo sapiens
  misc_feature: GYAE6OF01A41TX.18.70.G04.1.454.CMB.1.raw
  modified_base (243)..(243): a, c, t, g, unknown or other
  misc_feature (243)..(243): n is a, c, g, or t
tcagtacgagtatgcacgaccggtgctcgatttagtgtagtgtgaagggaaagggacccaacaaccacatcccctcctgagaacgcccccagagcacaactccttaccatggactggacctggagtactccttctttttggtggcagcagccacgaggtcgacccactcccgagtccagtcttgtcgctagtcgtgggtctgaggtgaacgacgtccgtcgggcctgagtcgtaacgtttccngacgtagtacgttcgacgtactaccttccttacttactttacgttttaccacttacgttagttcggctcggaccgcccgtacccggtacccgaacgtaacggtcgtaggtgggtcgggtgggacgtaggactaccgaagtcgtacgtactagttcggtacctactaattaaacgtcttacgacgtaaggttagtcggacgtacggtacgtagtacccgtaactaccggtttaaccgtacggtaaccggtaccgtaacccgtaaccgtacccggtaacggtaaaccgaacccggtaccggttaccccgttaaaggtaccgggttaacgggacccgttacggtaacgggaaccggttcccgtaaccggttaacccgttacgttaaacgttccggtaaaccggttaacggaaaccccgtttcgggtaaccccgtttagttaacccgggttttaacctttaacgttaccggtttacgggttaacgggtacccggttaagtttaccgttaacggggtttcccgggttaacgggtacggttttaaacccgggttacccttttaaaccccgtttaacggttaaaccccgtttaccgttaaacccgtttaacggttaaccggttaacggggttaacccggttttaacccgggaaccgggggtttaaaccccgggg

SEQ ID NO: 62356 - DNA, 898 bp, Homo sapiens
  misc_feature: GYAE6OF01DZXZE.18.70.G04.1.454.CMB.1.raw
  modified_base (212)..(212): a, c, t, g, unknown or other
  misc_feature (212)..(212): n is a, c, g, or t
tcagtacgagtatgcacgaccggtgctcgatttagtgtagtgtgaagggaaaggggacccaacaaccacatccctcctgagaagcccccagagcacaactccttaccatggactggacctggagatcctctttttggtggcagcagccacaggtgcccactcccaggtccagcttgtgcagtctggggctgaggtgaagagccgtgggcctnagtgaaggtttcctggacaagacttcgtaggtactaccttccttctaactttagtttttcacttcctattcgggtctggaccgtcccgacgggtccccccgggaacctaaaacgggtccttaggaaggttgggggtcggggtaagttgggacttaccggaaccggtccgttaggttactaacgttagggtaccttaacaaacctaaaaaacttagtttaaccgaacgtaacggtaaacggtttcgaacggaaacgggggtctaaacgggtacgtaaccgtaacccgtaaacgtttaacgtaaaccgggggtaaacctaaccgtaaccgttacccgggaccgggtaaaacgaaacccggtaaaccggtacccctttaaacgaacggggtttacgggaacgtaccgtttacgggaaccgacccgtaaccggttaccccgtaagggtaactttaaccgtaccggttaaacggaaaccgggtaacccgaaccggggttacccgtttaagtttaacgttaaacgttttaccggttaaggttacgggtaacggttaacgggtaacgtttcggaccggtaacgggttagggaaaccggttacgggtttaacccctttaccggttaaaccttaaaccttaacccgttaaaccgttacgtaaggttaccgggtaacggttccgggtaaaccgggg

SEQ ID NO: 62357 - DNA, 806 bp, Homo sapiens
  misc_feature: GYAE6OF01B4UC3.18.70.G04.1.454.CMB.1.raw
  modified_base (239)..(239): a, c, t, g, unknown or other
  misc_feature (239)..(239): n is a, c, g, or t
tcagtacgagtatgcacgaccggtgctcgatttagtgtagtgtgaagggaaaggggacccaacaaccacatccctcctgagaacgcccccagagcacaactccttaccatggactggacctggaggatccttctttttggtggcagcagccacaggtgcccacctcccaggtccagcttgtgcagtcgtggggctggaggtagaagaaggccgtggggcctgaggtgtaacggtttccngactaagtacttcgtggtactacttccttctacgtttagtttttctactacctagttggtctcggccgaccgtaccggggaccccccggaacgtaaacgggtccgtttgggagggttggggggtagggtaggtagggtacttacgaacggtcttagttacgtaagtcgggtacctactaaactaaaacgttacttaaccgaacgtaaggtaaggtttacggacgtaggggacgaagtaacggtaccctaaccgtaagtttaaaccggtaacggggaaacctaaccgaaccgttacccggaacggaaaccgaacgtaacgtaccccgtaacgaaggttccgggaaggttcgtaaggaccggtaccgacgtacccgtaagtacgtaagttccgaaggtaacgaaccgtcgggtaacgttagttaacgtttacgtttccgtaggtacggacgtaacgggttagttcggaccggttagggtacggagttaacccgttacctttaaccgttacttaaaccgtttacccttaacgtaacgtacggttacgggtccggttaacgggtaacgggg

SEQ ID NO: 62358 - DNA, 727 bp, Homo sapiens
  misc_feature: GYAE6OF01DJJ4G.18.70.G04.1.454.CMB.1.raw
  modified_base (289)..(289): a, c, t, g, unknown or other
  misc_feature (289)..(289): n is a, c, g, or t
tcagtacgagtatgcacgaccggtgctcgatttagtgtagtgtgaagggaaagggacccaacaaccacatccctcctgagaagcccccagagcacaactccttaccatggactggacctggagatccttcttttggtggcagcagccacaggtgcccactcccaggtccagcttgtgcagtctggggctgaggtgaagaagcctggggcctcgagtgaggtttcctgcaagacttctggatactccttcactagttttctatctattggctcgcgccacggccccgganaagcttgaggtggtggagtgatcacggtctgtcaagtggtactacaacgtaaaatattacacaagtaagttcgcgtaaggggcagtagtacaaccaagttacggtaagggaactaaccgactccggacgtaacgaaaccacggtacccttaacgacgttagggaacgaccgttaggaacggccaaggtcccgttaaggacttaacgttaccgtaaggaaaccggaacgtaaacccgggtcgttaacggttaatttaaacggtttacgttacgggttacggtacggttaacgggaacgttttacggacccggttaagggtcggggtaaaacgttaccggtttaacccgtttaaaacccgtttaacccgttaacttaaaacccgtttacctaaacggttaaggtttacggggtaaaccggttcgggtaaacccggggggg

SEQ ID NO: 62359 - DNA, 787 bp, Homo sapiens
  misc_feature: GYAE6OF01AO90G.18.70.G04.1.454.CMB.1.raw
  modified_base (313)..(313): a, c, t, g, unknown or other
  misc_feature (313)..(313): n is a, c, g, or t
  modified_base (530)..(530): a, c, t, g, unknown or other
  misc_feature (530)..(530): n is a, c, g, or t
tcagtacgagtatgcacgaccggtgctcgatttagtgtagtgtgaagggaaaggggacccaacaaccacatccctcctgagaagcccccagagcacaactccttaccatggactggacctggaggatcctcttttggtggcagcagccacaggtgcccactcccaggtccagcttgtgcagtctgggggctggaggtgaagaacggcccgtagggggccctcgaggtgtaaagggttttccctgaccgaagaccttctggtatacctccttcaacttagtttttcatccattggctgcgccacggccccgganaacggcttggaggtcggggtgggatggactcgaaaccgtcgtagtacaagttcggtacctaccaaaactaaaaactaatttccaaacgtaaggtaaacgtttcggaacgtaaggggaccgtaaggtaacgtaccaacccgtaagtttaaccgtaaacggggaacctaaccgaacggttacccgggaccgaaacggtaaaccgacgtaaccccgtaanaaggttacggaacggtcgtacggaacgaccgacgcctaggtacttactacgtaggaaacggtaaccgacggtaccgttaaggtaactttagtttaacctgggtaaccgtaccgggtaaggttacgttagggaaccgtagggtaacggtacgggttaacccgttttaacgttacccgttaaaccccgtttaacttaaacgttaacccgtaaacccgtaagggtttacccgggtaagggttccgggttaaaccgggggg

SEQ ID NO: 62360 - DNA, 816 bp, Homo sapiens
  misc_feature: GYAE6OF01ER4NM.18.70.G04.1.454.CMB.1.raw
  modified_base (333)..(333): a, c, t, g, unknown or other
  misc_feature (333)..(333): n is a, c, g, or t
tcagtacgagtatgcacgaccggtgctcgatttagtgtagtgtgaagggaaaggggacccaacaaccacatccctcctgagaacgcccccagagcacaactccttaccatggactggacctggaggattccttctttttggtggcagcagccacaggtgcccactcccaggtccagcttgtgcagtcgtggggctgaggtgaagagccgtgggcctcgagtgtaacggtttcctgacgtaagtacttcgtaggacttaaccttccgtttactacgttttagttttttctattccctagttcggtcgtcgtcgacccacgggtacccccggaanaaacggtcgttaggagggtgggggtacgggtagtacgggtaacgtcgaaccgcgttcgtacgtaaggttcggtactactaaactaaaacttattaccgaagtaacggtaagttaggacgacggggtaccaagggtaacgtaccgtaaccgtaacgtttaaccggtaaacgggaaacctaaccgtaaacggttaccccgggaccggtaaacggaaacccgtaacggtaccccgttaacgttaacgttacggggaaccgtcggttaacggaacggttaccaacgccgttaagtacttaatacgttaaggaaccgtacggtaccgggttacttacgtttaacgttaatttaccggtaggtcggacgtaggtagtttacggacgtagggttcggtaaccggtaggtttaacccttacgttaaacccttaacgttaaaccgtaccttaaacgtagttaacggggttacccgttcggggtaaaccgggg

SEQ ID NO: 62361 - DNA, 705 bp, Homo sapiens
  misc_feature: GYAE6OF01CC7BD.18.70.G04.1.454.CMB.1.raw
  modified_base (243)..(243): a, c, t, g, unknown or other
  misc_feature (243)..(243): n is a, c, g, or t
  modified_base (352)..(352): a, c, t, g, unknown or other
  misc_feature (352)..(352): n is a, c, g, or t
  modified_base (493)..(493): a, c, t, g, unknown or other
  misc_feature (493)..(493): n is a, c, g, or t
  modified_base (663)..(663): a, c, t, g, unknown or other
  misc_feature (663)..(663): n is a, c, g, or t
tcagtacgagtatgcacgaccggtgctcgatttagtgtagtgtgaagggaaaggggacccaacaaccacatccctcctgagaagccccagagcacaactccttaccatggactggacctggagatcctcttttggtggcagcagccacaggtcgcccactcccgaggtccagtcttgtgcagtcgtggggctggaggtagaaggaacggccgtggggcctcgtaggtgtaacgggttttcccngactaaggtacctttcgtaggtaactaccttccttacttaaccgtttagtttttcctaacttcctaagtttcggtctcggtacccgcccgaaccgggacccccggtaanaaacgggtccgttaggaggtgggggtaggtagtacgacgtacgtaacgcgtacgtacgtaagtcggtactacaagtaaactattacacgtaagtagttcgacggtaggacgacgagtacaacctaataccgagggacaacncgtaccgacggtaacaacgcgtaccctaagtaggagacgtacgtacgacgtacaggacctggtaactagtcgaagaacgtacgcggttactagttactagttcgtagtcggaggtacgtaagttcggagtaacggttacggcgtacctttaacgttactacgttaacctnttaacccgaagtttaggtcccggtaaggtcgggtaaaccggg

SEQ ID NO: 62362 - DNA, 887 bp, Homo sapiens
  misc_feature: GYAE6OF01D20KZ.18.70.G04.1.454.CMB.1.raw
  modified_base (140)..(140): a, c, t, g, unknown or other
  misc_feature (140)..(140): n is a, c, g, or t
tcagtacgagtatgcacgaccggtgctcgatttagtgtagtgtgaagggaaaggggacccaacaaccacatccctcctgagaacgcccccagagcacaactccttaccatggactggacctggagatccttctttttggnggcagcagcccacaggtcgcccactcccaggtccagtcttgtgctagtcgtggggctggaggtagaagtacgccgtcggggcctcgaggtaggttaacggtttcctaggaccgtaagtaccgttcgtaggtaccttaccttccttactacgttttacgtttttactaacttccttaggttcggtcgttccgacccgtacccggaacccgggaccccccggtaaagtaaacgggttccgttagggtacggggttggggggttagggacggtacgggtaacttaccggtaaccggtcgttacggtaacgtaacggttcggtacctaactaaaaaccgtaaaacgtttactaacgtaacgtaaaggttacgttcggaacggacggtaacgaaggtaaccgtacctaaccgttaagttaaccggaacggacctaacgtaaccgtacccgggaacgaaacggaacctaccgtacccgttaaggaacggttaccgggactacggtacggaaacgtccggtaaccgttaccgtaaggttaaccttaacgtaaccgtaacgggaaaaccggtaccgttaaccgggttaatttacggtttaaattaccggttttaacggcggttaacgggtagggtaacctaggttacggaggtacggtacggggttaaacctacgttttaacccgttaattaaacccgttaacttaaccggttacaacggttacggttacgggttcgggtacgggaaacccgggg

SEQ ID NO: 62363 - DNA, 862 bp, Homo sapiens
  misc_feature: GYAE6OF01EJ00S.18.70.G04.1.454.CMB.1.raw
tcagtacgagtatgcacgaccggtgctcgatttagtgtagtgtgaagggaaaggggacccaacaaccacatccctcctgagaacgcccccagagcacaactccttaccatggactggacctggaggatccttctttttggtggcaggcagccacgaggtcgcccacctcccgaggtcccagtcgttgtcgctagtcgtgggctggaggtgaagacgcgtcggggctcgagtagtacggttcctgactaacgtcttcgagtacttaccgttccttacttacgttttacgtttttacctacttccgttacgttcggtcctcggtacccggacccggtaccccgggaacccccggtaaaggtaaaccggtcgtttacgggaggggttggggggtacgggtaaggtcgggtaaaccgtaccgtaaaccggttcgttacggtaaccgttaggttccggttaaccctaacgaaaaacgtttaaacttacgttaacgaacgtaaggttaacgttcggacgggaacgggtacgtaaggtaccgtaaccctaccgtaagttaaccgggtaacggaacctaaccgttaccgacccggaaacgtaacggtaacccgtacccgtaacccgtaaggtaaccgggtcgggtaacctaaggttacccggaacgtacccgtacggtactaacggtaactttaccgtaacgtaacgggaaccgtacggacccgtttataacggttttactaacggtttgaggtaccggtaaggtaggttacgtagtcggtaaggtacggtacgtttacctaacgttaccgttaaccgttaccttaaccgtacttacggtaccggtggtacccgggtaggtaacccgggg

SEQ ID NO: 62364 - DNA, 634 bp, Homo sapiens
  misc_feature: GYAE6OF01CUC4L.18.70.G04.1.454.CMB.1.raw
  modified_base (288)..(288): a, c, t, g, unknown or other
  misc_feature (288)..(288): n is a, c, g, or t
  modified_base (407)..(407): a, c, t, g, unknown or other
  misc_feature (407)..(407): n is a, c, g, or t
tcagtacgagtatgcacgaccggtgctcgatttagtgtagtgtgaagggaaaggggacccaacaaccacatccctcctgagaagcccccagagcacaactccttaccatggactggacctggagatccttcttttggtggcagcagccacaggtgcccactcccaggtccagcttgtgcagtctggggctgaggtgaagagcctggggcctcagtgaaggtttcctgacaagacttctggatactccttcacttagttttctatccattggctgcgccaggccccganaaaggcttgagtgggtggatggatcaagctgtcaatcggtctcgaactaaaatattacaacaagtaagttgacgtagggcagacttcaacctaattacgtaacgggacacgataccggngtaacgaacagcctaacattaggagtactggagtacgaacggtcctggaacttagtctaggaaacgtaccgaacgggtacttaggtaacttagtttaacgtcggttaggtaccggtaagggtacgtttcgaccgtaggttcgggtaacgtacgtttaccctttaaacttaacccgttaactaccgttaaacctacctaagttacgggtaaccgtggttaaccggggg

SEQ ID NO: 62365 - DNA, 757 bp, Homo sapiens
  misc_feature: GYAE6OF01DOK3A.18.70.G04.1.454.CMB.1.raw
  modified_base (238)..(238): a, c, t, g, unknown or other
  misc_feature (238)..(238): n is a, c, g, or t
tcagtacgagtatgcacgaccggtgctcgatttagtgtagtgtgaagggaaagggacccaacaaccacatccctcctgagaacgcccccagagcacaactccttaccatggactggacctggaggatccttcgttttttggtggcagcagccacaggtcgcccacctcccgaggtccagcttgtgcagtcgtgggctggaggtgaagaagccgtgggcctcgaggtgtaaggtttccngacaagtcttctggataccttccttactactttagtttttctacttcctagtttggctcggccgccgaccggacccccggaagtaaacggtcttggaggtggggtagggagtggacgtacgaacgcgttgtactaagttcggtactactaaactaaaatacttacgaacgtaagtaaacgttcgacgtaaggggcaagtacgtacaaaccgttaacgttaaaccggtaacgggaaactaaccgaacgttacccggaacggaaacgaaccgtaaccgacccgttaaacgaggttacgggacgacgttaggacgtaccgacgtccgtaagtaagttacgtaacggtagaacgtaaccggtacggttacttaagttaacgtttaacgttaacggttggtacgaacggttaggttaccgtaggaccgtaagggttaacggtaacggtaccgtttacccttaacgttaaccttaacgttaacctaacggtactaaggttcgggtaacggtcgggtaaaccgggg

SEQ ID NO: 62366 - DNA, 917 bp, Homo sapiens
  misc_feature: GYAE6OF01C4TYP.18.70.G04.1.454.CMB.1.raw
tcagtacgagtatgcacgaccggtgctcgatttagtgtagtgtgaagggaaagggacccaacaaccacactccctcctgagaacgccccagagcacaactcctaccatggactgacctggagatccttcgttttggtggcagcagccacaggtcgcccacctcccgaggtcccagtcttgtagctagtcgtggggctggaggtgaagacgccgtgggcctcgagtgtaacggtttcctagactaagtaccttcgaggtactaccttccttacctaacgttttacgtttttacctacttccgttagttcgggctcggcccgaccgacccgggtacccccggaagaacggttccgttggtacggggtggggtagggacgtaggtactaccgaacgtccgtcggtaactaacgtttcggtacctaacctaaacgttaaaaacttacgttaaccgaaacgttaaggtaaaccggtttggaacccgggtaagggaccgttaacggtaaccgtacccgtaaaccgtttaacgttttaaacccggaacggggtaaaccctaacccggtaaacggttaccccgggtaaacgggaacctaaacccgacggttaaacccccgttaaaggtacggtaacgggtaccggtaaccgttaggaaaccggcccggtaacgttaaccgtaacggttataacgtttaccgaacgtaaaccgacgtaccggttacgtaaggtttaaacttacgtttaccggtaggtaccgacgggtttaaacggtattccggtaaccggtaaagggttaccgggttaacgttaacccgttttaaacccctttaaaccgtaacccgttttaaacgttaaacctttaacccgggttaacgttaagggttcccggggtttaaccggtaacggggttaaacccgggggg

SEQ ID NO: 62367 - DNA, 936 bp, Homo sapiens
  misc_feature: GYAE6OF01CJGYQ.18.70.G04.1.454.CMB.1.raw
tcagtacgagtatgcacgaccggtgctcgatttagtgtagtgtgaagggaaaggggacccaacaaccacatccctcctgagaagcccccagagcacaactccttaccatggactggacctggagatcctcttttggtggcagcagccacaggtgcccactcccaggtccagcttgtgcagtcgtgggctgaggtgaagagccgtggggcctcagtgaaggtttcctgcaagacttctggatactcttcacttagtttttctatcctattacggtctggccgtcccgacgggtaccccccggaactaaaacgggcgtttaggacggttcgggggtggggtagttcggggaacttccgaaaccggtccgttcggtactaaacgtgggttacctaaccgaaaactaaaaacgttacgtttacgaaaaccgtaaggtaaaggtttacggaaccggtaagggggtactaaacgggtaacggtaccgtaaacccgtaagttttaaacccggtaacggggaaaccgtaaaccgtaacggtacccggttaacggaaaccggtaaaccgtaaccggtaacccctaacgtaacgttaggggaaccgtacggttaacgggaagtaccgtaaaccggtcccgttaaggaacgtttaacggttaccccgtaaagggtaaaccgtaaaccggtaacggtacccggtttaaaggttaaacgttttaaccgtttaacggtttacggttaaccggggacggttaaaaccgggtttaaggttaccggttaacccggtaaggggtttaacggggtaacgggtttaacccgggtttaaacccgttttaaaccggtttaaccccgtttaaaacgtttaaacccgttaaaacccttaaccgggttaagtttaaacccgggggttacccggttaaaccgggggtttaaacccggggggg

SEQ ID NO: 62368 - DNA, 795 bp, Homo sapiens
  misc_feature: GYAE6OF01DJGH6.18.70.G04.1.454.CMB.1.raw
  modified_base (297)..(297): a, c, t, g, unknown or other
  misc_feature (297)..(297): n is a, c, g, or t
tcagtacgagtatgcacgaccggtgctcgatttagtgtagtgtgaagggaaagggacccaacaaccacatccctcctgagaagcccccagagcacaactccttaccatggactggacctggaggatccttctttttggtggcagcagccacaggtgcccactcccaggtccagcttgtgcagtcgtggggctgaggtgaagagcctggggcctcagtgtaaggtttcctgcaagtacttcgtggactacctccttcacttagtttttctatcctattggctgcgccacggccccganaaggcttagaggtgggtggagtggatcgaacgtctagtactaagtcggtctacaaactaaattacttacaactaaggtaacgtttacggacgtaggggaccaaggtaacgtacctaacccgtaagttaccggttaacggggacctaacgtacgttacccggaacggaacgtaaaccaccggtaaccttaaccgtaacggttacgggacgtaccgttagggaccgaccgtacggtacccgttagtaacgttaacgttaccggtaacggaaacggtaacccggtaaccgggttacgttaacggtttaacgtttaacgtttacggttagggttacgggtaccggtaaagggttacgtttacgggaccggttaagggttacgggaacggtttacccggtttaaccctttaaccgttaacccgtttaaacccgtttaacgttaaacccgttaacggtaccggtttaccggggttaaccgggttcgggttaaaaccccgggggg

SEQ ID NO: 62369 - DNA, 826 bp, Homo sapiens
  misc_feature: GYAE6OF01BG5BD.18.70.G04.1.454.CMB.1.raw
tcagtacgagtatgcacgaccggtgctcgatttagtgtagtgtgaagggaaagggacccaacaaccacatccctcctgagaacgccccagagcacaactccttaccatggactggacctggaggatccttctttttggtggcagcagccacgaggtcgcccactcccaggtccagtcttgtgcagtcgtggggctggaggtagaaggaagccgtggggcctgagtgtaacggtttcctgactaagtcttgtacggtactaccgttccttctactttagtttttcctatcctagttcggtctcggtcccgcccggtaccggacccccggaacggtaaacggtccggttacggggtacgggttaggggggtcggaaggtcgggactacgaccgtcgtagacgtaagtcggtactaactaaactaaaattcttaaccgaacgtaagtaacggttcgccggaagggacaacggtaccgtaacccgtaacttaacgttaacggtaacggacctaacctacggtacccggtaacgaaacgaaccgaaccgtaccgttaaacgagggttacgggacgttacgacggaaccctcggaaccggttacctaagtaaccttgtaccgtaagaaaccggtaacgtccggttacttaacggtttaaacttaccgtttaggttacgggtaccgggtaggtaaggtaggtttaacggcgggtaaagggtttacggaacggtttaacccttaccgttttaaaccgtaaaccctttcccggaaactttaaccggttaccgtaaaggggtttacccggacgggttaacgggtaaaccccggggg

SEQ ID NO: 62370 - DNA, 834 bp, Homo sapiens
  misc_feature: GYAE6OF01EX3SM.18.70.G04.1.454.CMB.1.raw
  modified_base (156)..(156): a, c, t, g, unknown or other
  misc_feature (156)..(156): n is a, c, g, or t
  modified_base (180)..(180): a, c, t, g, unknown or other
  misc_feature (180)..(180): n is a, c, g, or t
  modified_base (257)..(257): a, c, t, g, unknown or other
  misc_feature (257)..(257): n is a, c, g, or t
  modified_base (700)..(700): a, c, t, g, unknown or other
  misc_feature (700)..(700): n is a, c, g, or t
tcagtacgagtatgcacgaccggtgctcgatttagtgtagtgtgaagggaaggggacccaacaaccacatccctcctgagacgccccagagcacaactccttacagtggactggactggagatcctcgttttggcgctagcacgcctacgaggtcncccactcccaggtccagtcttgtnctagtcgtaggggctaggaggtgaaacgtacgtccgtaggggtcccctacggtaggttacggaacggggtttttccncggtaacctaaaggttacccgtttagtacgggtaaccttaccttccctttacgtacgtttttacggttttttaccacttaccgtaagtttcggcctttaacggcccgttacccgtaacccggggacccccgtaaggtaacccggttggttaacggtagggttggggggttacgggacggtttacgaacgttaccggaccgttcgttacgtacgaaggtttccgtaccgtaaccaaaacttaaaactttcggttaaccaccggtaaagttacggtttaccgcgagggtaccgttaacgaaggtccctagttaacgtttacggacggtacacgtacgtaccggaagtactaaccggccgtaactaggtaggttaccggaagttcggtacggacgtaaccgggtcctacggtaattacggtacttacggaaccggttaagacccgnggttaaaccttggtaaactttcggacgttgaaccgggtacgggttaagtcggtactacgggaacgtttgggaacccttcggttttaaccactacccgtattacgtcgtaccagttcgggtacctgggtaaacgg

SEQ ID NO: 62371 - DNA, 979 bp, Homo sapiens
  misc_feature: GYAE6OF01B4TUN.18.70.G04.1.454.CMB.1.raw
tcagtacgagtatgcacgaccggtgctcgatttagtgtagtgtgaagggaaaggggacccaacaaccacatccctcctgagaacgcccccagagcacaactccttaccatggactggacctggagatccttcttttggtggcagcagccacaggtcgcccactcccgaggtccagtcttgtgcagtcgtggggctgaggtagaagagcgtggggcctcgagtggtaacggtttcctagacgaagtactttcgtacggtacttaccgttcctttactaacgtttttacgttttttacctaacttccgtaagtttcgggtcgtcgtcccgggaccccgtaaccggggaccccccgggaaacggtaaacgggtcgtttacggggtaaggggttggggggttacggggtaaggttacggggaacctttaccggaaaccggtcgttacggtaacgtaaacggtttccgggttaccttaaccgaaaacgttaaaaacttttaccgtttaacccgaaaacggtaacggttaaacggtttacgggaaccggtaaacgggggtacgttaaacgggttaccggtaacccgtaacccgtttaacgtttaaaccccgggtaagggtaacccccgtaacggtaaacccggtttacccgggaaaccggtaaaccgaacccggtaacccggttaaccctaacggaacggtacgggaacgtacggttagggaccacccggttacggtacccgtagtaactttaaccgtacgtaacgggaaccggtacgtacccgggttaagttacggtttaacgttaacgtttacggttacggttacgggaggttacgggttaaacgttcgggtaccggttaaggggtaacccggttacggtttaccgtttaaccccgttaaccgttaaccttttaaacccgtaaaccgtttaccttaacgggttacgggttaccgggttccgttaaccggggtaacccgggggg

SEQ ID NO: 62372 - DNA, 778 bp, Homo sapiens
  misc_feature: GYAE6OF01BJVIE.18.70.G04.1.454.CMB.1.raw
  modified_base (140)..(140): a, c, t, g, unknown or other
  misc_feature (140)..(140): n is a, c, g, or t
  modified_base (278)..(278): a, c, t, g, unknown or other
  misc_feature (278)..(278): n is a, c, g, or t
  modified_base (329)..(329): a, c, t, g, unknown or other
  misc_feature (329)..(329): n is a, c, g, or t
tcagtacgagtatgcacgaccggtgctcgatttagtgtagtgtgaagggaaaggggacccaacaaccacatcccctcctgagaacgcccccagagcacaactccttacatggactggacctggagactccttcttttggnggcagcagccacaggtcgcccactcccgaggtcccagtcttagtgcgtagtcgtgggctggaggtagaagacgtccgtggggcctcgaggtcgtacgtttccagacgtaagtctgtagtacttcctcttatacgtttnttttcatctcgtcgtctcgccgaccgaccggacccgagtacgtcgttaggngggttgggacggtagtacggtaccgtaacgcggtcgtaggtacctacggtcgtacctaactaaaacgtaaacttacgttaacaaggtaagtacggtacgacgggacgtacgtacgtacctaaccgtacgtaacgtaacggtaccggaacgtaccgtaaccgtacggaacgtaacgtaccgtacgtaccgtacgtacgtacggtaacgtacgtaacgacgtaccgtacgttacgagtacgtacgtaacggtaccgaacgtaccgggtaacttacggttaagttacttacggttacggttaggaccggtaggtaacggttaccggttaggaacggttaccggtaacgttaaccggttacccgttttaaaccgttaacccgttaacccgttaacgttaacccgttaaagggaccttagggttacccggttaaaccgggtaccggaaacgggg

SEQ ID NO: 62373 - DNA, 795 bp, Homo sapiens
  misc_feature: GYAE6OF01AD7KY.18.70.G04.1.454.CMB.1.raw
  modified_base (319)..(319): a, c, t, g, unknown or other
  misc_feature (319)..(319): n is a, c, g, or t
  modified_base (501)..(501): a, c, t, g, unknown or other
  misc_feature (501)..(501): n is a, c, g, or t
tcagtacgagtatgcacgaccggtgctcgatttagtgtagtgtgaagggaaaggggacccaacaaccacatccctcctgagaagcccccagagcacaaactccttaccatggactggacctggaggatccttctttttggtggcagcagccacaggtcgcccactcccaggtccagcttgtgcagtcgtggggctggaggtgaagagccgtgggcctcgagtgtaaggtttccagcaagtacttcgtggtacttaccttccttactacgtttagtttttcatcctagttcggctcggtccgccgaccggaccccggaanaaacggtcgttcggaggtcgggtgggtacgtggacgtccgaacgtcgtaggtactaagttcggtacctacgaaactaaaacttacgttacaacgtaacggtaaggttcgacgtacgggacaaggtacgtactaaccgtagttaacgaggacacgacgtccgacgaagtacacgtacctacgngtacggagtccgtagaacgtccgacgtacctgtaacttacggtacgtaacggtaacggaccgttacggtaccgtttaagttacgttaaaccgtttacggttagggttaccgtacgggtaagggtttacgttacggtaccgggttaagggtaacggtaaccggttaacccggttttaaccccgttaaccgtttaaacccgtttaaacccgtttaacccgttttaaacccggttaacggttaaccggggttaacgggtttaacccccgggggttaaggggttaaaaccccgggggg

SEQ ID NO: 62374 - DNA, 1033 bp, Homo sapiens
  misc_feature: GYAE6OF01ETZ6T.18.70.G04.1.454.CMB.1.raw
  modified_base (140)..(140): a, c, t, g, unknown or other
  misc_feature (140)..(140): n is a, c, g, or t
  modified_base (152)..(152): a, c, t, g, unknown or other
  misc_feature (152)..(152): n is a, c, g, or t
tcagtacgagtatgcacgaccggtgctcgatttagtgtagtgtgaagggaaagggacccaacaaccacatccctcctgagaacgccccagagcacaactccttaccatggactggacctggaggacttcctctttttggnggcagcagccanaggtgcccactccgaggtccgagtcgttgtcgacgtagtcggtagggtctaggacggtagaacgacggtcggtcggtcgtagtaggttaacggtacgtttcgagaacgtaacgtacgttcgtaggtaaccttaccgttaccttaccttagtttttacgttttctacgttaccgttaggtcggtcctacggtcccgacccgggaccccggtacccggaaaggtacggtcgttacgggtaggggttcggggaggtacggtacggtaccgtaccgtaacgttcgttacgtaacgtacggttacggtaaccttaactaaaaaccgtttaaagttaccgtaacgtaaacggtaaaggttaagggtttaccggaacggggtaacgtaccgggtaaacggtaccgttaacccttaaacggtttaaacccgttaaacggggaaacgtaacccgtaaccgtaaccggtaacccgtaacgggtaaaccccgaacgtaaccggtaccgttaaacgggtaccggtaagggtaaccgttaggtaacgaacccgggtaacgttaaccccggttttacggaaactttaaccccgggttaaacttaccgggtaaaacgggaaccccgggttaacggtttaacccggtaaccgttttaagggtttaaccctttttaaacgggttacggttaacggggttaacggacggggttttaacgttaacggttccgggggaaattaaagggggtttaaaccgttaccggggtttaaaccccgtttaaccttttaaaacccgggaacccgtttttaaaccgtaaaccccgtttaaacccgggtttaggttaaaccccggggttttaacgggttaaaccccgggttacgggggtaaaaacccgggg

SEQ ID NO: 62375 - DNA, 709 bp, Homo sapiens
  misc_feature: GYAE6OF01B11A1.18.70.G04.1.454.CMB.1.raw
  modified_base (238)..(238): a, c, t, g, unknown or other
  misc_feature (238)..(238): n is a, c, g, or t
  modified_base (372)..(372): a, c, t, g, unknown or other
  misc_feature (372)..(372): n is a, c, g, or t
  modified_base (559)..(559): a, c, t, g, unknown or other
  misc_feature (559)..(559): n is a, c, g, or t
tcagtacgagtatgcacgaccggtgctcgatttagtgtagtgtgaagggaaaggggacccaacaaccacatccctcctgagaacgcccccagagcacaactccttaccatggactggacctggagatccttcttttggtcggcagcagccacgaggtcgcccacctcccaggtccagccttgtcgcagtcgtgggtctggaggtgaagacgccgtgggcctcgagtagtacgtttccngactacgtacttcgaggtacttactccttctacgtttagtttttctactcctagttggctcggccgccgacccggtaccccggaacgtaacggtcgtaggtacggttgggggtagggatgggacttcgaacgtntcggtactactacggtacctaacgaactaaaattcttacgaacgtagtaacgtcgaggacggtacaacgtcgacctaacgtacgtttaacgacggaacctatacggcccgaagaccgtaactaacgtaccgaacgtagacgtacgacgtagaacggtcgaccgttcgtaacgtattactacgggtanaaccgtacgcgggttacttagtaactttaacgtgttacggtcggtaacggactttaggagtaccggtagtagggacccttaggttacccttaccgttaaccgttaactaagttaccgttacacgggttcgtaaaccggtggtaaccgggg

SEQ ID NO: 62376 - DNA, 851 bp, Homo sapiens
  misc_feature: GYAE6OF01C5T44.18.70.G04.1.454.CMB.1.raw
tcagtacgagtatgcacgaccggtgctcgatttagtgtagtgtgaagggaaaggggacccaacaaccacatccctcctgagaagcccccagagcacaactccttaccatggactggacctggagatccttcttttggtggcagcagacacgaggtcgcccactcccaggtccagtcttgtgcagtcgtgggctgaggtgaagacgccgtgggcctcgagtacgtaacggtttcctgactaagtacttcgtaggtactaccgtccttctacgtttacgtttttctaccgttcctagtttcggactcggtccgacccgtacccgggacccccggtaacgtaaacggtccgttaggtaggtggggtaggtagtacggtactacgaacgtcgtacgtactaacggttcggtactaacctaaagtaaactacttacgaacgtaagtaacgttacgacgtacgggacgtaacgtacgtaccgtaaccgtaacgtttacggtaaccggacgtaaccgtaccgtaccggacgtaaacgaaccgacccggttaccgaagtacgggttagggactacgggtaacggacgtacccgtagtacccgttaagtcctttaactaccggaacggtaaacccgacggtaaccgggtacttttaacggttaactttaacgtttagtacgggttaccgggtagtaaccgggttattaccgggaccggtttaagggtaccggtaaaacggtttccccccggttttaaactttaaacccgtttaaaccgttaacccgttaaacctttaacccggtaaacggtacgtttttaaaccgggggcccgggtttaaaccggggaaaacccgggggg

SEQ ID NO: 62377 - DNA, 774 bp, Homo sapiens
  misc_feature: GYAE6OF01AOTZU.18.70.G04.1.454.CMB.1.raw
tcagtacgagtatgcacgaccggtgctcgatttagtgtagtgtgaagggaaaggggacccaacaaccacatccctcctgagaacgcccccagagcacaactccttaccatggactggacctggaggatcctctttttggtggcagcagccacaggtcgcccacctcccaggtccagtcttgtgcagtcgtgggctggaggtgaagagccgtggggcctcaggtagtacggtttcctgacgaagtacttctggtaactaccgttcctttctaacttttacgttttttctaacttcctagtttcggcttcgccgaccgaccgggacccccggaacgaaacggtctaggtggttggggtacgggtatggactacgtaacggtctggtactaagttcggtactacgaaacttaaaattctacgaacgaacggtaagttcgacgaaggggtcgaagtaccggtaccaacgttaacgttaaaccggtaacgggtaaaccacgtaaccggtaccgaacgtaacgaaaccgtaccgtaccgtaacgagttacgggaccgtacgacggtacgtaccgacggttactagtacgtttacgtacgtaacggaaacgtacgacggttacgttacgttaattacgtttaccggtagtcggtaggaaggttgtacggtacgtaagggttacggaacgttaccgtttaacccgtttaacgttaaccgttaaacttacccgttaaacgtacgttaaccggttagggtaacccggtcggggttaaaccgggg

SEQ ID NO: 62378 - DNA, 880 bp, Homo sapiens
  misc_feature: GYAE6OF01BB2PM.18.70.G04.1.454.CMB.1.raw
  modified_base (156)..(156): a, c, t, g, unknown or other
  misc_feature (156)..(156): n is a, c, g, or t
  modified_base (159)..(159): a, c, t, g, unknown or other
  misc_feature (159)..(159): n is a, c, g, or t
  modified_base (178)..(178): a, c, t, g, unknown or other
  misc_feature (178)..(178): n is a, c, g, or t
tcagtacgagtatgcacgaccggtgctcgatttagtgtagtgtgaagggaaaggggacccaacaaccacatccctcctgagaacgcccccagagcacaactccttaccatggactggacctggagatccttcttttggtgcagcagccacaggtcnccnctcccgaggtccagcttgngtctagtcgtgggctggaggtgaagacgccgtcgggcctgagtgtaacggttcctgacaagtcttcgtagacttacctccgtactacgtttagttttctactcctagttcggctcgccgaccgaccggtacccccggaataaggtcgtacggtaggtacggggtggtacgtggtactaccggaacgtccgttgtaccgtaaagttccggttacctaacgtaaaaccgttaaaacttacgttaccgaaagtacggttaacgttacggacgtaacggggactaacggtaacggttacctaaccgttaacgttaaccgtaaaccggggttaaccaaaaccggtacccgttaacccccggggtaagaaccggttaaacccgaaccgggttaacccgttaaaccgaagggtttaccccgggaacgttacccgttaaggggaaacccgacccgtaaccggttaccccgtaaagggttaaccttaagtacccggtaaaccgggtaaccgtaaccgggtaccggtacttaaacggtttaaaccttagggtttaacggttaccgtaggggaaccggtttacgggtacttaaacgggtaggttaaccggttaaggggtaaccgtttacccgttaacccgttagttaaacccccggttaataacccgttaacgacgttaacggttcccgttaaagggtccccgggtaaagggg

SEQ ID NO: 62379 - DNA, 754 bp, Homo sapiens
  misc_feature: GYAE6OF01B8PP1.18.70.G04.1.454.CMB.1.raw
  modified_base (135)..(135): a, c, t, g, unknown or other
  misc_feature (135)..(135): n is a, c, g, or t
  modified_base (561)..(561): a, c, t, g, unknown or other
  misc_feature (561)..(561): n is a, c, g, or t
tcagtacgagtatgcacgaccggtgctcgatttagtgtagtgtgaagggaagggacccaacaaccacatccctcctgagaacgccccagagcacaactccttaccatggactggactggagatccttcttttggnggcagcagccacaggtgcccactcccaggtccagcttgtgcagtcgtgggctgaggtgaagaagccgtggggcctcgaggtggaacggttttccaggacaagtactttccgtggaattaccttccttactacgttaacgttttttcacttcctaagtttcggcttgccgacctacgggaccccccggaataaacggtcgttggaaggttggggtaggtagtagggtaacttaccgaaaccggtctacggtctaacgtgggttacctagtaaactaaaatctttaacacgtaagtaaggttagacgtaacggggacacggtacgtaccctaaccgttaagtaacgtaagggacctaacgacgtaccgacgtacgaaacgtcgtaccacgtaggtaggaacgctacgacgcgacggtactacagttanaccgtagaacgaccgtacgggtacttacgttaagttaaccctttgaacggttacgggtaccgtaagggtactttacgggacggtacggttacgggtaacggttccttaacccgtttaaccgtaaccccgtttaattaaaccccggttcttaaacggttaccggtacggtaccggggtttccgaaaaccggggg

SEQ ID NO: 62380 - DNA, 762 bp, Homo sapiens
  misc_feature: GYAE6OF01DZ98E.18.70.G04.1.454.CMB.1.raw
  modified_base (293)..(293): a, c, t, g, unknown or other
  misc_feature (293)..(293): n is a, c, g, or t
  modified_base (300)..(300): a, c, t, g, unknown or other
  misc_feature (300)..(300): n is a, c, g, or t
tcagtacgagtatgcacgaccggtgctcgatttagtgtagtgtgaagggaagggacccaacaaccacatccctcctgagaacgccccagagcacaactccttacatggactggacctggaggtatccttcgttttggtggcagcagccacgaggtcgcccactcccgaggtccagtcttgtacgcagttcgtgggctggaggtgaagtagtccgtggggtcctacgtagtacggttaaggtttccagactaagtacttcgaggtactaccttaccttatactttcgttttacncttactnttggctacgcgaccgaccggaccccggaagaagtcgtagtagggtaggggtaggagtacggtacgtacgaaccgtgtagtaagtaacgtcgtactacgtaaactaaattacgtactaacgagtacggttacgacggtacggatacggaacgtactaaccgtaagtacgtaacgggactactaacgtaccggaacgaacgtacccacgtaccaagtaccggtaggacgtacgagacgacgacgttaccaaggtcttaaccgtagtaaagaccgaacgggtactcgttaaagttacgttaagttcccgggtagtaggggtaacccgtaagggtttacgtcgtaacgggttacggtaacgggttaacgtttaacccggtttaacggtttaacccaacgtttaaccgttaaaaccctaacggttaaccggtagtaacgggttaacccgggtgggtaaaacccgggg

SEQ ID NO: 62381 - DNA, 718 bp, Homo sapiens
  misc_feature: GYAE6OF01EYSV3.18.70.G04.1.454.CMB.1.raw
  modified_base (259)..(259): a, c, t, g, unknown or other
  misc_feature (259)..(259): n is a, c, g, or t
  modified_base (328)..(328): a, c, t, g, unknown or other
  misc_feature (328)..(328): n is a, c, g, or t
  modified_base (358)..(358): a, c, t, g, unknown or other
  misc_feature (358)..(358): n is a, c, g, or t
  modified_base (443)..(443): a, c, t, g, unknown or other
  misc_feature (443)..(443): n is a, c, g, or t
  modified_base (596)..(596): a, c, t, g, unknown or other
  misc_feature (596)..(596): n is a, c, g, or t
tcagtacgagtatgcacgaccggtgctcgatttagtgtagtgtgaagggaaaggggacccaacaaccacatccctcctgagaacgcccccagagcacaactccttaccatggactggacctggaggactccttctttttggtggcaggcacgcccacgacggtcgccccaccttccccaggttcccagccgttgtgcaggtcgtcggggctggaggtgaaggaacgtccggtgggcctcgacggtacggtaggtttccncgacgaagtacttcgtggtactaccttccttacctacgtttagtttttctactcctagtcgtcctggcnccgaccggcccgaacgtaacggtcgtaggnggtggcgggatcggtactacgacgcgtcgtacagtcgtactacgtaaactaaatctacgaacgagtaacgttcgacgcgggtaanacgtacgtaccaacgttacgttaaccgaacgggtaaccacctaaacgtacccgtaacggaacgtaaaccggtacctaacccgttaaccgtacgggtacggtaaaccgttcgtaaggaccgaacctacggtacgtacgtattaccgtacgtaanaaccgtagtaccgttcgtattacttacgttgtagtgacggtgtagtcggtagtacggtggtaacgttcgttacctttagaacttcgtaactacgtacgtagtccgggtagtccgggaacggg

SEQ ID NO: 62382 - DNA, 835 bp, Homo sapiens
  misc_feature: GYAE6OF01C9ZLH.18.70.G04.1.454.CMB.1.raw
  modified_base (139)..(139): a, c, t, g, unknown or other
  misc_feature (139)..(139): n is a, c, g, or t
tcagtacgagtatgcacgaccggtgctcgatttagtgtagtgtgaagggaaagggacccaacaaccacatccctcctgagacgccccagagcacaactccttaccatggactggacctggagactccttcgtttttggnggcagcagccacaggtcgcccactcccgaggtccagcttgtgcagtcgtgggctggaggtgaagacgccgtgggcctcgaggtagtaacggtttccaggacaagtacttcgtggtaactaccgttccttactactttagttttcactctagttcggctcggcgacccgaccgggtacccccgaagtaaggtctggacggtggggtggagtcggatccgaacgctgactagtcggtacaacgaaataatctacgaagaagtagtcgagagacaacgtacgtaccacgttaagttacgaacggaacacgtaccgtacggacgtaaacgaaccgtacgtaaccgttaacgagtacgggacgtaccgtaggacccgtacaaccggtaccgttaagtaactttacggtaacccgtaagggaaaacccggtacccggtaacgggtttaactttaacgggttaaaaccgttttacggttaaaccggtttcgggtaaccgggtttaaacggggtaacgtttaaaaccgggtccggtaaaacggggttagggtaaccggggtaaacccggtttaacccgttttaaaacccccgttttaaaaccggtaacccttttaaaaccccgttaaacgttttaaaccccgtaaacggttttacgggtaaaccggggtttaccccgggttacgggggttaaaaaccccggggg

SEQ ID NO: 62383 - DNA, 713 bp, Homo sapiens
  misc_feature: GYAE6OF01BFNSX.18.70.G04.1.454.CMB.1.raw
  modified_base (151)..(151): a, c, t, g, unknown or other
  misc_feature (151)..(151): n is a, c, g, or t
  modified_base (637)..(637): a, c, t, g, unknown or other
  misc_feature (637)..(637): n is a, c, g, or t
tcagtacgagtatgcacgaccggtgctcgatttagtgtagtgtgaagggaaaggggacccaacaaccacatccctcctgagaacgccccagagcacaactccttaccatggactggactggaggattccttcttttggtggcagcagccanaggtcgcccactccccaggtccagcttgtgctagtcgtggggctaggacggtagtaagaacggccgtcggggtcctcgaggttagtaacggtttcctagacgaaggtctttcgaggtacttaccttcctactacttttagttttcattctagtggtctcgtcccgaccgacccgggtaccccgaacgtaaacggtcgttagggacggttaggggggtacggtacgtacgggtactaccggaacgtccgttaggtacctagtaccggttacctaacctaaaacgtaaaacttacgtaccaacggtaagtaagttacggacgtacgggactaacggaactacccgactaacgttaacggaacgggtaaccacgtaccgtacggacgaacgaacgacgacctagacgtaggacgtcgacgacgactacgaccttagactacgtagaacgaagtaccgtgtacgttagtacgttctagtcggacgtacgngtacgtgacggtacgtgtacgttacgtaccttctaaccttacctataccacgttaggtggtccgtagggtaccggg

SEQ ID NO: 62384 - DNA, 817 bp, Homo sapiens
  misc_feature: GYAE6OF01AYGQZ.18.70.G04.1.454.CMB.1.raw
  modified_base (138)..(138): a, c, t, g, unknown or other
  misc_feature (138)..(138): n is a, c, g, or t
tcagtacgagtatgcacgaccggtgctcgatttagtgtagtgtgaagggaaagggacccaacaaccacatccctcctgagaacgccccagagcacaactccttacatggactggacctggagactccttcgttttggngcagcagccagaggtcgcccactcccgaggtccagtcttgtcgctagtcgtggggctggaggtgaagacgcgtgggctcgtaggtgtaacgtttccagactaaggtcttcgaggtacttaccttcgttactacgttttacgttttctacgtccttagttcggacttcggccgtaccggaaccggaccccggtaaagtaacggtcttacgggacgggttggggtacgggacgtacggactacggtaaacggtcttacggtacctaaggtttcggtacctaacgtaaacttaaacttacgttaacgaaccgttaagggttaagtcgaacggtaacggtgaaccgttaacgtaccaacgttacttaaacggggacgtaacctaagtaccgtaccggacggaaacaaccgtacgaaccgtagtaaacgtcgggaacaccggttaaggacctacgaccgttactaacgtagttaccgtaagaacggtaaccgtaccggtaacgtaacggtttaactaaggttccttaacgggttggaccgggtaagttaacggttataacgggtacggtaaaccggttagggtacctttaacccgggtttaactaaccttaaacccggtttaacccttacggtactaaaccggtttagggtacccgggttcgggtaaacccggtaaaccggggg

SEQ ID NO: 62385 - DNA, 748 bp, Homo sapiens
  misc_feature: GYAE6OF01BAYBN.18.70.G04.1.454.CMB.1.raw
  modified_base (320)..(320): a, c, t, g, unknown or other
  misc_feature (320)..(320): n is a, c, g, or t
tcagtacgagtatgcacgaccggtgctcgatttagtgtagtgtgaagggaaaggggacccaacaaccacatccctcctgagaacgccccagagcacaactccttaccatggactggacctggagactccttctttttggtggcagcagccacaggtcgcccactcccaggtccagcttgtgcagtctgggctgaggtgaagaagccgtggggcctcgagtggtaagtttcctggacaagtacttcgtaggacttaccttccttctactttagtttttctactacctagttcggctcgccgtccgacggaccccccggaanaaaacggtccgttaggacggttggggtacgggtagttacggtactaccgaaccggtcttacggtacgaaagtttcggtactaaccgaaaactaaaagttacttaacgaaccgtaaggtaacggttggaacggagggtaccgtaagtacgtaaccaacgtaactttaaccgtaaacgggacctaacgacgtacccgacgaacgaaccgtacgaaccgttaagaaggttcggaacgtacgtaggaacgaccgtaacgtaccgaagtaacgttactaacccggtaagaaacccggacgttaaccgggactttaacggttaattacgtttacgtaggtacggacgtaagtagttcgacgtaggtaggacgttaacgttaccgttaacttaacgtacttacttactaagtagtcggtacgttacgggaacggg

SEQ ID NO: 62386 - DNA, 854 bp, Homo sapiens
  misc_feature: GYAE6OF01A1LMO.18.70.G04.1.454.CMB.1.raw
  modified_base (134)..(134): a, c, t, g, unknown or other
  misc_feature (134)..(134): n is a, c, g, or t
  modified_base (185)..(185): a, c, t, g, unknown or other
  misc_feature (185)..(185): n is a, c, g, or t
  modified_base (244)..(244): a, c, t, g, unknown or other
  misc_feature (244)..(244): n is a, c, g, or t
tcagtacgagtatgcacgaccggtgctcgatttagtgtagtgtgaagggaagggacccaacaaccacatccctcctgagaacgccccagagcacaactccttacatggactggactggagatccttcttttggnggcagcagccacgaggtcgcccacctcccgaggtccagtctgtgcagtcgngggctggaggtagaacgacgtccggtggggacctacgtaggtagttaacggttttccgnggaccgtaagtaccttcgtaggtacttaccgtcctttacgtactttaacgtttttcacgttaccgtacgttcgtcgtcgtccgtaccgaccggacccccggaagtaacggtccttaggtacgggttggggtacggtaggtacgtacgttaccggtaaccgtacgtcgttacgaggttaccgtactaaccggtaaaactaaacttacttaacggaccgttaaggtaacggttaggacggtaacgggtcgaacggtaacgtaccctaacgtacgttaaaccgtacgggtaactaaccgtacggtacccgaagtaaccgaaccgaaccggttaccgtagaacgggtacggtaaacgtacgtaacggacggtaacggtaccgtaaccggtaattaacccggttgtaaaccggtaacgaaccggtaaccggtaccgttttaaacgccggtttaaacgtttaccgttaacgggttacgacgggtttaacccgtaggtagttaaccggacggttacggttacgggtactttaccgttaaccttaccgttaacgtaaccctttaacgtaaccggttactaacggggtaaccggtttaccggacgggttaaacccgggg

SEQ ID NO: 62387 - DNA, 852 bp, Homo sapiens
  misc_feature: GYAE6OF01ASW9C.18.70.G04.1.454.CMB.1.raw
  modified_base (139)..(139): a, c, t, g, unknown or other
  misc_feature (139)..(139): n is a, c, g, or t
  modified_base (228)..(228): a, c, t, g, unknown or other
  misc_feature (228)..(228): n is a, c, g, or t
tcagtacgagtatgcacgaccggtgctcgatttagtgtagtgtgaagggaagggacccaacaaccacatccctcctgagaacgccccagagcacaacctccttaccatggactcggcctggagatccttcgtttttggnggcagcacgccactaggtcgcccactcccaggtccagtcttgtgcgagtcgtggggctggaggtagaagacgtccggtcggggcctcgnggtgtaacggtttccctggacgtaataccgtttcgtacggtaactacccttccttacgttaacttttacgttttttacacttccttagttcggtactcggcccgtaccgaaccgggtacccccggaagtaacggtcgttaggacgggttaggggtggtaacgtgggtaactcccgtaacggtcttacggtacgtagtttaccggtacctaaccgttaaaactaaactttaccgtacgaaccgttaagggtaacgtcggtaaccggaggggtaacctagggaacccttccgaaaacccggttacgttaaaccgggtaaacggaaaccgacccggtaccgttaacccgggaacgaacctaaacggttacccgtaactaccgggttaaactcccggggaaacgttccgtaggaaccggtaacctaacgtccgtttaacggaactttaacggtacgttagaaccggtaaccgtcgtacgtaagggtttacttaacgtcggttagtagggtaccgaaggttctacggaggttaagggtaacgtccggtttaacctaaaccgtttccttaaaacgttaccgaactttacctaaccggtaagttcccgggttaccggtaacggtaccgggg

SEQ ID NO: 62388 - DNA, 766 bp, Homo sapiens
  misc_feature: GYAE6OF01A3OH5.18.70.G04.1.454.CMB.1.raw
tcagtacgagtatgcacgaccggtgctcgatttagtgtagtgtgaagggaaaggggacccaacaaccacatccctcctgagaagcccccagagcacaactccttaccatggactggacctggaggatccttctttttggtggcagcagccacaggtgcccactcccaggtccagcttgtgcagtctggggctgaggtgaagagccgtggggcctcagtgaaggtttcctgactaagacttcgtaggtacttaccttcctttactactttagtttttcctaacttccatttggcttgccgacccgtacgggccccccggaacaaaacggtccttggaacggtggggtaggggtagtcgggattaccgaacgccgttgtacgaaagttcgggttacctacaaacgtaaaaattactttacgaacgtaagtaaggtttgacgtaggggacgaaggacgttacgaacctaactttaacgtaacgggaacctaacgtaacgttacccgaccggaaagaacccgaacggtacccctaacgacgttacgggaaccgtcgtagggaaccgaccgaccggtcccttaaggacttactaccggtagaaacgaccgaaccgggtctttagtaatttacgtttacgtggttacgaccggtaaggttcttaggtaggtaacgggttagggaacggttacgttacccgtttaaaccgttacccttaaactttaaccctaacttaacgtagttagggtacccgttccggggtaaacggggg

SEQ ID NO: 62389 - DNA, 866 bp, Homo sapiens
  misc_feature: GYAE6OF01ARJ5K.18.70.G04.1.454.CMB.1.raw
  modified_base (237)..(237): a, c, t, g, unknown or other
  misc_feature (237)..(237): n is a, c, g, or t
tcagtacgagtatgcacgaccggtgctcgatttagtgtagtgtgaagggaaaggggacccaacaaccacatccctcctgagaagccccaggagcacgaactccttaccatggactggacctggaggatcctcttttggtggcagcagccacgaggtgcccactcccaggtccagcttgtgcagtcgtggggtctgacggtgaagaacgccgtgggacctcgagtcgtaaggtttccngacgaacgtacttacgtcggtacttaaccgttccttctaacgttttacgtttttacacttcccgttaagttcggtccttggacccggtacccgtaaccgggacccccccgggtaaaagtaaaaccggggtccgttagggtacgggttcgggggtaagggtacggtacggacgttaccgaaaccgtcgttacgtacgtaacggttcggtacctaactaaaaccgtaaaactttactacctaaccgtaaaggtaacggttacgaccgggtacgggtaccgaacggtactacccgtaacgtaacgtttaacgaccggggtaaccaaccgtaacgtaccgtaaccgggaagtaaacccacggtaacccgtaacgtcggtacggtaacggtcggtacgacggtaccgtaacgggtccctaacggtacttcgttaaccggtaggaacccggtaacgtcgtaacgtttcgtaaacgtttagttaccgtaggtccgtaagggtacgtaggtttacgaccggttaggggttaaccgggtaccttagggttttaacccttaccgttaaccgttaaacccttaacggtaaacccttaacgggtagttacccgggtaacggttacccgggttaaaccgggg

SEQ ID NO: 62390 - DNA, 842 bp, Homo sapiens
  misc_feature: GYAE6OF01DPSRX.18.70.G04.1.454.CMB.1.raw
  modified_base (144)..(144): a, c, t, g, unknown or other
  misc_feature (144)..(144): n is a, c, g, or t
tcagtacgagtatgcacgaccggtgctcgatttagtgtagtgtgaagggaaagggacccaacaaccacatccctcctgagaacgccccagagcaacaactccttaccatggactggacctggagtacttcctttcgtttttggnggcagcagaccacgaggtccgacccacctcccgacggtccagtcttgtgctagtcgtgggactggtaaggtagaaggacgccggtcgggtactcgaggtacgttaacgtttcagacgaacgtcttcgtagtacttaccttcctttacttacttttcgttttacacctacgttagttcggcgtacgcccgaccgtacccggacccgtaacgaagtcgttaggacgggtagggtacggagtacggtactacgtaacgtcgttagtaacgtaggttcgtaactaactaaacttaagtactaacgtaagtaacgtaggtccggacggtagaccgtagtacgttaaccgtacgttaacgtacgggaacgtaacctaccgtaccgtaaccggacgaagtaaccgccgtaaccgtagttacggacggtacgtaacggtacgaacggtataccgcgtaattacgtaacggtcgtaaacgacggtacgttacgtactttaaacgggtttacctttaagggtttcgaccgggttaaggtacgttacggggttaaactccggggttaaacgggtcggtttaaacccggtttaaaccggttaccgtttttaaaacccggttcccggtttaaaaactttacccttaaaccggttacggttaaaccgggtttggggtaaaacccgttcgggggttaaaccccgggtaacggg

SEQ ID NO: 62391 - DNA, 806 bp, Homo sapiens
  misc_feature: GYAE6OF01BWMLX.18.70.G04.1.454.CMB.1.raw
  modified_base (129)..(129): a, c, t, g, unknown or other
  misc_feature (129)..(129): n is a, c, g, or t
  modified_base (136)..(136): a, c, t, g, unknown or other
  misc_feature (136)..(136): n is a, c, g, or t
  modified_base (568)..(568): a, c, t, g, unknown or other
  misc_feature (568)..(568): n is a, c, g, or t
  modified_base (605)..(605): a, c, t, g, unknown or other
  misc_feature (605)..(605): n is a, c, g, or t
  modified_base (697)..(697): a, c, t, g, unknown or other
  misc_feature (697)..(697): n is a, c, g, or t
tcagtacgagtatgcacgaccggtgctcgatttagtgtagtgtgaagggaaaggggacccaacaaccacatccctcctgagaacgccccagagcacaactccttacatggactggactggagatccttnttttggngcagcagccacgaggtcacccacgtcccgaggtcccagtcttgtgacctaggttcgtcgggggactaggaggttagaacggaaccgccggtacgggcccttagaggttaggtaacggtttccgtagaactaaggtccttgtacggtacttaccgttaccttacggtactttttacggttttctacgttcccgtagttccgtagtcggcccgtacccggaaccggtaccccgggaagttaaacgggtctttagggtacgggttgggggtacgggtaacgtttacgggactaccgtaaccggtgtagggtaaccttaaggttcgtaaccttaactaaaaccgttaaattcgtactaaacgtagttacggtacgacgggtaggactaagtacggaacctagttaaccgtacggtacgaactacgaaccgtcgaanaaccgtacgacttaccgacgtagtcgacgtagacggnactacggtcgtacgttataccgtacgttaacgggaactacccgggtacgtatacgtttagaaccgtttgttcgggaacggtcgttaagggtnttaccgggagacgggtttacggggtactttacgtaccccggtttttaaagactttaacccgtaacggtaccttacggaaccggtgggttacctccgggggttaaaacgg

SEQ ID NO: 62392 - DNA, 740 bp, Homo sapiens
  misc_feature: GYAE6OF01EKU1K.18.70.G04.1.454.CMB.1.raw
  modified_base (139)..(139): a, c, t, g, unknown or other
  misc_feature (139)..(139): n is a, c, g, or t
  modified_base (156)..(156): a, c, t, g, unknown or other
  misc_feature (156)..(156): n is a, c, g, or t
tcagtacgagtatgcacgaccggtgctcgatttagtgtagtgtgaagggaaaggggacccaacaaccacatccctcctgagaagcccccagagcacaactccttaccatggactggacctggaggatcctctttttggnggcagcagccacaggtncccactcccaggtccagcttgtgcagtcgtggggctgaggtgaagagccgtggggcctgagtgaaggtttcctgcaagtacttcgtggacttacctccttactacgtttagtttttccatcctagttcggcttagccgtccgacgggtacccccggaacgaaacggttcttagggacggttgggggtagggagttggggactacgtaaccggtcgttacgtacgtaagttcggtctaacaactaaaattactacaacgtaagtaacggttagacggagggaccaaggtaacgtaccctaaccgtaatttaaccgtacgggtaaccaacgtaccgtaccggaacgtaacgaaaccgtacgtacctaacgtaggttagggactacgtacggaacgcaacggtcagtagttacgtcgtaacggaacgtaccgtacgggtacttagtaacgtttaacgttagtacggtacggacgggtaaggttacgtgtacgtaagggtacggtaacggttcgttaaccgtttaccttaaccttaaaccttaacttaacgttaaccaggttccggtaacggttcgggtaaccggggg

SEQ ID NO: 62393 - DNA, 507 bp, Homo sapiens
  misc_feature: GYAE6OF02IGZUX.18.70.G04.1.454.CMB.1.raw
  modified_base (342)..(342): a, c, t, g, unknown or other
  misc_feature (342)..(342): n is a, c, g, or t
  modified_base (457)..(457): a, c, t, g, unknown or other
  misc_feature (457)..(457): n is a, c, g, or t
  modified_base (501)..(501): a, c, t, g, unknown or other
  misc_feature (501)..(501): n is a, c, g, or t
tcagtacgagtatgcacgaccggtgctcgatttagtgtagtgtgaagggaaaggggacccaacaaccacatccctcctgagaagcccccagagcacaactccttaccatggactggacctggaggatcctctttttggtggcagcagccacaggtgcccactcccaggtccagcttgtgcagtctggggctgaggtgaagaagcctggggcctcagtgaaggtttcctgcaagacttctggatactccttcactagttttctatccattggctgcgccaggcccccggacaaaggcttgagtgggtgggatggatcaacgctgtcaatggtctcacaaaatnttcacagaagttgcagggcagagtcacattactagggacacatccgcgagaacagcctacatggagctgagcagcctgatatctagaagacacggctgtatattactgtgcgagnttgcagtggagagtccttatactactactactacatcggacgtntcgggg

SEQ ID NO: 62394 - DNA, 545 bp, Homo sapiens
  misc_feature: GYAE6OF02H0KOT.18.70.G04.1.454.CMB.1.raw
  modified_base (292)..(292): a, c, t, g, unknown or other
  misc_feature (292)..(292): n is a, c, g, or t
tcagtacgagtatgcacgaccggtgctcgatttagtgtagtgtgaagggaaaggggacccaacaaccacatccctcctgagaagcccccagagcacaactccttaccatggactggacctggaggatcctctttttggtggcagcagccacaggtgcccactcccaggtccagcttgtgcagtctggggctgaggtgaagaagcctggggcctcagtgaaggtttcctgcaagacttctggatactccttcacttagtttttctatccattggctgcgccaggcccccgganaaaggcttgagtgggtggatggatcaacgctgtcaatggtctcaacaaaatattacaacagaagttgacagggcagaagtcaaccattaacgtagggacacatccgcgagaaacagacctacatggagctgagcgaagcctagatatcgtagaaacgcaacggctgtaatattcttgtgacggagtattgacgaggttaggagtacgtccttaactaacttacctactactacaagtggacgttgtacggggg

SEQ ID NO: 62395 - DNA, 514 bp, Homo sapiens
  misc_feature: GYAE6OF02GO11Q.18.70.G04.1.454.CMB.1.raw
  modified_base (410)..(410): a, c, t, g, unknown or other
  misc_feature (410)..(410): n is a, c, g, or t
  modified_base (475)..(475): a, c, t, g, unknown or other
  misc_feature (475)..(475): n is a, c, g, or t
  modified_base (507)..(507): a, c, t, g, unknown or other
  misc_feature (507)..(507): n is a, c, g, or t
tcagtacgagtatgcacgaccggtgctcgatttagtgtagtgtgaagggaagggggacccaacaaccacatccctcctgagaagcccccagagcacaactccttaccatggactggacctggaggatcctctttttggtggcagcagccacaggtgcccactcccaggtccagcttgtgcagtctggggctgaggtgaagaagcctggggcctcagtgaaggtttcctgcaagacttctggatactccttcactagtttttctatccattggctgcgccaggcccccggacaaaggcttgagtgggtgggatggatcaacgctgtcaatggtctcacaaaatattcacagaagttgcagggcagagtcaccattactagggacacatccgcgagaacagcctacatgganctgagcagcctgatatctgaagacacggcttagtatattactgtgcgaggattggctaggtgganagtccttatactactactactacatggacgtntacgggg

SEQ ID NO: 62396 - DNA, 547 bp, Homo sapiens
  misc_feature: GYAE6OF02H056P.18.70.G04.1.454.CMB.1.raw
tcagtacgagtatgcacgaccggtgctcgatttagtgtagtgtgaagggaaaggggacccaacaaccacatccctcctgagaagcccccagagcacaactccttaccatggactggacctggaggatcctctttttggtggcagcagccacaggtgcccactcccaggtccagcttgtgcagtctggggctgaggtgaagaagcctggggcctcagtgaaggtttcctgcaagacttctggatactccttcactagtttttctatccattggctgcgccaggcccccggacaaaggcttgagtgggtgggatggatcaacgctgtcaatggtctcacaaaatattcacagaaagttgcagggcagagtcaccattacgtagggacacatccggacgagaacagcctaacatggagctgagcagcctgatatctagaagacgaacggctagtaatattactgtgcgaggtattgacgagtgggaagacgttccctttaactaaccgttacttaactaacctaacgagtacggtaccgttgtacggggg

SEQ ID NO: 62397 - DNA, 508 bp, Homo sapiens
  misc_feature: GYAE6OF02G185Z.18.70.G04.1.454.CMB.1.raw
  modified_base (403)..(403): a, c, t, g, unknown or other
  misc_feature (403)..(403): n is a, c, g, or t
tcagtacgagtatgcacgaccggtgctcgatttagtgtagtgtgaagggaaaggggacccaacaaccacatccctcctgagaagcccccagagcacaactccttaccatggactggacctggaggatcctctttttggtggcagcagccacaggtgcccactcccaggtccagcttgtgcagtctggggctgaggtgaagaagcctggggcctcagtgaaggtttcctgcaagacttctggatactccttcactagtttttctatccattggctgcgccaggcccccggacaaaggcttgagtgggtgggatggatcaacgctgtcaatggtctcacaaatattcacagaagttgcagggcagagtcaccattactagggacacatccgcgagaacagcctanatggagctgagcagcctgatatctgaagacacggctgtatattactgtgcgagattgcagtggagagtccttactactatactactacatcggacgtcgtagggg

SEQ ID NO: 62398 - DNA, 577 bp, Homo sapiens
  misc_feature: GYAE6OF02I3CXU.18.70.G04.1.454.CMB.1.raw
  modified_base (316)..(316): a, c, t, g, unknown or other
  misc_feature (316)..(316): n is a, c, g, or t
  modified_base (404)..(404): a, c, t, g, unknown or other
  misc_feature (404)..(404): n is a, c, g, or t
  modified_base (410)..(410): a, c, t, g, unknown or other
  misc_feature (410)..(410): n is a, c, g, or t
tcagtacgagtatgcacgaccggtgctcgatttagtgtagtgtgaagggaaagggacccaacaaccacatccctcctgagaagcccccagagcacaactccttaccatggactggacctggaggatcctcttttggtggcagcagccacaggtgcccactcccaggtccagcttgtgcagtctggggctgaggtgaagaagcctggggcctcagtgaaggtttcctgcaagacttctggatactccttcactagttttctatccattggctgcgccaggcccccgacaaaggcttgagtggtggatggatcaacgntgtcaatggtctcaacaaatattacacagagttagcagggcagagtcaccattaacgtagggacacatccgacgagaaaccagcctanatgganctagagcagcctgatatctagaagacacggtctgtaattattacgtgttacggcgtaagggtacttggactaggtacgggaggtaacgtttacccgtttaacttaacccgttaccgttaaccttaaccgttaacctagttcgggtaaccgttccggttaacgggggg

SEQ ID NO: 62399 - DNA, 532 bp, Homo sapiens
  misc_feature: GYAE6OF02GYJHC.18.70.G04.1.454.CMB.1.raw
tcagtacgagtatgcacgaccggtgctcgatttagtgtagtgtgaagggaaaggggacccaacaaccacatccctcctgagaagcccccagagcacaactccttaccatggactggacctggaggatcctctttttggtggcagcagccacaggtgcccactcccaggtccagcttgtgcagtctggggctgaggtgaagaagcctggggcctcagtgaaggtttcctgcaagacttctggatactccttcacttagttttctatccattggctgcgccaggcccccggacaaaggcttgagtgggtgggatggatcaacgctgtcaatggtctcaacaaaatattcacagaagttgcagggcagagtcaccattactagggacacatccgcgagaacagcctaacatggagctgacgcagcctgattatctagaacgcacggctagtaatattactgtgcgaaggattgctaggtggtagtaggttccttaactacttaactacttaactacagttcggacgtgtacgggg

SEQ ID NO: 62400 - DNA, 518 bp, Homo sapiens
  misc_feature: GYAE6OF02GFF6X.18.70.G04.1.454.CMB.1.raw
  modified_base (406)..(406): a, c, t, g, unknown or other
  misc_feature (406)..(406): n is a, c, g, or t
tcagtacgagtatgcacgaccggtgctcgatttagtgtagtgtgaagggaaaggggacccaacaaccacatccctcctgagaagcccccagagcacaactccttaccatggactggacctggaggatcctcttttggtggcagcagccacaggtgcccactcccaggtccagcttgtgcagtctggggctgaggtgaagagcctgggcctcagtgaaggtttcctgcaagacttctggatactccttcacttagttttctatccattggctgcgccaggcccccggacaaaggcttgagtgggtggatggatcaacgctgtcaatggtctcacaaaatattcacagaagttgcagggcagagtcaccattactagggacacatccgcgagaacagcctacatgganctgagcagcctagatatctagaacgacacggctagtatattactgtgcgagtattgcagtggagagttcccttaatacgtactacgtactacagtacggtacgtgtacgggg

SEQ ID NO: 62401 - DNA, 611 bp, Homo sapiens
  misc_feature: GYAE6OF02JAV7H.18.70.G04.1.454.CMB.1.raw
  modified_base (337)..(337): a, c, t, g, unknown or other
  misc_feature (337)..(337): n is a, c, g, or t
tcagtacgagtatgcacgaccggtgctcgatttagtgtagtgtgaagggaaaggggacccaacaaccacatccctcctgagaagcccccagagcacaactccttaccatggactggacctggaggatcctctttttggtggcagcagccacaggtgcccactcccaggtccagcttgtgcagtctggggctgaggtgaagagcctggggcctcagtgaaggtttcctgtcagacctatggattccccttccagtaattttgatatccattgggtgcgacaggccagtggacaagggctcggagtggatgggatggatggaacggtaaactgaccaanacaggctatgcagaggcatccgagggcagagtcacagtcgacccgggaacccctccgaccggcacgacgacctaacagtggagcgtagagcagtctgaccaccgtgaaccgacgaccgggtcccgtacttaactttacgtgtacgcggaagacggaccggacgtaagttagttggtaggtacgaacggaaagtaggttacgggtttcgttttagggttttggtttttacgggacccgggtttagtaaccggttaccgggttcgggggtacccgg

SEQ ID NO: 62402 - DNA, 525 bp, Homo sapiens
  misc_feature: GYAE6OF02HWXOQ.18.70.G04.1.454.CMB.1.raw
  modified_base (291)..(291): a, c, t, g, unknown or other
  misc_feature (291)..(291): n is a, c, g, or t
tcagtacgagtatgcacgaccggtgctcgatttagtgtagtgtgaagggaaaggggacccaacaaccacatccctcctgagaagcccccagagcacaactccttaccatggactggacctggaggatcctctttttggtggcagcagccacaggtgcccactcccaggtccagcttgtgcagtctggggctgaggtgaagaagcctggggcctcagtgaaggtttcctgcaagacttctggatactccttcactagtttttctatccattggctgcgccaggcccccgganaaaggcttgagtgggtgggatggatcgaacgctgtcaatggtctcacaaaatattacacagaagttgacagggcagagtcaccattactagggacacatccgcgagaacagcctacatggagctgagcagcctgatatctagaagacacggctgtatattactgtcgacgagattgctaggtggagtagttccttaacgtactacgtactactaacagtggacgtcgtacgggg

SEQ ID NO: 62403 - DNA, 507 bp, Homo sapiens
  misc_feature: GYAE6OF02IFK8S.18.70.G04.1.454.CMB.1.raw
  modified_base (400)..(400): a, c, t, g, unknown or other
  misc_feature (400)..(400): n is a, c, g, or t
  modified_base (406)..(406): a, c, t, g, unknown or other
  misc_feature (406)..(406): n is a, c, g, or t
  modified_base (465)..(465): a, c, t, g, unknown or other
  misc_feature (465)..(465): n is a, c, g, or t
tcagtacgagtatgcacgaccggtgctcgatttagtgtagtgtgaagggaaaggggacccaacaaccacatccctcctgagaagcccccagagcacaactccttaccatggactggacctggaggatcctctttttggtggcagcagccacaggtgcccactcccaggtccagcttgtgcagtctggggctgaggtgaagagcctggggcctcagtgaaggtttcctgcaagacttctggatactccttcactagtttttcatccattggctgcgccaggcccccggacaaaggcttgagtgggtgggatggatcaacgctgtcaatggtctcacaaatattcacagaagttgcagggcagagtcacattactagggacacatccgcgagaacagcctanatgganctgagcagcctgatatctgaagacacggctgtatattactgtgcgagattgcagtgganagttccttatactactactactacagtcggacgtgtacgggg

SEQ ID NO: 62404 - DNA, 524 bp, Homo sapiens
  misc_feature: GYAE6OF02JBLGY.18.70.G04.1.454.CMB.1.raw
  modified_base (342)..(342): a, c, t, g, unknown or other
  misc_feature (342)..(342): n is a, c, g, or t
tcagtacgagtatgcacgaccggtgctcgatttagtgtagtgtgaagggaaaggggacccaacaaccacatccctcctgagaagcccccagagcacaactccttaccatggactggacctggaggatcctctttttggtggcagcagccacaggtgcccactcccaggtccagcttgtgcagtctggggctgaggtgaagaagcctggggcctcagtgaaggtttcctgcaagacttctggatactccttcactagttttctatccattggctgcgccaggccctcggacaaaggcttgagtgggtgggatggatcaacgctgtcaatggtctcacaaaatnttacacagaagttgacaggcagagtcaacctattaatagggacacatccgagacgaacacgcctacatggagctagagcagcctagatatctagaagtacgacggctagtatacttactgtagcgagtattgctaggtggagtagtccttacttactacttactactactataggacgtcgg

SEQ ID NO: 62405 - DNA, 594 bp, Homo sapiens
  misc_feature: GYAE6OF02GMJ9O.18.70.G04.1.454.CMB.1.raw
tcagtacgagtatgcacgaccggtgctcgatttagtgtagtgtgaagggaaaggggacccaacaaccacatccctcctgagaagcccccagagcacaactccttaccatggactggacctggaggatcctctttttggtggcagcagccacaggtgcccactcccaggtccagcttgtgcagtctggggctgaggtgaagaagcctggggcctcagtgaaggtttcctgcaagacttctggatactccttcacttagtttttctatcctattggctgcgccacggccccggacaaaggcttgagtggggtgggatggatcgaacgctgtcaatggtctacaacaaatattacaacagtaagttgacgagggcagagtacacctattacgtaggacactacgtccgacgagaacacgacctacagtggatcagagcagcctagactatcgtagaacgaccgacggcttagtaacttattacgtagttcgacggtaaggtacgttaggacgtagggttagggaacgtacgtttacccgtaacttaaccgttaacttaccgtacttaacgacgttacggtaccgttcggtaacgggg

SEQ ID NO: 62406 - DNA, 646 bp, Homo sapiens
  misc_feature: GYAE6OF02H3QXR.18.70.G04.1.454.CMB.1.raw
  modified_base (451)..(451): a, c, t, g, unknown or other
  misc_feature (451)..(451): n is a, c, g, or t
tcagtacgagtatgcacgaccggtgctcgatttagtgtagtgtgaagggaaagggaccgaacaaccacatcctcctgagaagccccacgagcacaactccttaccatggactggacctggaggatccttcttttggtggcagcagccacaggtgcccactccaggtccagcttgtgcagtctggggctgaggtgaagaagcctggggcctcagtgaaggtttcctgcaagacttctggaatactccttcacttagttttcatccattggctgcgcagccccggacaaagcttgagtgggtggatcggatcgaaacgctgtcaaagttgggtctccaataaaaattattcacaaagaaaggtttcgcgaacggggcaagaggtaccaacccggtatttaaacctaaggggaccaacacttcccggacgaagaaaccgtaggaccccttaaanagtaggaacgcgtaggacgacacgtccgtagataagttacgaggaaacggaccgtacgggtacttagtaattaacgttacgttaggtcgggaacgaagggttattacggacgtaagggttaggaacgttaacgttccgttaaacttaacctaacttaaccttactaacgaagttcggaccggttacggtacgggg

SEQ ID NO: 62407 - DNA, 528 bp, Homo sapiens
  misc_feature: GYAE6OF02F8OVS.18.70.G04.1.454.CMB.1.raw
  modified_base (425)..(425): a, c, t, g, unknown or other
  misc_feature (425)..(425): n is a, c, g, or t
  modified_base (438)..(438): a, c, t, g, unknown or other
  misc_feature (438)..(438): n is a, c, g, or t
  modified_base (460)..(460): a, c, t, g, unknown or other
  misc_feature (460)..(460): n is a, c, g, or t
tcagtacgagtatgcacgaccggtgctcgatttagtgtagtgtgaagggaaaggggacccaacaaccacatccctcctgagaagcccccagagcacaactccttaccatggactggacctggaggatcctcttttggtggcagcagccacaggtgcccactcccaggtcccagcttgtgcagtctggggctgaggtgaagaagcctggggcctcagtgaaggtttcctgcaagacttctggatactccttcactagttttctatccattggctgcgccaggcccccggacaaaggcttgagtgggtgggatggatcaacgctgtcaatggtctcacaaaatattcacagaagttgcagggcagagtcacattactagggacacatccgcgagaacagacctacatggagctgagcagcctgatanctgaagacacggntagtatattactgtgcgaaggnttgcaggtggaaggattcccttaataccttactaccgtacttaacagttcgggaccgttgtaacgggg

SEQ ID NO: 62408 - DNA, 512 bp, Homo sapiens
  misc_feature: GYAE6OF02F3W0O.18.70.G04.1.454.CMB.1.raw
  modified_base (473)..(473): a, c, t, g, unknown or other
  misc_feature (473)..(473): n is a, c, g, or t
tcagtacgagtatgcacgaccggtgctcgatttagtgtagtgtgaagggaaaggggacccaacaaccacatccctcctgagaagcccccagagcacaactccttaccatggactggacctggaggatcctctttttggtggcagcagccacaggtgcccactcccaggtccagcttgtgcagtctggggctgaggtgaagaagcctggggcctcagtgaaggtttcctgcaagacttctggatactccttcacttagtttttctatccattggctgcgccaggcccccggacaaaggcttgagtgggtgggatggatcaacgctgtcaatggtctcacaaaatattcacagaagttgcagggcagagtcacattactagggacacatccgacgagaacagccctacatggagctgagcagcctgatatctagaagacacggctagtatattactgtgcgagattgcagtggangttacctatactactactactacagtcgacgtgtacggg

SEQ ID NO: 62409 - DNA, 551 bp, Homo sapiens
  misc_feature: GYAE6OF02JBRXG.18.70.G04.1.454.CMB.1.raw
  modified_base (420)..(420): a, c, t, g, unknown or other
  misc_feature (420)..(420): n is a, c, g, or t
tcagtacgagtatgcacgaccggtgctcgatttagtgtagtgtgaagggaaaggggacccaacaaccacatccctcctgagaagcccccagagcacaactccttaccatggactggacctggaggatcctctttttggtggcagcagccacaggtgcccactcccaggtccagcttgtgcagtctggggctgaggtgaagaagcctggggcctcagtgaaggtttcctgcaagacttctggatactccttcacttagttttctatccattggctgcgcacggcccccggacaaaggcttgagtgggtgggagtggatcgaacggctagtcaatggtctcaacaaatattacacagtaagttgacagggcagatcacattacgagggacacatccgcgaagaacacgacctacagtcggancgtgagcagcctagactatctagaacgacgacggtctagttatattacgtgtgacggagagttgagtaggtaggagtacttaccgttactaacttacgtacttaactacgtagtcggacgttcgtacgggg

SEQ ID NO: 62410 - DNA, 609 bp, Homo sapiens
  misc_feature: GYAE6OF02IDQJY.18.70.G04.1.454.CMB.1.raw
  modified_base (340)..(340): a, c, t, g, unknown or other
  misc_feature (340)..(340): n is a, c, g, or t
tcagtacgagtatgcacgaccggtgctcgatttagtgtagtgtgaagggaaaggggacccaacaaccacatccctcctgagaagcccccagagcacaactccttaccatggactggacctggaggatcctctttttggtggcagcagccacaggtgcccactcccaggtccagcttgtgcagtctggggctgaggtgaagaagcctggggcctcagtgaaggtttcctgcaagacttctggatactccttcacttagttttctatccattggctgcgccaggcccccgacaaaggcttgaggtgggtgggatggatcgaacgctgtcaagtggtctcaanaaaatattcacagtaagttgcaagggcaagagtaccaactacgtttaactaagggacacaacttcccgacgaacgaaaccagccctaacagtcggagtcctaggacgtcgagccctggaattatcgtagaaagacacgggacttagtattaacttagtgttcgacggtaaggtagtttgaccgtaggttggaaggttaacgttaccgttaacgttaaccttaacgttaccttaacctaagtagttacgggtacgttcggtaacgggggg

SEQ ID NO: 62411 - DNA, 535 bp, Homo sapiens
  misc_feature: GYAE6OF02HB8ZX.18.70.G04.1.454.CMB.1.raw
tcagtacgagtatgcacgaccggtgctcgatttagtgtagtgtgaagggaaaggggacccaacaaccacatccctcctgagaagcccccagagcacaactccttaccatggactggacctggaggatcctctttttggtggcagcagccacaggtgcccactcccaggtccagcttgtgcagtctggggctgaggtgaagaagcctggggcctcagtgaaggtttcctgcaagacttctggatactccttcactagttttctatccattggctgcgccaggcccccggacaaaggcttgagtgggtgggatggatcaacgctgtcaatggtctcacaaaatattacacagaagttgcagggcagagtcaccattactagggacacatccgcgagaacagcctacagtggagctgagcagcctagatatctgaagacacggctgtatattactgtgcgaggtattgacgtaggtaggagtagtcctttaactaaccttacttacttacctactagtacggtacggtcgtacggggg

SEQ ID NO: 62412 - DNA, 580 bp, Homo sapiens
  misc_feature: GYAE6OF02GPDSA.18.70.G04.1.454.CMB.1.raw
  modified_base (289)..(289): a, c, t, g, unknown or other
  misc_feature (289)..(289): n is a, c, g, or t
  modified_base (410)..(410): a, c, t, g, unknown or other
  misc_feature (410)..(410): n is a, c, g, or t
tcagtacgagtatgcacgaccggtgctcgatttagtgtagtgtgaagggaaaggggacccaacaaccacatccctcctgagaagcccccagagcacaactccttaccatggactggacctggaggatcctcttttggtggcagcagccacaggtgcccactcccaggtccagcttgtgcagtctggggctgaggtgaagaagcctggggcctcagtgaaggtttcctgcaagacttctggatactccttcactagtttttctatccattggctgcgccaggcccccganaaaggcttgagtgggtgggatggatcgaacgctgtcaatggtctcacaaatattcacagaagttgacagggcagagtcacattactagggacacatccgacgagaacacgcctacagtagngactgacgcagcctagatatctagaacgacgacgggacttagtacttagttacgtgtacgacggtaaggtagtttggaccgtaggtaggaacggtacgttacccgtttaacttacttaaccttaacttaaccgtaaccgtaacgttcggggtaccgttcggtaacggggg

SEQ ID NO: 62413 - DNA, 567 bp, Homo sapiens
  misc_feature: GYAE6OF02HOG61.18.70.G04.1.454.CMB.1.raw
  modified_base (275)..(275): a, c, t, g, unknown or other
  misc_feature (275)..(275): n is a, c, g, or t
  modified_base (289)..(289): a, c, t, g, unknown or other
  misc_feature (289)..(289): n is a, c, g, or t
  modified_base (333)..(333): a, c, t, g, unknown or other
  misc_feature (333)..(333): n is a, c, g, or t
  modified_base (343)..(343): a, c, t, g, unknown or other
  misc_feature (343)..(343): n is a, c, g, or t
  modified_base (456)..(456): a, c, t, g, unknown or other
  misc_feature (456)..(456): n is a, c, g, or t
  modified_base (509)..(509): a, c, t, g, unknown or other
  misc_feature (509)..(509): n is a, c, g, or t
tcagtacgagtatgcacgaccggtgctcgatttagtgtagtgtgaagggaaaggggacccaacaaccacatccctcctgagaagcccccagagcacaactccttaccatggactggacctggaggatcctctttttggtggcagcagccacaggtgcccactcccaggtccagcttgtgcagtctggggctgaggtgaagagcctggggcctcagtgaaggtttcctgcaagacttctggatactccttcacttagttttcatccattggctgcnccaggcccccgganaaaggcttgagtgggtggatggatcaacgctgtcaagtggtctnaactaaaatnttcacagaagttgacagggcagagtcaacctattacgtagggacacaatccggacgaacgaacaacggacccttacagtaggaagcctaggaacgcaaggcccttagattacncgtagaaacgtacgacggtactgtaactattacgtgtgacgaggtattgacgnggtaggatacgttacttactacgtactactactacgtagtacggtacgtcgtacgggg

SEQ ID NO: 62414 - DNA, 540 bp, Homo sapiens
  misc_feature: GYAE6OF02HDEGJ.18.70.G04.1.454.CMB.1.raw
tcagtacgagtatgcacgaccggtgctcgatttagtgtagtgtgaagggaaaggggacccaacaaccacatccctcctgagaagcccccagagcacaactccttaccatggactggacctggaggatcctctttttggtggcagcagccacaggtgcccactcccaggtccagcttgtgcagtctggggctgaggtgaagagcctggggcctcagtgaggtttcctgcaagacttctggatactccttcacttagtttttctatccattggctgcgccaggcccccggacaaaggcttgagtggtgggatggatcaacgctgtcaatggtctcacaaatattcacagaagttgacagggcagagtcaccattactagggacacactccgcgagaacagcctacgatggagctggagcagcctgatactctagaagacacggcttagtattagttactgtcgacgaggtattgcgtaggtggaacgtacgttccgttaactacgttacttaacgtactacagtcggtaccgtcgtacgggg

SEQ ID NO: 62415 - DNA, 552 bp, Homo sapiens
  misc_feature: GYAE6OF02IHU7H.18.70.G04.1.454.CMB.1.raw
  modified_base (292)..(292): a, c, t, g, unknown or other
  misc_feature (292)..(292): n is a, c, g, or t
  modified_base (344)..(344): a, c, t, g, unknown or other
  misc_feature (344)..(344): n is a, c, g, or t
  modified_base (364)..(364): a, c, t, g, unknown or other
  misc_feature (364)..(364): n is a, c, g, or t
  modified_base (411)..(411): a, c, t, g, unknown or other
  misc_feature (411)..(411): n is a, c, g, or t
  modified_base (418)..(418): a, c, t, g, unknown or other
  misc_feature (418)..(418): n is a, c, g, or t
  modified_base (478)..(478): a, c, t, g, unknown or other
  misc_feature (478)..(478): n is a, c, g, or t
tcagtacgagtatgcacgaccggtgctcgatttagtgtagtgtgaagggaaaggggacccaacaaccacatccctcctgagaagcccccagagcacaactccttaccatggactggacctggaggatcctctttttggtggcagcagccacaggtgcccactcccaggtccagcttgtgcagtctggggctgaggtgaagaagcctggggcctcagtgaaggtttcctgcaagacttctggatactccttcacttagtttttctatccattggctgcgccaggcccccgganaaaggcttgagtgggtgggatggatcaacgctgtcaatggtctcacaaaatnttcacagaagttgacagggnaagagtcacctattaacgtagggacacatccgacgagaacagcctanagtgganctgagcagcctagatatcgtagaagacacggtcttagtattagttctgtcgacggaagtnttgcgagtagggagtacggttacctttaacgtactaacttactactacctagtacgggtacgtcggtaacgggg

SEQ ID NO: 62416 - DNA, 523 bp, Homo sapiens
  misc_feature: GYAE6OF02HDC79.18.70.G04.1.454.CMB.1.raw
  modified_base (341)..(341): a, c, t, g, unknown or other
  misc_feature (341)..(341): n is a, c, g, or t
  modified_base (402)..(402): a, c, t, g, unknown or other
  misc_feature (402)..(402): n is a, c, g, or t
tcagtacgagtatgcacgaccggtgctcgatttagtgtagtgtgaagggaaaggggacccaacaaccacatccctcctgagaagcccccagagcacaactccttaccatggactggacctggaggatcctcttttggtggcagcagccacaggtgcccactcccaggtccagcttgtgcagtctggggctgaggtgaagaagcctggggcctcagtgaaggtttcctgcaagacttctggatactccttcacttagttttctatccattggctgcgccaggcccccggacaaaggcttgagtgggtggatggatcaacgctgtcaatggtctcacaaaatnttcacagaagttgcagggcagagtcaccattactaggacacatccgacgagaacagcctanatggagctagagcagtcctgatatctagaacgacacggctagtatattactgtcgacgagattgcgaggtggaagacgtccttaactactacttactactacagtcggtacgtgtacgggg

SEQ ID NO: 62417 - DNA, 542 bp, Homo sapiens
  misc_feature: GYAE6OF02GCMYK.18.70.G04.1.454.CMB.1.raw
  modified_base (289)..(289): a, c, t, g, unknown or other
  misc_feature (289)..(289): n is a, c, g, or t
  modified_base (342)..(342): a, c, t, g, unknown or other
  misc_feature (342)..(342): n is a, c, g, or t
  modified_base (488)..(488): a, c, t, g, unknown or other
  misc_feature (488)..(488): n is a, c, g, or t
tcagtacgagtatgcacgaccggtgctcgatttagtgtagtgtgaagggaaaggggacccaacaaccacatccctcctgagaagcccccagagcacaactccttaccatggactggacctggaggatcctctttttggtggcagcagccacaggtgcccactcccaggtccagcttgtgcagtctgggctgaggtgaagaagcctggggcctcagtgaaggtttcctgcaagacttctggatactccttcacttagtttttctatccattggctgcgcacggccccganaaaggcttgagtgggtgggatggatcgaacgctgtcaatggtctcaacaaatnttacacagaagttgcagggcagagtcaacattaacgagggacacataccgcgaagaacaggacctaacgatgggaagcgtaggaacgcgagcctaggatatctaggaacgacgacggacttgtatattacgtgtcaggagtagtgnaggtggagtcgttacttactacttactactactacgagtcggtacgtgtacggg

SEQ ID NO: 62418 - DNA, 538 bp, Homo sapiens
  misc_feature: GYAE6OF02GTXR4.18.70.G04.1.454.CMB.1.raw
  modified_base (338)..(338): a, c, t, g, unknown or other
  misc_feature (338)..(338): n is a, c, g, or t
  modified_base (344)..(344): a, c, t, g, unknown or other
  misc_feature (344)..(344): n is a, c, g, or t
  modified_base (469)..(469): a, c, t, g, unknown or other
  misc_feature (469)..(469): n is a, c, g, or t
tcagtacgagtatgcacgaccggtgctcgatttagtgtagtgtgaagggaaaggggacccaacaaccacatccctcctgagaagcccccagagcacaactccttaccatggactggacctggaggatcctcttttggtggcagcagccacaggtgcccactcccaggtccagcttgtgcagtctggggctgaggtgaagaagcctggggcctcagtgaaggtttcctgcaagacttctggatactccttcacttagttttctatccattggctgcgccaggcccccggacaaaggcttgagtgggtgggatggatcgaacgctgtcaatggtctcaanaaaatnttacacagaagttgcaggcagagtcaccattactaggacacactccgcgagaacagcctacatggagctgagcagcctagatatctgaagccgaggcttaggtaatatttactgtagcgaaggtnttggcaggtggagacgttaccttaactaccgttaactactacgtactagttcgggacgttgtacggggg

SEQ ID NO: 62419 - DNA, 523 bp, Homo sapiens
  misc_feature: GYAE6OF02HGGBT.18.70.G04.1.454.CMB.1.raw
  modified_base (404)..(404): a, c, t, g, unknown or other
  misc_feature (404)..(404): n is a, c, g, or t
  modified_base (441)..(441): a, c, t, g, unknown or other
  misc_feature (441)..(441): n is a, c, g, or t
tcagtacgagtatgcacgaccggtgctcgatttagtgtagtgtgaagggaaaggggacccaacaaccacatccctcctgagaagcccccagagcacaactccttaccatggactggacctggaggatcctctttttggtggcagcagccacaggtgcccactcccaggtccagcttgtgcagtctggggctgaggtgaagaagcctggggcctcagtgaaggtttcctgcaagacttctggatactccttcacttagtttttctatccattggctgcgccaggcccccggacaaaggcttgagtgggtgggatggatcaacgctgtcaatggtctcacaaaatattcacagaagttgcagggcagagtcacattactagggacacatccgcgagaacagcctanatggagctgagcagcctgatatctagaagacgacggntagtatattacgtgtggcgaggtattgcaggtggagtagttccttaacgtactacttactactacagtcggacgtgtacggg

SEQ ID NO: 62420 - DNA, 521 bp, Homo sapiens
  misc_feature: GYAE6OF02GA6NZ.18.70.G04.1.454.CMB.1.raw
  modified_base (290)..(290): a, c, t, g, unknown or other
  misc_feature (290)..(290): n is a, c, g, or t
  modified_base (391)..(391): a, c, t, g, unknown or other
  misc_feature (391)..(391): n is a, c, g, or t
  modified_base (416)..(416): a, c, t, g, unknown or other
  misc_feature (416)..(416): n is a, c, g, or t
tcagtacgagtatgcacgaccggtgctcgatttagtgtagtgtgaagggaaaggggacccaacaaccacatccctcctgagaagcccccagagcacaactccttaccatggactggacctggaggatcctctttttggtggcagcagccacaggtgcccactcccaggtccagcttgtgcagtctggggctgaggtgaagaagcctggggcctcagtgaaggtttcctgcaagacttctggatactccttcactagtttttcatccattggctgcgccaggtccccgganaaaggcttgagtgggtgggatgggatcaacgctgtcaatggtctcaacaaaatattcacagaagttgcagggcagagtcacattactagggacacatccgngagaacagcctaacatggagctgancagcctgatatctgaagcacggctgtatattactgtgcggagtattgctaggtggaagagttccttaactacgtacttactactacagtcggtacgtgtacgggg

SEQ ID NO: 62421 - DNA, 675 bp, Homo sapiens
  misc_feature: GYAE6OF02IF1LJ.18.70.G04.1.454.CMB.1.raw
  modified_base (298)..(298): a, c, t, g, unknown or other
  misc_feature (298)..(298): n is a, c, g, or t
tcagtacgagtatgcacgaccggtgctcgatttagtgtagtgtgaagggaaaggggacccgaacaaccacatccctcctgagaagcccccagagcacaactccttaccatggactggacctggaggatcctctttttggtggcagcagccacaggtgcccactcccaggtccagcttgtgcagtctgggggctggaggtgaagaagccgtggggcctcagtgaaaggtttcctgcaagtacttctggatactccttcactagtttttcatccattggctgcgcctacggcccccgganaaaaggcttggagtggggtgggatggatcgaaacgctgtacaatggtctacaacctaaaaatatttacaactaagaaacggtttgacgaaggggaccaagtacggtacaacctaagtttaaccgtaaggggaacctacgaagtcccggtacgaaggaaaccaaggtacccttaaacacgttagggaaacgtcgttaggaacggacaacggaccgttagaataacgttcctaggaaacgacgaaccggtcttaaggtaattaacttaacgttggtacggacgtaaggtaagtttggacgtaagggttggaaagtacggtttaccttaaccgttactaaccttaccgtaactataaggtcgggtacgtagtacgggggg

SEQ ID NO: 62422 - DNA, 661 bp, Homo sapiens
  misc_feature: GYAE6OF02HAG21.18.70.G04.1.454.CMB.1.raw
tcagtacgagtatgcacgaccggtgctcgatttagtgtagtgtgaagggaagggggacccaacaaccacatccctcctgagaagcccccagagcacaactccttaccatggactggacctggaggatcctcttttggtggcagcagccacaggtgcccactcccaggtccagcttgtgcagtctggggctgaggtgaagaagcctggggcctcagtgaaggtttcctgcaagacttctggatacctccttcacttagttttctatccattggctgcgccaggcccccggacaaacggcttgagtgggtggagtggatcgaacgcgtgtcaagtcggtctacaacaaaatattaccacagaagttgcgagggcaagagtcacattacgtagggaccactacgtcccgacgaacgaaccagaccctaacaagttgggagtcgtagacgacgacgtcctaggacttagtccgttaggaaacgaccgtacgggtacttaggttaaacgttatttaaccgtggttacggaccggtaaaggttagttcggtacgtacgggttagggtaacggtacgtttaccccgtttaacgtaacccgtttaaccgttaaccttaacccgttaacgaacggtttacgggtaaccgggtttcggtaacccggggggg

SEQ ID NO: 62423 - DNA, 527 bp, Homo sapiens
  misc_feature: GYAE6OF02GBQD4.18.70.G04.1.454.CMB.1.raw
  modified_base (475)..(475): a, c, t, g, unknown or other
  misc_feature (475)..(475): n is a, c, g, or t
tcagtacgagtatgcacgaccggtgctcgatttagtgtagtgtgaagggaaaggggacccaacaaccacatccctcctgagaagcccccagagcacaactccttaccatggactggacctggaggatcctctttttggtggcagcagccacaggtgcccactcccaggtccagcttgtgcagtctggggctgaggtgaagaagcctggggcctcagtgaaggtttcctgcaagacttctggatactccttcacttagtttttctatccattggcttgcgccacggcccccggacaaaggcttgagtgggtgggatggatcaacgctgtcaatggtctcacaaaatattacacagaagttgacagggcagagtcaacattactagggacacatccgcgagaacagcctacatggagctgagcacgcctgatatctagaagacacggctagtatattacgttgtgacgaggtattgngagtggagtattccttaactctactactactactatcggtacgtgtacgggg

SEQ ID NO: 62424 - DNA, 698 bp, Homo sapiens
  misc_feature: GYAE6OF02F3U0P.18.70.G04.1.454.CMB.1.raw
  modified_base (287)..(287): a, c, t, g, unknown or other
  misc_feature (287)..(287): n is a, c, g, or t
tcagtacgagtatgcacgaccggtgctcgatttagtgtagtgtgaagggaaaggggacccaacaaccacatccctcctgagaagcccccagagcacaactccttaccatggactggacctggaggatcctctttttggtggcagcagccacaggtgcccactcccaggtccagcttgtgcagtctggggctgaggtgaagagcctggggcctcagtgaaggtttcctgcagacttctggatactcttcactagttttctatccattggctgcgccacggccccgganaagcttgagtgggtggatggatcaacgctgtacaagtggtcctcgaactaaaattcgttacaacgtaagtaaggtttgacgtaaggggcaaggtagtaccgaacctaatttaaccgtaaggggaacctaacacgtaccggacggagaaaaccacggtaccctaacgtaagtacgggaaagtccgttacgggaacgtccgtaaacggtcccgttaaggtacgttaacttaccgtaggtaaaacggtacctaaccgggtaccttagggttaacttaacgtttaaccgttgtaacgtccggtaaggtagttgaccgtaggtacgggtaagtaccggtttaccttaaccgttaaccgttaaccttaccgttaaccttaaccgttacgtaacgggtaccgttacgttaacgggggg

SEQ ID NO: 62425 - DNA, 655 bp, Homo sapiens
  misc_feature: GYAE6OF02HCP8S.18.70.G04.1.454.CMB.1.raw
  modified_base (291)..(291): a, c, t, g, unknown or other
  misc_feature (291)..(291): n is a, c, g, or t
tcagtacgagtatgcacgaccggtgctcgatttagtgtagtgtgaagggaaaggggacccaacaaccacatccctcctgagaagcccccagagcacaactccttaccatggactggacctggaggatcctctttttggtggcagcagccacaggtgcccactcccaggtccagcttgtgtagtctggggctgaggtgaagaagcctggggcctcagtgaaggtttcctgcaagacttctggatactccttcacttagttttctatccattggctgcgccacggcccccganaaacggcttgagtgggtgggatggatcgaacgctgtcaagttggtctacaacaaaattacttacaacaggtaagttgacgtagggacagagtaccactaattacgaagggacacgactcccgacgaacgaaacgacgtaccctaacgagtaggagtcgtacgaagccgacgtccgtaggtacttactacgtaagaaaccggaccgtacgggtccttaagtacgtttaactttaacgttggttacgaaggtacgggttaattcggaacgtacgggttagggacggtaacgtttaccctttaactaaccttaccgttaacgttacctacgtacgtacggtaccggttacggtacggggtaaaccgg

SEQ ID NO: 62426 - DNA, 578 bp, Homo sapiens
  misc_feature: GYAE6OF02IFTFH.18.70.G04.1.454.CMB.1.raw
  modified_base (249)..(249): a, c, t, g, unknown or other
  misc_feature (249)..(249): n is a, c, g, or t
  modified_base (335)..(335): a, c, t, g, unknown or other
  misc_feature (335)..(335): n is a, c, g, or t
  modified_base (376)..(376): a, c, t, g, unknown or other
  misc_feature (376)..(376): n is a, c, g, or t
  modified_base (397)..(397): a, c, t, g, unknown or other
  misc_feature (397)..(397): n is a, c, g, or t
tcagtacgagtatgcacgaccggtgctcgatttagtgtagtgtgaagggaaaggggacccaacaaccacatccctcctgagaagcccccagagcacaactccttaccatggactggacctggaggatcctctttttggtggcagcagccacaggtgcccactcccaggtccagcttgtgcagtctggggctgaggtgagaagcctgggcctcagtgaaggtttcctgcaagacttctggatactccttnactagttttcatccattggctgcgccaggccccgacaaaggcttgagtgggtggatggatcaacgctgtcaatggtctcacaaatntacacagagttgcagggacagagtcaccattacagggacanatccgacgagaacagacctanatggagctagacgcacgtcctagatatcgtagaaagacaacgggcttaggtaacttaattaaccgtggtagaccggtaggtaattggacgtaggtggtaaggtaacgttacccttaacgttaaccttaacgttaccgttaacttaaccgaagtttacgggtaccgttaggtaaccgggggg

SEQ ID NO: 62427 - DNA, 538 bp, Homo sapiens
  misc_feature: GYAE6OF02JCPR2.18.70.G04.1.454.CMB.1.raw
  modified_base (216)..(216): a, c, t, g, unknown or other
  misc_feature (216)..(216): n is a, c, g, or t
  modified_base (231)..(231): a, c, t, g, unknown or other
  misc_feature (231)..(231): n is a, c, g, or t
  modified_base (280)..(280): a, c, t, g, unknown or other
  misc_feature (280)..(280): n is a, c, g, or t
  modified_base (339)..(339): a, c, t, g, unknown or other
  misc_feature (339)..(339): n is a, c, g, or t
  modified_base (350)..(350): a, c, t, g, unknown or other
  misc_feature (350)..(350): n is a, c, g, or t
  modified_base (419)..(419): a, c, t, g, unknown or other
  misc_feature (419)..(419): n is a, c, g, or t
  modified_base (435)..(435): a, c, t, g, unknown or other
  misc_feature (435)..(435): n is a, c, g, or t
  modified_base (448)..(448): a, c, t, g, unknown or other
  misc_feature (448)..(448): n is a, c, g, or t
tcagtacgagtatgcacgaccggtgctcgatttagtgtagtgtgaagggaaaggggacccgaacaaccacatccctcctgagaagcccccagagcacaactccttaccatggactggacctggaggatcctcttttggtggcagcagccacaggtgcccactcccaggtccagcttgtgctagtctggggcctgaggtgaagaagcctggggcctnagtgaagggtttccngcaagacttctgggatactccttcactagttttctatccattggctgcnccaggcccccggacaaaggcttgagtgggtgggagtggatcgaacgctggtcaatggtntcgacaaaatnttcaacagaagttgcagggcaggagtcactatactagggacacatccgcgaagaacagcctacatgganctgagcagcctgatanctagaagacaggntgtatattacgtgtgacgagtattgctaggtggaagtacgtccgttactaactacgttactactacgtagtcggtaccgtcgtacggggg

SEQ ID NO: 62428 - DNA, 559 bp, Homo sapiens
  misc_feature: GYAE6OF02I73HJ.18.70.G04.1.454.CMB.1.raw
  modified_base (273)..(273): a, c, t, g, unknown or other
  misc_feature (273)..(273): n is a, c, g, or t
  modified_base (327)..(327): a, c, t, g, unknown or other
  misc_feature (327)..(327): n is a, c, g, or t
  modified_base (399)..(399): a, c, t, g, unknown or other
  misc_feature (399)..(399): n is a, c, g, or t
tcagtacgagtatgcacgaccggtgctcgatttagtgtagtgtgaagggaaaggggacccaacaaccacatccctcctgagaagcccccagagcacaactccttaccatggactggacctggaggatcctctttttggtggcagcagccacaggtgcccactcccaggtccagcttgtgcagtctggggctgaggtgaagagcctggggcctcagtgaaggtttcctgcaagacttctggatactccttcacttagttttctatcctattggntgcgccacggccccggacaagcgttgagtgggtggagtggatcgaacgctgtanagtcggtctacacaaatatacacagtaagttgcaggcagatacactagttacaggacacacgtaccgcgaanaaccgagacctacagtacgagctagagcgacgctgatatacgtagaagacgtacgactgtaattattcgtaggttcacggtaagtagttgacgtggtacggagttacgttacttacttactacttaacttactacgtacgtacggtcgtacggtacgggg

SEQ ID NO: 62429 - DNA, 650 bp, Homo sapiens
  misc_feature: GYAE6OF02JITA7.18.70.G04.1.454.CMB.1.raw
  modified_base (290)..(290): a, c, t, g, unknown or other
  misc_feature (290)..(290): n is a, c, g, or t
  modified_base (301)..(301): a, c, t, g, unknown or other
  misc_feature (301)..(301): n is a, c, g, or t
  modified_base (410)..(410): a, c, t, g, unknown or other
  misc_feature (410)..(410): n is a, c, g, or t
  modified_base (434)..(434): a, c, t, g, unknown or other
  misc_feature (434)..(434): n is a, c, g, or t
  modified_base (444)..(444): a, c, t, g, unknown or other
  misc_feature (444)..(444): n is a, c, g, or t
tcagtacgagtatgcacgaccggtgctcgatttagtgtagtgtgaagggaaagggacccaacaaccacatccctcctgagaagcccccagagcacaactccttaccatggactggacctggaggatcctctttttggtggcagcagccacaggtgcccactcccaggtccagcttgtgcagtctggggctggaggtgaagaagccgtgggcctcagtgaagtttcctgcaagtcttctgatactccttcacttagttttcatccattggctgccgccgacggccccgaanaaggtcttggnggtgggtggagtaggactacgaacgtctgtacagtgtcctacaacaaatcttacagtagtacgttgacgaggccagtactacacgtatacgacggacactcgtaccggnaacgaactacactacgagtacggnacgtaggacncgtacgtctagtaactacgtacgtaacggaacgtacgtacgtaacgttacttaacgttaaggttccgaggtacggtaacggtacgttcggtaacgtaggttacgggtacgttaacccggttaacctttaaaccctacggttaaaccttaaccggttactaaccggttacggacggtttaaccggtacgggtaccgggtaaaccggg

SEQ ID NO: 62430 - DNA, 585 bp, Homo sapiens
  misc_feature: GYAE6OF02GRXUX.18.70.G04.1.454.CMB.1.raw
  modified_base (340)..(340): a, c, t, g, unknown or other
  misc_feature (340)..(340): n is a, c, g, or t
tcagtacgagtatgcacgaccggtgctcgatttagtgtagtgtgaagggaaaggggacccaacaaccacatccctcctgagaagcccccagagcacaactccttaccatggactggacctggaggatcctctttttggtggcagcagccacaggtgcccactccctggtccagcttgtgcagtctggggctgaggtgaagaagcctggggcctcagtgaaggtttcctgcaagacttctggatactccttcacttagttttcatcctattggctgcgccacggcccccggacaaaggcttgagtgggtggagtggatcgaacgctgtcaatggtctcaanaaaatattcaactagaagttcgacagggcaagagtcaacattacgtagggacacacgtccgacgaacgaacacgaccctaacgataggggatcgtacggacgtcgaacggtccctagtactatctaggaacgacgacggactagtacttagttactggtcgacgtagattggactaggtcggaagtaacgttccttaacgtacctaacttaccgttaactagtactacgggtacctggtacgggg

SEQ ID NO: 62431 - DNA, 664 bp, Homo sapiens
  misc_feature: GYAE6OF02I3TYN.18.70.G04.1.454.CMB.1.raw
  modified_base (215)..(215): a, c, t, g, unknown or other
  misc_feature (215)..(215): n is a, c, g, or t
  modified_base (230)..(230): a, c, t, g, unknown or other
  misc_feature (230)..(230): n is a, c, g, or t
  modified_base (241)..(241): a, c, t, g, unknown or other
  misc_feature (241)..(241): n is a, c, g, or t
  modified_base (293)..(293): a, c, t, g, unknown or other
  misc_feature (293)..(293): n is a, c, g, or t
tcagtacgagtatgcacgaccggtgctcgatttagtgtagtgtgaagggaaaggggacccaacaaccacatccctcctgagaagcccccagagcacaactccttaccatggactggacctggaggatcctctttttggtggcagcagccacaggtgcccactcccaggtccagcttgtgcagtctggggctgaggtgaagaagccgtggggcctnagtgaaggttttccngcaagacttcnggatactccttcacttagttttcatcctattggctgcgccaggcccccgganaaaggcttgagtgggtcgggatggatcgaacgctgtcaatggtctcaactaaatattcacagaagttgactaggcagagttacgaacctagttaacctaacgggacaaccgtacgtacccgacggaaagaaaccacggtaccctaactaacgtaggtaacggaccgttaggaagaccgtaaggccccgttaggaacttataccgttaggaaacggaacgaccggtagtaccggtaattaacgtttaaccgtgttaggaccgtaagggtccttaggtaccgtagggtggtaaggtaccggttacctttaacggttaccttaacgtttaacctaccttaacgaggtttacggtacggttaccggtaacggggg

SEQ ID NO: 62432 - DNA, 589 bp, Homo sapiens
  misc_feature: GYAE6OF02IZCUD.18.70.G04.1.454.CMB.1.raw
  modified_base (139)..(139): a, c, t, g, unknown or other
  misc_feature (139)..(139): n is a, c, g, or t
  modified_base (179)..(179): a, c, t, g, unknown or other
  misc_feature (179)..(179): n is a, c, g, or t
  modified_base (213)..(213): a, c, t, g, unknown or other
  misc_feature (213)..(213): n is a, c, g, or t
  modified_base (233)..(233): a, c, t, g, unknown or other
  misc_feature (233)..(233): n is a, c, g, or t
  modified_base (243)..(243): a, c, t, g, unknown or other
  misc_feature (243)..(243): n is a, c, g, or t
  modified_base (261)..(261): a, c, t, g, unknown or other
  misc_feature (261)..(261): n is a, c, g, or t
  modified_base (267)..(267): a, c, t, g, unknown or other
  misc_feature (267)..(267): n is a, c, g, or t
  modified_base (276)..(276): a, c, t, g, unknown or other
  misc_feature (276)..(276): n is a, c, g, or t
  modified_base (330)..(330): a, c, t, g, unknown or other
  misc_feature (330)..(330): n is a, c, g, or t
  modified_base (346)..(346): a, c, t, g, unknown or other
  misc_feature (346)..(346): n is a, c, g, or t
  modified_base (373)..(373): a, c, t, g, unknown or other
  misc_feature (373)..(373): n is a, c, g, or t
  modified_base (391)..(391): a, c, t, g, unknown or other
  misc_feature (391)..(391): n is a, c, g, or t
  modified_base (398)..(398): a, c, t, g, unknown or other
  misc_feature (398)..(398): n is a, c, g, or t
  modified_base (401)..(401): a, c, t, g, unknown or other
  misc_feature (401)..(401): n is a, c, g, or t
tcagtacgagtatgcacgaccggtgctcgatttagtgtagtgtgaagggaaaggggacccaacaaccacatccctcctgagaacgcccccagagcacaactccttaccatggactggacctggaggatcctcttttggnggcagcagccacaggtcgcccactcccaggtccagcttgngcagtcgtgggctggagtgaagagcctgggcctnagtgaggtttcgcaagcttnggatctcttnacttgttttcatcattgntgcacncgccccganaaggcttgagtggtggatggatcaacgctgtacaagtgtctcaataaatatcanagtaacttgacagggntagacgtcactattacgaggacaacgntcgcgaagactagcctanagtggancgngaagctaagcctagactatccgagaacgacgttaccgggactagtaacttacgtaaccgttagtccggacgtagggtaactttcggaccgtacggttaggacgttaacggttaccttaaccgttaaccgttaacgttaaccttaacccggtattaaccgggtacggttaccgtagggttaacccgggg

SEQ ID NO: 62433 - DNA, 539 bp, Homo sapiens
  misc_feature: GYAE6OF02FPQZV.18.70.G04.1.454.CMB.1.raw
tcagtacgagtatgcacgaccggtgctcgatttagtgtagtgtgaagggaaaggggacccaacaaccacatccctcctgagaagcccccagagcacaactccttaccatggactggacctggaggatcctcttttggtggcagcagccacaggtgcccactcccaggtccagcttgtgcagtctggggctgaggtgaagagcctggggcctcagtgaaggtttcctgcaagactttctggatactccttcacttagtttttcatccattggctgcgccaggcccccggacaaaggcttggagtggggtgggatggatcgaacgctgtcaagtggtctcaacaaaatattcacagaattgcagggcagatcacattacagggacacatccgacgagaacagacctacagtggagctgagcagcctgatatctagaacgacacggactcgtaattattaacgttgtcgacggtaggtattgcgtagtggagtagttaccgttaactacttaactactactacagtcggacgtcgtacgggg

SEQ ID NO: 62434 - DNA, 667 bp, Homo sapiens
  misc_feature: GYAE6OF02JOM1H.18.70.G04.1.454.CMB.1.raw
  modified_base (296)..(296): a, c, t, g, unknown or other
  misc_feature (296)..(296): n is a, c, g, or t
  modified_base (413)..(413): a, c, t, g, unknown or other
  misc_feature (413)..(413): n is a, c, g, or t
tcagtacgagtatgcacgaccggtgctcgatttagtgtagtgtgaagggaaaggggacccaacaaccacatccctcctgagaagcccccagagcacaactccttaccatggactggacctggaggatcctcttttggtggcagcagccacaggtgcccactcccaggtccagcttgtgcagtctggggctgaggtgaagagcctggggcctcagtgaaggtttcctgacaagacttctggatacctccttgacttagtttttccaatcctatttgctagcgcctacggcccccganaaggcttgagtcgggtggatggactcaacgctgtcaagtcggtctacgactaaatcgttacaacagtaagttgaccgagggctaacgagtcaacctagtttaacgaggggaccaacncttacccggacgacgaaacaggaccctacaagtcggtaagacctaggacgacaggtaccctagaacgttactaccgttacggaaagtaccgacgggtacttaccgttaaagttactttaacccggtgttacgacggtaaggggttaacttcgggactacggggttacggtaaggtaaccggtttccctttaacggtaccttaacggttacccttaaccggttaaatccgtaagggttaccgttcggtaacgggg

SEQ ID NO: 62435 - DNA, 583 bp, Homo sapiens
  misc_feature: GYAE6OF02IB69Q.18.70.G04.1.454.CMB.1.raw
  modified_base (214)..(214): a, c, t, g, unknown or other
  misc_feature (214)..(214): n is a, c, g, or t
  modified_base (289)..(289): a, c, t, g, unknown or other
  misc_feature (289)..(289): n is a, c, g, or t
  modified_base (344)..(344): a, c, t, g, unknown or other
  misc_feature (344)..(344): n is a, c, g, or t
  modified_base (407)..(407): a, c, t, g, unknown or other
  misc_feature (407)..(407): n is a, c, g, or t
  modified_base (448)..(448): a, c, t, g, unknown or other
  misc_feature (448)..(448): n is a, c, g, or t
tcagtacgagtatgcacgaccggtgctcgatttagtgtagtgtgaagggaaaggggacccaacaaccacatccctcctgagaagcccccagagcacaactccttaccatggactggacctggaggatcctctttttggtggcagcagccacaggtgcccactcccaggtccagcttgtgcagtctggggctgaggtgagaagcctggggcctcngtgaaggtttcctgcaagacttctggatactccttcacttagttttcatccattggctgcgccaggcccccgganaaaggcttgaggtgggtgggatggatcgaacgctgtcaatggtctacacaaaatnttcacagaagttgcagggcagagtcaactatacagggacacatccgagaagaacacgcctaanagtggagctaggagcagcctgatatctagaacgacgacggnttggtaacttacgttacgttacgtcggtaacggaagggtactttggcgtaagggttcggaaggtaacgttccgttaacctaacgttaccttacgtaacttaaccgtaagtacgggtaccggttacgtaacggggg

SEQ ID NO: 62436 - DNA, 527 bp, Homo sapiens
  misc_feature: GYAE6OF02JHNTN.18.70.G04.1.454.CMB.1.raw
  modified_base (345)..(345): a, c, t, g, unknown or other
  misc_feature (345)..(345): n is a, c, g, or t
tcagtacgagtatgcacgaccggtgctcgatttagtgtagtgtgaagggaaaggggacccaacaaccacatccctcctgagaagcccccagagcacaactccttaccatggactggacctggaggatcctctttttggtggcagcagccacaggtgcccactcccaggtccagcttgtgcagtctggggctgaggtgaagaagcctggggcctcagtgaaggtttcctgcaagacttctggatactccttcacttagtttttctatccattggcttgcgccaggcccccggacaaaggcttgagtgggtgggatggatcaacgctgtcaatggtctcacaaaatnttcacagaagttgcagggcagagtcacatactagggacacatccgcgagaacagcctacatggagcgtgacgcagcctgatatctagaacgacgacggctagtatagttactgtgcgaggtattgcagtggaagtcgttaccttactacttactactactactagtggaccgtgtaacgggg

SEQ ID NO: 62437 - DNA, 572 bp, Homo sapiens
  misc_feature: GYAE6OF02FJ8X2.18.70.G04.1.454.CMB.1.raw
  modified_base (289)..(289): a, c, t, g, unknown or other
  misc_feature (289)..(289): n is a, c, g, or t
tcagtacgagtatgcacgaccggtgctcgatttagtgtagtgtgaagggaaaggggacccaacaaccacatccctcctgagaagcccccagagcacaactccttaccatggactggacctggaggatcctcttttggtggcagcagccacaggtgcccactcccaggtccagcttgtgcagtctggggctgaggtgaagaagcctggggcctcagtgaaggtttcctgcaagacttctggatactccttcacttagttttcatccattggctgcgccaggcccccgganaaaggcttgagtgggtgggatggatcaacgctgtcaatggtctcacaaaatattacacagaagttgcagggcagagtcaccattacctagggacacatccgcgaagaacagcctacagtgggactcgtaggacgcacgccgtagatactcgtagaaaggtaccacgggcttttaatatttacttgtgaccgtaggtattcggacctaggttcggagtacgttacctttacctaaccttacttaaccttactacgagttcgggacgttcggtaggggaacccgg

SEQ ID NO: 62438 - DNA, 633 bp, Homo sapiens
  misc_feature: GYAE6OF02HSXFE.18.70.G04.1.454.CMB.1.raw
  modified_base (238)..(238): a, c, t, g, unknown or other
  misc_feature (238)..(238): n is a, c, g, or t
  modified_base (315)..(315): a, c, t, g, unknown or other
  misc_feature (315)..(315): n is a, c, g, or t
  modified_base (344)..(344): a, c, t, g, unknown or other
  misc_feature (344)..(344): n is a, c, g, or t
  modified_base (481)..(481): a, c, t, g, unknown or other
  misc_feature (481)..(481): n is a, c, g, or t
  modified_base (489)..(489): a, c, t, g, unknown or other
  misc_feature (489)..(489): n is a, c, g, or t
  modified_base (509)..(509): a, c, t, g, unknown or other
  misc_feature (509)..(509): n is a, c, g, or t
tcagtacgagtatgcacgaccggtgctcgatttagtgtagtgtgaagggaaaggggacccaacaaccacatccctcctgagaagcccccagagcacaactccttaccatggactggacctggaggatcctctttttggtggcagcagccacaggtgcccactcccaggtccagcttgtgcagtctggggctgaggtgaagaagcctgggcctcgagtgaaggtttcctgcaagacttntggatacctccttcacttagtttttctacttccattggctgcgcctacggccccgacgaaacgctcgaggtggtggntggatcgaacgctgtcagtggtctacaanaaacttatcacgagtaagttgacgagggcaaggtataccgtaaccagtttaacgacgggtaactacacgtccgacggtaagaaaccgtacgtacctaacaggttagggacgcgttggacggactacggtaacccgtnaagttacncgtagaacggcctaacgggnttaggtaacttagttacgttaggtaggacgagttaagttgacgtacggtggaacgttacggtaccctttaagtacccttaacgtacttttaccaataccggtacggttaccgtggtaaccgggg

SEQ ID NO: 62439 - DNA, 603 bp, Homo sapiens
  misc_feature: GYAE6OF02GKMWU.18.70.G04.1.454.CMB.1.raw
  modified_base (423)..(423): a, c, t, g, unknown or other
  misc_feature (423)..(423): n is a, c, g, or t
  modified_base (432)..(432): a, c, t, g, unknown or other
  misc_feature (432)..(432): n is a, c, g, or t
tcagtacgagtatgcacgaccggtgctcgatttagtgtagtgtgaagggaaaggggacccaacaaccacatccctcctgagaagccccagagcacaactccttaccatggactggacctggaggatcctctttttggtggcagcagccacaggtgcccactcccaggtccagcttgtgcagtctggggctgaggtgaagagcctggggcctcagtgagtttcctgcagacttctggatactccttcacttagtttttctatccattggctgcgccacggcccccggacaaaggcttgacgtgggtgggatggatcaacgctagtcaatggtctcgacaaaatattacacagtaagtgcagggcagagtcaccattacgtaggacacactccgacgagaacagacctacagtggagctagacgnagctgatanctagacgacgacggcttaggtatacttaacgttgtacggtacggacgggtagtttcggatacgggttacgggaaggtaaccgtttcccggttaacttaacccgtttaacgttaacccgttaaaccttaaccgtaacgtttacgggtacccggttccggttaaacggggggg

SEQ ID NO: 62440 - DNA, 789 bp, Homo sapiens
  misc_feature: GYAE6OF02IUEFS.18.70.G04.1.454.CMB.1.raw
tcagtacgagtatgcacgaccggtgctcgatttagtgtagtgtgaagggaaaggggacccaacaaccacatccctcctgagaagcccccagagcacaactccttaccatggactggacctggaggatccttctttttgggtggcagcagccacaggtgccactcccaggtccagcttgtgcgagtcgtggggtctaggagggtaggaaaggaacgccgtcggggcctcgaaggtaggtaagggtttcctagacaaggtacttcgtaggtataccttccttactactttagtttttactacttcctagttggtcttcgcggaccgtaccgggacccccggaaaccgaaacgggtccttaggagggtcgggggtaggtacggtgggtactacgtaacggtcgtagtagtaacgttcggtacgtaacaaacgttaaaaattacttaacgtaaacgaaggttaaacggttacggacggtaacggggactaacggtaacggtactaaaccgttaacgttaaaccggttaagggaaccgtaacctaaccgttacccgggaacggaaaccgtaaaccgaacggtaaccctaaacgaaggtaacggtacgggtacggttaggaacggtacgaacgtccgttaaggaactaacgttaacgtaacgaacgggtaaccgtacgggtagttacgtaaagttaacgttacgtgtacggtacggtaggtacgttgacgtaggtacgagtacgttacttaacgtactaacttaacgtctacgtacgtacggtacgtggaacggg

SEQ ID NO: 62441 - DNA, 705 bp, Homo sapiens
  misc_feature: GYAE6OF02H5IUP.18.70.G04.1.454.CMB.1.raw
  modified_base (292)..(292): a, c, t, g, unknown or other
  misc_feature (292)..(292): n is a, c, g, or t
  modified_base (629)..(629): a, c, t, g, unknown or other
  misc_feature (629)..(629): n is a, c, g, or t
tcagtacgagtatgcacgaccggtgctcgatttagtgtagtgtgaagggaaaggggacccaacaaccacatccctcctgagaagcccccagagcacaactccttaccatggactggacctggaggatccttctttttggtggcagcagccacagggtcgcccacctcccaggtccagcttgtgcagtcgtggggctggaggtgaagagccgtggggcctcgagtggaaggtttcctgcaagtacttcgtggtatacctccttactacttacgtttttcattcctagttcggnttgccggtccgaccgggcccccggaacgtaaaggtccgttggaggtggggtggtagtaggactacgaacgtcttgtacagtcggttacacaaaactaaaatacgttacaacgtagtaacgttcgacggtaggcaaggtaacgtacaaccgttacttaaacgtaacgggtaaccaacgacgtacccggacgtaaacgaaccgaaccgaccttaacgaagtacgggaagtcgtagacgacgacgtctagaactacttacgaagaacgtacgaacgggtattaggtaaacttacgtttacgagttcgaacgggttaattactaggacgtagggttacggnggttaaccgtttacgtaaccctttaacgtactttaccgaacttacgtaaggtttcgggtaccgttcgggtaacggg

SEQ ID NO: 62442 - DNA, 566 bp, Homo sapiens
  misc_feature: GYAE6OF02IXVP3.18.70.G04.1.454.CMB.1.raw
  modified_base (212)..(212): a, c, t, g, unknown or other
  misc_feature (212)..(212): n is a, c, g, or t
  modified_base (287)..(287): a, c, t, g, unknown or other
  misc_feature (287)..(287): n is a, c, g, or t
  modified_base (347)..(347): a, c, t, g, unknown or other
  misc_feature (347)..(347): n is a, c, g, or t
  modified_base (399)..(399): a, c, t, g, unknown or other
  misc_feature (399)..(399): n is a, c, g, or t
  modified_base (451)..(451): a, c, t, g, unknown or other
  misc_feature (451)..(451): n is a, c, g, or t
  modified_base (511)..(511): a, c, t, g, unknown or other
  misc_feature (511)..(511): n is a, c, g, or t
tcagtacgagtatgcacgaccggtgctcgatttagtgtagtgtgaagggaaaggggacccaacaaccacatccctcctgagaagcccccagagcacaactccttaccatggactggacctggaggatcctcttttggtggcagcagccacaggtgcccactcccaggtccagcttgtgcagtctggggctgaggtgaagagcctggggcctnagtgaaggtttcctgcaagacttctggatacctccttcacttagttttcatcctattgctgcgcacggccccganaaggcttgagtgggtggatggactacgaacgctagtcaagtggtctacgaactaaaattnttacactagaagttgacgagggcaaggacgtacaactattacgtagggaacncgaacgtccgacgaagaacagcctaacgagtggactactgacgcacgctagntatcgagaagtacacggtctagtatagttacgtgtggacgagtattggacgtaggtaggngtacttaccttaactactacgttactacgtacagttcggtacgtcggtaaccggg

SEQ ID NO: 62443 - DNA, 544 bp, Homo sapiens
  misc_feature: GYAE6OF02HHKHL.18.70.G04.1.454.CMB.1.raw
  modified_base (430)..(430): a, c, t, g, unknown or other
  misc_feature (430)..(430): n is a, c, g, or t
tcagtacgagtatgcacgaccggtgctcgatttagtgtagtgtgaagggaaaggggacccaacaaccacatccctcctgagaagcccccagagcacaactccttaccatggactggacctggaggatcctctttttggtggcagcagccacaggtgcccactcccaggtccagcttgtgcagtctggggctgaggtgaagaagcctggggcctcagtgaaggtttcctgcaagacttctggatactccttcactagtttttcatccattggctgcgccaggcccccgacaaaggcttgagtgggtgggatggatcgaacggctggtcaatggtctcacaaaagtattcactagaaagttgacagggccaggagtcacctattactagggacacgactccgcgaagaacagcctaacatggagctgagcancctgatatctagaacgacacggtactgtaatattactgtgcgtagtattgcgtaggtggaatacgtcctttaagtaccttactacttactactaagtcggtacgtcgtacgggg

SEQ ID NO: 62444 - DNA, 653 bp, Homo sapiens
  misc_feature: GYAE6OF02GOH40.18.70.G04.1.454.CMB.1.raw
  modified_base (213)..(213): a, c, t, g, unknown or other
  misc_feature (213)..(213): n is a, c, g, or t
  modified_base (227)..(227): a, c, t, g, unknown or other
  misc_feature (227)..(227): n is a, c, g, or t
  modified_base (361)..(361): a, c, t, g, unknown or other
  misc_feature (361)..(361): n is a, c, g, or t
tcagtacgagtatgcacgaccggtgctcgatttagtgtagtgtgaagggaaagggacccaacaaccacatccctccctgagaacgcccccagagcacaactccttaccatggactggacctggaggatcctctttttggtggcagcagccacaggtgcccactcccaggtccagcttgtgcagtctggggctgaggtgaagagctggggcctnagtgaaggtttccngcaagcttctggatactccttcacttagtttttctatcctagttcggctgcgccgacggtcccccggacaaaggccttaggagttggggtcggagtggatcgaacgtctgtcaatcggtctacgaactaaattnttacacgagtaagttcgacgtagggcaagagtccaactattacgtagggacacgacgtccgtgaacgaacacgtacctacgagtggacgtctaggacgcgacgcctagaattatcgtagaacgacgacggtacttagttaattacgtttaacgtggttacggaccggtaaggttagttacgacgtaaggttacgggaacggtttaccggtttaccctttaacgttaaacctttaaccgttaaccgttaacttaaccgtagtttaccgggtaaccggttcggttaaccggggg

SEQ ID NO: 62445 - DNA, 590 bp, Homo sapiens
  misc_feature: GYAE6OF02H7W25.18.70.G04.1.454.CMB.1.raw
  modified_base (250)..(250): a, c, t, g, unknown or other
  misc_feature (250)..(250): n is a, c, g, or t
  modified_base (341)..(341): a, c, t, g, unknown or other
  misc_feature (341)..(341): n is a, c, g, or t
  modified_base (357)..(357): a, c, t, g, unknown or other
  misc_feature (357)..(357): n is a, c, g, or t
tcagtacgagtatgcacgaccggtgctcgatttagtgtagtgtgaagggaaaggggacccaacaaccacatccctcctgagaagcccccagagcacaactccttaccatggactggacctggaggatcctctttttggtggcagcagccacaggtgcccactcccaggtccagcttgtgcagtctggggctgaggtgaagagcctggggcctcagtgaaggtttcctgcaagacttctggatactccttnacttagttttctatccattggctgcgccaggccccgacaaaggcttgagtggtggatggatcaacgctgtcaagtggtctacactaaaatnttacaacagaagttgnagggcagagtcacctattacaggacacatccgacgagaaccagaccttaacgatgggaagctaggacgctaacggcccttagaacttactacgtaggaaacgtacgaaccggtacttggtaacttagtttaccgttgttacgacgtaaggtattcgacgtaggtgggtaagtaacgtttccttaacttaacctacttactaactaactacgttacggtacgtcgtaacggggg

SEQ ID NO: 62446 - DNA, 520 bp, Homo sapiens
  misc_feature: GYAE6OF02F7WGN.18.70.G04.1.454.CMB.1.raw
  modified_base (426)..(426): a, c, t, g, unknown or other
  misc_feature (426)..(426): n is a, c, g, or t
  modified_base (433)..(433): a, c, t, g, unknown or other
  misc_feature (433)..(433): n is a, c, g, or t
  modified_base (439)..(439): a, c, t, g, unknown or other
  misc_feature (439)..(439): n is a, c, g, or t
  modified_base (455)..(455): a, c, t, g, unknown or other
  misc_feature (455)..(455): n is a, c, g, or t
  modified_base (460)..(460): a, c, t, g, unknown or other
  misc_feature (460)..(460): n is a, c, g, or t
  modified_base (464)..(464): a, c, t, g, unknown or other
  misc_feature (464)..(464): n is a, c, g, or t
tcagtacgagtatgcacgaccggtgctcgatttagtgtagtgtgaagggaaaggggacccaacaaccacatccctcctgagaagcccccagagcacaactccttaccatggactggacctggaggatcctctttttggtggcagcagccacaggtgcccactcccaggtccagcttgtgcagtctggggctgaggtgaagaagcctggggcctcagtgaaggtttcctgcaagacttctggatactccttcactagttttctatccattggctgcgccaggcccccggacaaaggcttgagtgggtgggatggatcaacgctgtcaatggtctcaacaaaatattacacagaagttgcagggcagagtcacattacagggacacactccgcgagaacagcctacatggagctgagcagcctgatanctagaancacggntagtatattactgtgngtagnttgnaggtggagacgttccttaactacttactactactactatacggtactcgtacgggg

SEQ ID NO: 62447 - DNA, 604 bp, Homo sapiens
  misc_feature: GYAE6OF02JGCVW.18.70.G04.1.454.CMB.1.raw
  modified_base (353)..(353): a, c, t, g, unknown or other
  misc_feature (353)..(353): n is a, c, g, or t
  modified_base (503)..(503): a, c, t, g, unknown or other
  misc_feature (503)..(503): n is a, c, g, or t
tcagtacgagtatgcacgaccggtgctcgatttagtgtagtgtgaagggaaaggggacccaacaaccacatccctcctgagaagcccccagagcacaactccttaccatggactggacctggaggatcctctttttggtggcagcagccacaggtgcccactcccaggtccagcttgtgcagtctggggctgaggtgaagagcctggggcctcagtgaaggtttcctgcaagacttctggatactccttcacttagtttttctactcctattggcttgccgtccacggcccccggacaaggccttggagtgggtgggatggactcaacgctgtcaagtggtctacaacaaatnttacacagtaagttgacagggcagacgtcactattacgagggacacagtccgcgaagaacacgacctaacatgggataccgtagaacgtcgacgtcctagacttataccgtaggaaacgacgacgggaccttaggtacttagtttaccgngttggtaccggaggtacttggactagggtgggtaacgtacgttccttaacgttaacgtaaccttaacttacctagtacggtaggtaccgttggtaacgggg

SEQ ID NO: 62448 - DNA, 637 bp, Homo sapiens
  misc_feature: GYAE6OF02H80LA.18.70.G04.1.454.CMB.1.raw
  modified_base (288)..(288): a, c, t, g, unknown or other
  misc_feature (288)..(288): n is a, c, g, or t
  modified_base (318)..(318): a, c, t, g, unknown or other
  misc_feature (318)..(318): n is a, c, g, or t
  modified_base (417)..(417): a, c, t, g, unknown or other
  misc_feature (417)..(417): n is a, c, g, or t
tcagtacgagtatgcacgaccggtgctcgatttagtgtagtgtgaagggaaaggggacccaacaaccacatccctcctgagaagcccccagagcacaactccttaccatggactggacctggaggatcctctttttggtggcagcagccacaggtgcccactcccaggtccagcttgtgcagtctggggctgaggtgaagagcctggggcctcagtgaaggtttcctgcaagacttctggatactccttcacttagttttcatcctattggctgcgcacggccccganaaggcttgagtgggtggatggatcgaacgntgtcaatcggtcacaacaaaatattacactaagtaagttgacgagggcagagtcaacattaacgtaggaacatactccgacgagaaacagacccgtaanagtagggacgtactaggaaggtacgccttagaagtactcgttaagaaagaccgacggtcttaagttaataacgtttacgtagttcgggaaccggtaggttaaccgttaggtacgaaggttagggtattaaccggttaccgtttaaccttaaaccgtttaacctaaccttaacgttaacctaaggttaccgggtaaccggttcggtaggggtaaaacccgg

SEQ ID NO: 62449 - DNA, 602 bp, Homo sapiens
  misc_feature: GYAE6OF02G8XTC.18.70.G04.1.454.CMB.1.raw
  modified_base (238)..(238): a, c, t, g, unknown or other
  misc_feature (238)..(238): n is a, c, g, or t
  modified_base (250)..(250): a, c, t, g, unknown or other
  misc_feature (250)..(250): n is a, c, g, or t
  modified_base (288)..(288): a, c, t, g, unknown or other
  misc_feature (288)..(288): n is a, c, g, or t
tcagtacgagtatgcacgaccggtgctcgatttagtgtagtgtgaagggaaaggggacccgaacaaccacatccctcctgagaagcccccagagcacaactccttaccatggactggacctggagatcctcttttggtggcagcagccacaggtgccactcccaggtccagcttgtgcagtctggggactgaggtgaagagcctggggcctcagtgtaaggtttcctgcaagacttcnggatactccttnacttagttttcatccattggctgcgccaggccccgganaaggcttgagtgggtggatggatcgaacgctgtaccaagtggtactcaataaaatcttacgaactagaacgttgacgagggcaggtagtaccaaccgtatttaacgacgggaactacgacgtccggacgaacgttaaacgaggtccctaaccgagttagggacgacgttggacgacacgtacccgtagtactataccgtagaaacgacacggtactgttaatactttaacgtgtgacgagtattcgcgagtggaacgtacgttaccgtaacttaacttacgtacttactactaggtacggacgttagaccgggg

SEQ ID NO: 62450 - DNA, 752 bp, Homo sapiens
  misc_feature: GYAE6OF02H644U.18.70.G04.1.454.CMB.1.raw
  modified_base (231)..(231): a, c, t, g, unknown or other
  misc_feature (231)..(231): n is a, c, g, or t
tcagtacgagtatgcacgaccggtgctcgatttagtgtagtgtgaagggaaaggggacccaacaaccacatccctcctgagaagcccccagagcacaactccttaccatggactggacctggaggatccttctttttggtggcagcagccacaggtgcccactcccaggtccagcttgtgcagtctggggctgaggtgaagagccgtggggcctcgagtgaaggttttccngcaagtaccttcgtggacttacctccttctacttagtttttctattcctattggtctgccgtcccgaccgggcccccggaacaaacggtcttggaggttacggggtgggacgtggactacgaacgcgttagtacaagttcggtactacaactaaaatacttaccaacgtaaggtaacgttacggaacgtagggactaggtaacgtaccaaccgtagttaacgtagggaacctaacgtacgtacccggacgaacgaaccgacgtaccccttaaggacgtagggaagtcgtaggacgtacgaacgtccgtagtaacttacgtacgtaggaaacgtaccgacgggttaccttagtaactttaacgttacgttagggttacggtacgggtaacggttacgtttacggacgttacgggttaagggacggtttaaccgtttacccgttaaaccttaacccgttaacccgtttaaccttaaccggttaaccgttacggttacgggtaccggttacgggtaaccggggg

SEQ ID NO: 62451 - DNA, 598 bp, Homo sapiens
  misc_feature: GYAE6OF02H6FIQ.18.70.G04.1.454.CMB.1.raw
  modified_base (238)..(238): a, c, t, g, unknown or other
  misc_feature (238)..(238): n is a, c, g, or t
  modified_base (291)..(291): a, c, t, g, unknown or other
  misc_feature (291)..(291): n is a, c, g, or t
  modified_base (393)..(393): a, c, t, g, unknown or other
  misc_feature (393)..(393): n is a, c, g, or t
  modified_base (400)..(400): a, c, t, g, unknown or other
  misc_feature (400)..(400): n is a, c, g, or t
  modified_base (408)..(408): a, c, t, g, unknown or other
  misc_feature (408)..(408): n is a, c, g, or t
  modified_base (436)..(436): a, c, t, g, unknown or other
  misc_feature (436)..(436): n is a, c, g, or t
tcagtacgagtatgcacgaccggtgctcgatttagtgtagtgtgaagggaaaggggacccaacaaccacatccctcctgagaagcccccagagcacaactccttaccatggactggacctggaggatcctctttttggtggcagcagccacaggtgcccactcccaggtccagcttgtgcagtctggggctgaggtgaagaagcctggggcctcagtgaaggtttcctgcaagacttntggatactccttcactagtttttctatccattggctgcgccaggcccccgganaaggcttgagtgggtgggatggatcaacgctgtcaatggtctacacaaatattcacagattgcagggcagagtcaacattaacgaggacactatcccgaganaaaccgngaccctanaagtacggagctagagcagcctagactntactaggaacgacgaccggattcggtaattacttacgttgtacggcgtaagggtactttgaccgaggttacgggacggtaacgttacccgttaactttaacccttaacgttacccttaacgtaaccttacggttaacgggtaccgttacggtaaccgggggg

SEQ ID NO: 62452 - DNA, 607 bp, Homo sapiens
  misc_feature: GYAE6OF02H9A50.18.70.G04.1.454.CMB.1.raw
  modified_base (303)..(303): a, c, t, g, unknown or other
  misc_feature (303)..(303): n is a, c, g, or t
  modified_base (338)..(338): a, c, t, g, unknown or other
  misc_feature (338)..(338): n is a, c, g, or t
  modified_base (363)..(363): a, c, t, g, unknown or other
  misc_feature (363)..(363): n is a, c, g, or t
  modified_base (369)..(369): a, c, t, g, unknown or other
  misc_feature (369)..(369): n is a, c, g, or t
  modified_base (495)..(495): a, c, t, g, unknown or other
  misc_feature (495)..(495): n is a, c, g, or t
tcagtacgagtatgcacgaccggtgctcgattttagtgtagtgtgaagggaaaggggacccaacaaccacatccctcctgagaagcccccagagcacaacctccttaccatggactggacctggaggatcctctttttggtggcagcagccacaggtgcccacctcccaggtccagcttgtgcagtctggggctggaggtgaagaagcctggggcctcagtgaaggtttcctgcaagacttctggatactccttacacttagtttttctattcctattggctgccgccgacggcccccggaanaaaggcttaggaggtgggtaggatggatcgaacgntgtcaagtcggtctacaataaaatntacaanagtaagtgacgagggcagacgtacaactagttaacgagggactacgagtcccgagaacgaaacgacgtacctaacagtggatcgtagagacgacgtctagaatactactaggaaacgccgtacggnttagtaattaattcgtagtcgaggagtattcgacgtaggtacggaatacgtttacctaacgttacttaacttacttaactaacgtagttacgggtaccgttggtaaccgggg

SEQ ID NO: 62453 - DNA, 743 bp, Homo sapiens
  misc_feature: GYAE6OF02G9LBD.18.70.G04.1.454.CMB.1.raw
  modified_base (216)..(216): a, c, t, g, unknown or other
  misc_feature (216)..(216): n is a, c, g, or t
  modified_base (229)..(229): a, c, t, g, unknown or other
  misc_feature (229)..(229): n is a, c, g, or t
  modified_base (303)..(303): a, c, t, g, unknown or other
  misc_feature (303)..(303): n is a, c, g, or t
tcagtacgagtatgcacgaccggtgctcgatttagtgtagtgtgaagggaaaggggacccaacaaccacatccctcctgagaagcccccagagcacaactccttaccatggactggacctggaggatcctctttttggtggcagcagccacaggtgcccactcccaggtccagcttgtgcagtcgtggggctgaggtgaagaagccgtggggcctnagtgaaggtttcngcagacttctaggtataccttccttctacttagtttttctatccattcggctgccgccgacggccccccggaanaaacggcgttaggacggtggggtcggggtagtgggactacgaacggtcttcgtacaagttcggtctaccaaactaaaattacttaccgaacgaaggtaaacgttcggacgacgggtacaaggcgtaaccacgttaataacgtagggaacacgtacgttaccgacgaacgaaaccgacggtaccctaagtggtacggacgtacgtacggacgccgtaaggtacccttacgtaagttaccgtacgttaacggaaacgaccggtaaccggtgtttacggttaactttaagtttaccggttaggtacggtacggtaaggttaccgttagggaccgtagggtcgggtaaacggttaccgtttacctttaaccgtaactttaacccgtttaaccgttaaccgttaacgttaccgggtaacgggttaccggttacgggtaacggggg

SEQ ID NO: 62454 - DNA, 660 bp, Homo sapiens
  misc_feature: GYAE6OF02IWGLA.18.70.G04.1.454.CMB.1.raw
  modified_base (231)..(231): a, c, t, g, unknown or other
  misc_feature (231)..(231): n is a, c, g, or t
  modified_base (338)..(338): a, c, t, g, unknown or other
  misc_feature (338)..(338): n is a, c, g, or t
  modified_base (484)..(484): a, c, t, g, unknown or other
  misc_feature (484)..(484): n is a, c, g, or t
  modified_base (585)..(585): a, c, t, g, unknown or other
  misc_feature (585)..(585): n is a, c, g, or t
tcagtacgagtatgcacgaccggtgctcgatttagtgtagtgtgaagggaaaggggacccaacaaccacatccctcctgagaagcccccagagcacaactccttaccatggactggacctggaggatccttctttttggtggcagcagccacaggtgcccactcccaggtccagcttgtgcagtcgtggggctgaggtgaagagcctggggcctcgagtgtaaggtttccngcaagacttgtggatactccttcacttagttttcatcctagttggctgcgtccacggccccggaagaaaggcttcggaggtgggtgggagttggattccgaacggtntcggtacaagttcgggtactaccaaacgtaaagtttacttacgaaacgtaaggtaacggtttagccgtaagggaccgaggaacgttaccacgttaagttaacggtaggaacactacgtcgacgtaacgaacacgtacctaaggacngggtaactcgtacgagcgaacgtccgtgtaaactgaccgtaagtaccgaagtaccggtacgttagtatttacgttactacggggacttaggtaaaccggtnttcgacgtaaggtcggtaacttacgtccgttaacctcgtaataacgtctaacggtactggaccgtgtaacccggg

SEQ ID NO: 62455 - DNA, 646 bp, Homo sapiens
  misc_feature: GYAE6OF02IESQE.18.70.G04.1.454.CMB.1.raw
  modified_base (229)..(229): a, c, t, g, unknown or other
  misc_feature (229)..(229): n is a, c, g, or t
  modified_base (329)..(329): a, c, t, g, unknown or other
  misc_feature (329)..(329): n is a, c, g, or t
  modified_base (438)..(438): a, c, t, g, unknown or other
  misc_feature (438)..(438): n is a, c, g, or t
tcagtacgagtatgcacgaccggtgctcgatttagtgtagtgtgaagggaaaggggacccaacaaccacatccctcctgagaagcccccagagcacaactccttaccatggactggacctggaggatcctctttttggtggcagcagccacaggtgcccactcccaggtccagcttgtgcagtctggggctgaggtgaagaagcctggggcctcgagtgaaggtttccngcaagacttcgtggatactccttcacttagttttctatcctattggctgcgccgacggcccccggacaaaggcttgaggtgggtggagtggatcgaacgntgtctaagtggtctacgaactaaaatattacaatagtaagttcgacgtagggcagtagtcaaccgtattaacgtagggacaccagttcccgagaacgaacacgcctaanagtaggacgtctaggagccaagtcctagtactatcgtagaacgtacgacggtcttaagtatttaagttacgtaggttcggaccgtaagggtattggaccgtaagggtagggtaacgttaaccggtttaccctttaacgttaaccgtttaaaccgtttaaccgtaaccgtttaaccgagtttacgggtacccgttgggtaacccggggg

SEQ ID NO: 62456 - DNA, 683 bp, Homo sapiens
  misc_feature: GYAE6OF02HHMPL.18.70.G04.1.454.CMB.1.raw
tcagtacgagtatgcacgaccggtgctcgatttagtgtagtgtgaagggaaaggggacccaacaaccacatccctcctgagaagcccccagagcacaactccttaccatggactggacctggaggatcctctttttggtggcagcagccacaggtgccactccaggtccagcttgtgcagtctggggctgaggtgaagaagccgtggggcctcaggtgaaggtttcctgcaagacttcgtggatactccttctacttagttttctatcctattggctgcgccgacggacccccggaacgaaacggcttcggtaggtggggtcgggtagtggtagtacgaacgcgtagtacaacgttggtctacaaactaaaatacttacaacgtaagtaacgtttgacggtagggacgtaagtaacgtacgaaccttacgtttaaacgtaacggggaacctaccgtacgtacccggaacgaaacggaactacggtacccgttaacaacggttacggggtaacgtacggtaggaacggacgtaaccggacccgttaggtaacttacgtacgtaaggaaacggacgaacggtcgttaagtaacgtattacgtgtacggtacgagtagtgacgtagtagggattaccgttctaacgtacgttactacgtacctgtagtcggtagtcggtaacgggg

SEQ ID NO: 62457 - DNA, 609 bp, Homo sapiens
  misc_feature: GYAE6OF02IAZPT.18.70.G04.1.454.CMB.1.raw
  modified_base (251)..(251): a, c, t, g, unknown or other
  misc_feature (251)..(251): n is a, c, g, or t
  modified_base (364)..(364): a, c, t, g, unknown or other
  misc_feature (364)..(364): n is a, c, g, or t
  modified_base (377)..(377): a, c, t, g, unknown or other
  misc_feature (377)..(377): n is a, c, g, or t
tcagtacgagtatgcacgaccggtgctcgatttagtgtagtgtgaagggaaaggggacccaacaaccacatccctcctgagaagcccccagagcacaactccttaccatggactggacctggaggatcctctttttggtggcagcagccacaggtgcccactcccaggtccagcttgtgcagtctggggctgaggtgaagaagcctggggcctcagtgaaggtttcctgcaagacttctggatactccttnacttagttttctatccattggctgcgccacggcccccggacgaaaggcgttagacgtgggtgggacgtgggattcgaaacgcgtgtcaagtcggtctcaactaaaatattcanagtaagtgcaggnagagtcactatactaggacacacgtccgacgagaacacgacctaacagtagagctagagcacggcctagatacttactagtaaacggacaaccggtacgttacgtaagttacttaacgttgtcggacggagttacgttagaccgtagggtgggaaggttaccggttactttaacccgttaactacccttaactaccttaacgtaacgtggtacccggttacggtaacggggg

SEQ ID NO: 62458 - DNA, 721 bp, Homo sapiens
  misc_feature: GYAE6OF02F9HRC.18.70.G04.1.454.CMB.1.raw
  modified_base (405)..(405): a, c, t, g, unknown or other
  misc_feature (405)..(405): n is a, c, g, or t
  modified_base (411)..(411): a, c, t, g, unknown or other
  misc_feature (411)..(411): n is a, c, g, or t
tcagtacgagtatgcacgaccggtgctcgatttagtgtagtgtgaagggaaaggggacccaacaaccacatccctcctgagaagcccccagagcacaactccttaccatggactggacctggaggatcctctttttggtggcagcagccacaggtgcccactcccaggtccagtcttgtgcagtcgtgggctgaggtgaagagccgtgggcctcagtgtaaggtttcctgacaagtaccttcgtaggtactacctccttcgtactttacgtttttctacttcctagttggctcgccgtccgaccggcccccgaagaacggtcttggaggtcggggtagggagtaggatacgacgtctcgtacagtcggtctacaactaaattactcaacagtacgttgacgaggnagtacnccaactatacgtaggaacacgtacgtacgacgaacgaacgacgtacctaacgagtacggacgtacgtacggacgtacgacggtacctaggttaactaccgtacgtacgaaacggtaccggtaacgttacgttagtttaaacgttacgtttacggttacgtacggtaccggttaacgggtagtttccgggtaacggttagggtagggtaccgtaaccggtttacccgtttaacccgtttaacgttaacccgtttaaccgtaaccgttaaccgttaacggttccgggttaccggttccgggtaaaccggggg

SEQ ID NO: 62459 - DNA, 530 bp, Homo sapiens
  misc_feature: GYAE6OF02HDEMO.18.70.G04.1.454.CMB.1.raw
tcagtacgagtatgcacgaccggtgctcgatttagtgtagtgtgaagggaaaggggacccaacaaccacatccctcctgagaagcccccagagcacaactccttaccatggactggacctggaggatcctctttttggtggcagcagccacaggtgcccactcccaggtccagcttgtgcagtctggggctgaggtgaagaagcctggggcctcagtgaaggtttcctgcaagacttctggatactccttcacttagtttttctatccattggctgcgccacggcccccggacaaaggcttgagtgggtgggatggatcaacgctgtcaatggtctcacaaaatattcacagtaagttgcagggtcagagtcacattactagggacacactccgacgagaacagacctacatggagctgagcagcctggatatctagaacgtacacggtctagtaatattacgtgtagcgagattgcgtagtggtagagttccttactactactactactacagtcgtacgtgtacgggg

SEQ ID NO: 62460 - DNA, 638 bp, Homo sapiens
  misc_feature: GYAE6OF02I8IFU.18.70.G04.1.454.CMB.1.raw
  modified_base (297)..(297): a, c, t, g, unknown or other
  misc_feature (297)..(297): n is a, c, g, or t
tcagtacgagtatgcacgaccggtgctcgatttagtgtagtgtgaagggaaaggggacccaacaaccacatccctcctgagaagcccccagagcacaactccttaccatggactggacctggaggatcctctttttggtggcagcagccacaggtgcccactcccaggtccagcttgtgcagtctggggctgaggtgaagaagccgtggggcctcgagtgtaaggtttcctgcaagacttcgtggatactccttcacttagttttctatcctattggctgcgccacggcccccgaanaagtcttgaggtgggtggatggatacgaacgtctgtacaagtcggtctacaactaaattatacacaagtaagttgacgtaggacagacgtacacctaagttaacgtagggactacgacgtccgagagaacacgacctaagaggtacggggctaggacgacgacggtacctaggattacgtacgaagaaacgccgacggtacgtagttattattacgttgtacgacggtaggtacttggacgtaggtacggtaagtaccggtttaccttaacgttaaccttaaccgttaaccttaaccgtacgtaacgttacggaccggtttacgggtacgggtaaaccggg

SEQ ID NO: 62461 - DNA, 821 bp, Homo sapiens
  misc_feature: GYAE6OF02HOJQ3.18.70.G04.1.454.CMB.1.raw
  modified_base (229)..(229): a, c, t, g, unknown or other
  misc_feature (229)..(229): n is a, c, g, or t
tcagtacgagtatgcacgaccggtgctcgatttagtgtagtgtgaagggaaaggggacccaacaaccacatccctcctgagaagcccccagagcacaactccttaccatggactggacctggaggatcctcttttggtggcagcagccacaggtgcccactcccaggtccagcttgtgcagtcgtggggctgaggtgaagagccgtcggggcccagtgaacggtttccngacaagtcttctaggtactaccttccttactactttacgtttttacacttacctagtttcggcgttggccgtacccgaccggggaccccccggaacggtaaaacgggtcccgttaggtaacggggttcggggggtaggggacgttacggggactttaccggaaaccggtccgttaggttaccgtaagttcgggtaccttaccgaaactaaaagttactttaccgaacgtaaggtaaacgttcggacggtaacgggacgtaacggtacgtaccgtaaacctaaaggtttaccgtaacggggtaaaccaccgtacggttacccgggaaccgtaaagtaaccaccggtacccgtaacgtacggtacgggtacgccgtaaggacgacctacgtacgtagttacttacgtaagtacgtaacgaccggacgttcgttaagtactttaaaccgttacgttagggttacgtaacggttaaggacgttacggtcgtagggtcggtaacgttaaccgttaccgtttacttaaccgttaaccgtttaacgtaacctaacggtccggttaacggggtaccggttagggtaaccgggtaaccggg

SEQ ID NO: 62462 - DNA, 918 bp, Homo sapiens
  misc_feature: GYAE6OF02GXP2W.18.70.G04.1.454.CMB.1.raw
  modified_base (293)..(293): a, c, t, g, unknown or other
  misc_feature (293)..(293): n is a, c, g, or t
tcagtacgagtatgcacgaccggtgctcgatttagtgtagtgtgaagggaaaggggacccaacaaccacatccctcctgagaacgcccccagagcacaactccttaccatggactggacctggaggatcctctttttggtggcagcagccacaggtgcccactcccaggtccagcttgtgcagtctgggctgaggtgaagagccgtgggcctcagtgtaaggtttcctgcaagacttctggactactccttcacttagtttttcactccattggctgcgccacggcccccganaaggtctgagtgggtggagtggactcgaacgcgttagtactaagttcggtactaccgaaactaaaacgttctttaccgaactaaggtaaacgtttgaccgtaggggacaacgggtacgtacctaacccgtaagtttaacccgtaacggggtaacctaacccgtaacgttaccccgggtaaaccggaaacggtaaaacccgaaccggttaacccccgttaaacgtaaacgggtttacgggaaccggttaccgttaacgggaaacggtcccggtaaaccggttaccccggtttaaagggttaaacctttaacccggttaaccggttaaacgggtaaaacccgggtaaaccccgtacccggggggtttaactttaaccgggttttaaacttttaaaccggtttttaaccgtttaccggggtttaaggtaacccgggttaaaaggggtttcgtttaaccggtaccgggttaaacggggtttacggggtaaaaccggtttaacccgttttaaaccccgttttaaacccggtttaacctttaaaaccccggttttaaaccttttaaccctaaaccggtttaaccgggtttaccggggtttaaccgggttacccggggtaaacccggggggg

SEQ ID NO: 62463 - DNA, 765 bp, Homo sapiens
  misc_feature: GYAE6OF02FO38C.18.70.G04.1.454.CMB.1.raw
  modified_base (281)..(281): a, c, t, g, unknown or other
  misc_feature (281)..(281): n is a, c, g, or t
  modified_base (296)..(296): a, c, t, g, unknown or other
  misc_feature (296)..(296): n is a, c, g, or t
tcagtacgagtatgcacgaccggtgctcgatttagtgtagtgtgaagggaaaggggacccaacaaccacatccctcctgagaagcccccagagcacaactccttaccatggactggacctggaggatcctcttttggtggcagcagccacaggtgcccactcccaggtccagcttgtgcagtctggggctgaggtgaagaagccgtggggcctcgagtgtaaggtttcctgcaagacttctggactactccttcacttagttttctatcctattggctgcnccgacggcccccganaaggctgaggtgggtgggatggatcgaacgcgtgtacaagtcggtctacaacgtaaattacttacaacgtaggtaaggttgaccgtagggactaagtacgtcctaaccgtacgtttaacggtaacgggaacctaacgtaaccgtacccggaacggtaacggaaaccgtacggtacccctaacgtaacggttagggaaccgtcgtaagggacgcgtaacggtcccgtagtaacgttactcgtaaggaaaccggaccgtaacgggtacctttacggttaacgtttaaacgtttaccgttcgggtacggtaaccgggttaaggttacgtttacggaccggtagggttaacgggtaacggttaccggtttaacccgtttaacccgtttaaccgttaaacccggtttaaccgtttaacccgtaaccggttacggttacccggggttaaccgggtttacggtaaacccggggggg

SEQ ID NO: 62464 - DNA, 685 bp, Homo sapiens
  misc_feature: GYAE6OF02ID19C.18.70.G04.1.454.CMB.1.raw
  modified_base (251)..(251): a, c, t, g, unknown or other
  misc_feature (251)..(251): n is a, c, g, or t
  modified_base (351)..(351): a, c, t, g, unknown or other
  misc_feature (351)..(351): n is a, c, g, or t
  modified_base (422)..(422): a, c, t, g, unknown or other
  misc_feature (422)..(422): n is a, c, g, or t
tcagtacgagtatgcacgaccggtgctcgatttagtgtagtgtgaagggaaaggggacccaacaaccacatccctcctgagaagcccccagagcacaactccttaccatggactggacctggaggatcctctttttggtggcagcagccacaggtgcccactcccaggtccagcttgtgcagtctggggctgaggtgaagaagcctggggcctcagtgaaggtttcctgcaagacttctggatactccttnacttagtttttctatcctattggctgcgccgacggcccccggacaaacggcttgaggtagggtggatggatcgaacgctgtcaatggtctacaacaaatnttacacagaagttggctaggcagacgtcacctattaacgaggacacatccgacgaagaacacgaccctaanacgtaggacgctaggagtacagaccgtgaatacgtacgtgaaacgcgtaacgggtccttagttaacgttaagtttaccgtgggttacggtaccggtaagggtacttttaggaccgtaagggtttacgggaacgggtttaaccgtttaccccgttttaacccgtttaaacccgttttaacccggtttaaacctttaacccgttttaaacgtaaccgggtttacggggtttaacccccggttcgggtttaaaaccccgggggggg

SEQ ID NO: 62465 - DNA, 726 bp, Homo sapiens
  misc_feature: GYAE6OF02JTDSL.18.70.G04.1.454.CMB.1.raw
  modified_base (186)..(186): a, c, t, g, unknown or other
  misc_feature (186)..(186): n is a, c, g, or t
  modified_base (226)..(226): a, c, t, g, unknown or other
  misc_feature (226)..(226): n is a, c, g, or t
  modified_base (286)..(286): a, c, t, g, unknown or other
  misc_feature (286)..(286): n is a, c, g, or t
  modified_base (496)..(496): a, c, t, g, unknown or other
  misc_feature (496)..(496): n is a, c, g, or t
tcagtacgagtatgcacgaccggtgctcgatttagtgtagtgtgaagggaaaggggacccaacaaccacatccctcctgagaagcccccagagcacaactccttaccatggactggacctggaggatccttcttttggtggcagcagccacaggtgcccactcccaggtccagcttgtgcagtcgnggggctgaggtgaagagcctgggcctcgagtgaggttccngcaagcttcgtgatactctcacttagttttcatctattgctgcgcaccggacccccgganaacggtcttcgaggtgggtggatggatacgaacggtctgtacagttggtaccttacgaactaaaattacgttacacgtaagtaagttcggactaaggggcctaaggtaccggtaccaaccgttaacgttaaccgtaacggggtaacctaacgtacttacccgggtaccgaacggaaaccgtacgtaccccgtaagtacgtaccggggaanccggttaggacggacccgtaggtacccgttaggtaacttactaccggttaacggaacggtaaaccggtaccgggtactttaacggtttaattaacgtttaccgttacgggttaggtaccgggtaagttaacgggtacggtaccgtaaggttacgggaaggtttaccgttacccgttaactaccgttaaacgtcttaacgaccgttaggtaccggtacggtaccgtacggg

SEQ ID NO: 62466 - DNA, 619 bp, Homo sapiens
  misc_feature: GYAE6OF02GSQUW.18.70.G04.1.454.CMB.1.raw
  modified_base (229)..(229): a, c, t, g, unknown or other
  misc_feature (229)..(229): n is a, c, g, or t
  modified_base (295)..(295): a, c, t, g, unknown or other
  misc_feature (295)..(295): n is a, c, g, or t
tcagtacgagtatgcacgaccggtgctcgatttagtgtagtgtgaagggaaaggggacccaacaaccacatccctcctgagaagcccccagagcacaactccttaccatggactggacctggaggatcctcttttggtggcagcagccacaggtgcccactcccaggtccagcttgtgcagtctggggctgaggtgaagaagccgtggggcctcgagtgaaggtttccngcaagacttctggatacctccttcacttagtttttctatccattggctgcgccacggcccccgganaaacggcttgagtgggtgggatggatcgacgtctgtcgaagtcggtctacgaactaaatacttacaacagtaagttgacgaggcagtacgtacactagtaccgtaagggacacgtactccgacgagaaacagacctacgagtaggagtctagacgcgacgtcgtagactatccgtaaggacgaacgtcggtacttcggtaattacgttacgttggtacgacggtaacggtattacggacgtagttacggggaacgttacggttacccttaactaacgtaaccttaacgtactaaccgtagtacggtacgttaccggtaacgggg

SEQ ID NO: 62467 - DNA, 527 bp, Homo sapiens
  misc_feature: GYAE6OF02GSHY8.18.70.G04.1.454.CMB.1.raw
  modified_base (428)..(428): a, c, t, g, unknown or other
  misc_feature (428)..(428): n is a, c, g, or t
tcagtacgagtatgcacgaccggtgctcgatttagtgtagtgtgaagggaaaggggacccaacaaccacatccctcctgagaagcccccagagcacaactccttaccatggactggacctggaggatcctctttttggtggcagcagccacaggtgcccactcccaggtccagcttgtgcagtctggggctgaggtgaagaagcctggggcctcagtgaaggtttcctgcaagacttctggatactccttcactagttttcatccattggctgcgccaggcccccggacaaaggccttgagtgggtgggatggatcaacgctgtcaatggtctcacaaaatattcacagaagttgcagggcagagtcaccattactagggacacatcccgacgagaacagcctacagtggaagctgagcagcctgatntctgaagacacggcttgtatattactgttgcgtaggattgcaggtggaagtacgttccttaactacttactactactacagttggacgtcgtacggggg

SEQ ID NO: 62468 - DNA, 694 bp, Homo sapiens
  misc_feature: GYAE6OF02JS1R6.18.70.G04.1.454.CMB.1.raw
  modified_base (217)..(217): a, c, t, g, unknown or other
  misc_feature (217)..(217): n is a, c, g, or t
tcagtacgagtatgcacgaccggtgctcgatttagtgtagtgtgaagggaaaggggacccaacaaccacatccctcctgagaagcccccagagcacaactccttaccatggactggacctggaggatccttctttttggtggcagcagccacaggtcgcccactcccgaggtccagcgttgtgcagtcgtgggctgaggtgaagagccgtgggcctnagtgtaaggttcctgacaagtcttcgaggtacttactccttctactttagttttctactccgtagttggtctgccgaccgaccggtacccccggaacgaaacggttcgtaggtacggtggggtcggtagtggacgtacgacgtcgtcgtacgtagtcgtaccttacaagtaaattctacacgtagtacgtgacgaggcgacgtacgtacaccgtagtaacgtacggaaaccactaacgtccgtaaggacgaaacgccgaaacgtctagtacgggaactcgtagaccgctacgcgttagaacgtactcgtaacgtaacgacccgtaggtacgttagttaaacgtacgtttacggtagtccgaaggttaacggtcgtttagcggttagggtacggtaaggtttacccggttaacctttaacgttaccgttaactaaccggttacgtacgtaacgttcgggtaccgtacgggttaacggg

SEQ ID NO: 62469 - DNA, 718 bp, Homo sapiens
  misc_feature: GYAE6OF02GBC6O.18.70.G04.1.454.CMB.1.raw
  modified_base (364)..(364): a, c, t, g, unknown or other
  misc_feature (364)..(364): n is a, c, g, or t
tcagtacgagtatgcacgaccggtgctcgatttagtgtagtgtgaagggaaaggggacccaacaaccacatccctcctgagaagcccccagagcacaactccttaccatggactggacctggaggatcctctttttggtggcagcagccacaggtgcccactcccaggtccagcttgtgcagtctggggctgaggtgaagagccgtggggcctcagtgaaggtttcctgcaagacttctggatactccttcacttagttttctatcctattggctgcgtccgacggcccccggacaaaggcttggacggtgggtgggagtggatcgaacgctgtcatggtctacacaaatatacacagaagttnacgagggacagatcactacttacgtaaggaacacacgtccgacgtaacgaaccaacggccctaacgaagttacgggaacgaccgtacgggaacgtaccgacgggtacccgtaggtaactttacgtacggttaacggaaacggtaaccggtaaccgggtaccgtttaggtaaacgttttaacgtttaacggttagggtttaccggaccgggtaacggggttaagtttccggtaagggttacgggtaggggtaacggttaaccggttttaccccgttaacgtttacccgtaactttaacccgtttaaccttaaccgttaaccggttagggttacccggttacgggtaaccgggggg

SEQ ID NO: 62470 - DNA, 658 bp, Homo sapiens
  misc_feature: GYAE6OF02H30C1.18.70.G04.1.454.CMB.1.raw
  modified_base (140)..(140): a, c, t, g, unknown or other
  misc_feature (140)..(140): n is a, c, g, or t
  modified_base (148)..(148): a, c, t, g, unknown or other
  misc_feature (148)..(148): n is a, c, g, or t
  modified_base (181)..(181): a, c, t, g, unknown or other
  misc_feature (181)..(181): n is a, c, g, or t
  modified_base (218)..(218): a, c, t, g, unknown or other
  misc_feature (218)..(218): n is a, c, g, or t
  modified_base (231)..(231): a, c, t, g, unknown or other
  misc_feature (231)..(231): n is a, c, g, or t
  modified_base (241)..(241): a, c, t, g, unknown or other
  misc_feature (241)..(241): n is a, c, g, or t
  modified_base (253)..(253): a, c, t, g, unknown or other
  misc_feature (253)..(253): n is a, c, g, or t
  modified_base (454)..(454): a, c, t, g, unknown or other
  misc_feature (454)..(454): n is a, c, g, or t
  modified_base (491)..(491): a, c, t, g, unknown or other
  misc_feature (491)..(491): n is a, c, g, or t
  modified_base (499)..(499): a, c, t, g, unknown or other
  misc_feature (499)..(499): n is a, c, g, or t
tcagtacgagtatgcacgaccggtgctcgatttagtgtagtgtgaagggaaaggggacccgaacaaccacatccctcctgagaacgccccagagcacaacctccttaccatggactggacctggagatcctctttttggnggcacggnacgccacaggtcgccactccaggtccagcttgncagtctggggctgaggtgaacgagccgtggggcctanagtgaacgttccngcaagcttcnggatactcttanacttagttttcactcagtgctgcgccacggacccccgataaaggccttgaggtgggtggatcggatacgaacgcgtcgtacaagttcggtactacgaacctaaaattcttaaccaacgtaagtaaacgttggacgacgggacgaagacgtacgaacataacgtaggactacgacgtccgacgacgaacacggtaccctaanaacgtggaacgtcgaacggatcgaacgactaggtaanaccgttanaaggaaacgtacgaaccggttagagtaattaccgttagacgttcgaacggttaaaggtctaaggccgtaaggtagggtaaccgtaacggtttccctaaacggtttaaccaacgttaaccgttacgaacctttaggtaccggtacgtcggttaaccgggg

SEQ ID NO: 62471 - DNA, 626 bp, Homo sapiens
  misc_feature: GYAE6OF02GVGYS.18.70.G04.1.454.CMB.1.raw
  modified_base (350)..(350): a, c, t, g, unknown or other
  misc_feature (350)..(350): n is a, c, g, or t
tcagtacgagtatgcacgaccggtgctcgatttagtgtagtgtgaagggaaaggggacccaacaaccacatccctcctgagaagcccccagagcacaactccttaccatggactggacctggaggatcctctttttggtggcagcagccacaggtgcccactcccaggtccagcttgtgcagtctggggctgaggtgaagaagccgtggggcctcagtgaaggtttcctgcaagacttctggatactccttcacttagttttctatccattggctgcgccacggcccccggacaaaggcttgagtgggtgggagtggatcaacgctgtaccaagtggtctcaacaaaatnttcaacagaagttgcgagggcagacgtcaacatttacgacgggactacagtccgacgaagaaccacgaccctaacacgtaggacgactagacgcgacgcccttagacttattcgacggaagaccgaccggcttgtaacttagtttaccgtagtacggaccgtagggtacttggtacctagggtaggcggtaacgtttaccctttaaaccgttaaccttaaccttaaccttaacgttacccgaaggtttaccgggtacgttacccggtaacgggggg

SEQ ID NO: 62472 - DNA, 745 bp, Homo sapiens
  misc_feature: GYAE6OF02I683G.18.70.G04.1.454.CMB.1.raw
tcagtacgagtatgcacgaccggtgctcgatttagtgtagtgtgaagggaaaggggacccaacgaaccacatccctcctgagaagcccccagagcacaactccttaccatggactggacctggaggatcctcttttggtggcagcagccacaggtgcccactccaggtccagcttgtgcagtcgtgggctgagtgaagagccgtgggcctgagtgtaaggttcctgacaagtacttcgtaggtactacctcttacgtacttaggtttttacaactcctaagttggacttgaccgtacccgtaagcccccccccggtaagaaacggggacccttaggaacggttcgggttaaggggagttagggtacgttacgtaacggactacggtacaaacgtagggtactccgtagaaaacttaagttacctaaactaacggaaagttaacggtacgaaagggttccaaagggtaacgtcgtaaaccgtaacgttaacctttaaacggggaccgtaaaccgaaccggttaacccgtaccggtaacgaaacgtaaacggaaccgtaaccgtaacgtacggtaagaacgtagtaacgaacgacgtacgtacgacgtacgtacgtacgaacgtacgaacgacgtacgtacgtagtaacgttgtacgtacgtaagtaacgttagtacgtacgtacggtagtacgtaacgttaacgtaacgtaacgtaaccgtaacgtaacgtacgtacgtacgtacg

SEQ ID NO: 62473 - DNA, 831 bp, Homo sapiens
  misc_feature: GYAE6OF02IXQFX.18.70.G04.1.454.CMB.1.raw
  modified_base (157)..(157): a, c, t, g, unknown or other
  misc_feature (157)..(157): n is a, c, g, or t
  modified_base (181)..(181): a, c, t, g, unknown or other
  misc_feature (181)..(181): n is a, c, g, or t
tcagtacgagtatgcacgaccggtgctcgatttagtgtagtgtgaagggaaggggacccaacaaccacatcccctcctgagaacgcccccagagcacaactccttaccatggactggactggagactcctcgttttggtggcagcagccacaggtcncccactcccaggtccagtcgttgngcagtcctaggggctagaggtagaagaacgccgtggggcctacgagtcgtaaggtttcctacgacaaggtaccttgacggtataacctccgttactaacgtttacgtttttacaacttccgtagttcggtacttacgccgaccgtacggtacccttacggaacgtaaacggtcttacggaggttgggtagggagtggtacgtaccgaacggtctaggtaaccgtaagttcgggtacccttaaataaacgttaaaaacttcgttaccaaaccggtaagttaagtacggaccggaggtacaagacgtaaccaactaagtttaacggaacgggtaccaacgtaccgtaccgacgaaacgtaaccgtaacgacctaaacggtagacggtaacggtaccgtaacgaccggaacgtaccggtaccgtacgaaacgttaacgtcgtaaaggaaaccgtaaccgtaacccggttagtttacgttaaacgtttacgtaacggtttaacggtaacggtacccgttaaagggttaccgttaggtaaccgtaccgggttaaagggttaaccgtaaccggttaacccttaacgttaaacccggttaccttaaaccgttaaccgttaacccgtaacggttaccgggtaacggtttaacccgggg

SEQ ID NO: 62474 - DNA, 645 bp, Homo sapiens
  misc_feature: GYAE6OF02HFWR3.18.70.G04.1.454.CMB.1.raw
  modified_base (139)..(139): a, c, t, g, unknown or other
  misc_feature (139)..(139): n is a, c, g, or t
  modified_base (299)..(299): a, c, t, g, unknown or other
  misc_feature (299)..(299): n is a, c, g, or t
  modified_base (328)..(328): a, c, t, g, unknown or other
  misc_feature (328)..(328): n is a, c, g, or t
  modified_base (343)..(343): a, c, t, g, unknown or other
  misc_feature (343)..(343): n is a, c, g, or t
  modified_base (352)..(352): a, c, t, g, unknown or other
  misc_feature (352)..(352): n is a, c, g, or t
  modified_base (358)..(358): a, c, t, g, unknown or other
  misc_feature (358)..(358): n is a, c, g, or t
  modified_base (427)..(427): a, c, t, g, unknown or other
  misc_feature (427)..(427): n is a, c, g, or t
  modified_base (485)..(485): a, c, t, g, unknown or other
  misc_feature (485)..(485): n is a, c, g, or t
  modified_base (508)..(508): a, c, t, g, unknown or other
  misc_feature (508)..(508): n is a, c, g, or t
tcagtacgagtatgcacgaccggtgctcgatttagtgtagtgtgaagggaaaggggacccaacaaccacatccctcctgagaagcccccagagcacaactccttaccatggactggacctggaggatcctctttttggnggcagcagccacaggtgcccactcccaggtccagcttgtgcagtcgtggggctggaggtgaagaagcctggggcctcagtgtaaggtttcctgcaaagtcttctggattacctccttacacttagttttctatcctattggctgcgcacggccccggaanaaggcttgagtgggtggatggatcaacgntgtacaagtgtctanaactaaatnttacanagtaagttgacgagggcaaggactacactaagttaacgaggacaacatccgacgaagaacacgcctaanacgtaggactcgtagagccgagtcctaggattacacgtaggaacgaccgaaccgggtnttaaggtaattaacgtttaccgngggttaacggacgttaagggtacgtttaggacggttagggttaacgggtaaggtaacccgtttacctttaaccgttaacgtttaaccgtaccttaaccgttacctaagggtccggttacccgtagggtaaccggggg

SEQ ID NO: 62475 - DNA, 654 bp, Homo sapiens
  misc_feature: GYAE6OF02G3APC.18.70.G04.1.454.CMB.1.raw
  modified_base (305)..(305): a, c, t, g, unknown or other
  misc_feature (305)..(305): n is a, c, g, or t
tcagtacgagtatgcacgaccggtgctcgatttagtgtagtgtgaagggaaaggggacccaacaaccacatccctcctgagaagcccccagagcacaactccttaccatggactggacctggaggatcctctttttggtggcagcagccacaggtcgcccacctcccaggtccagcttgtgcagtcgtgggctgaggtgaagagcctggggcctcgagtgaaggtttctgcaagtacttctggatactccttacacttagtttttctagtcctagttggctggccgaccgacgggcccccggaanaaacggtcgttaggaggtcggggtagggtatgggataccgacgtcgtgtactaagttcggtactacaacaaaattctacaactagaagttgacgagggacagacgtacaaccgtattaacgagggaccaacgtcgtaccggacggaagaaaccgtacgaacctaagacggtacgggagtacgtaggacgaccgtacggccgtagtacgtactcgtaacgaagaccgacggtcttagtattacttacgtgttcgaggtaagtgttaggcgtaggtaggtaggtacctttacgttaactaaccttacgttaacctcttaaaccgtgtaacgggtaccggtggtaacggggg

SEQ ID NO: 62476 - DNA, 779 bp, Homo sapiens
  misc_feature: GYAE6OF02FIA5I.18.70.G04.1.454.CMB.1.raw
  modified_base (243)..(243): a, c, t, g, unknown or other
  misc_feature (243)..(243): n is a, c, g, or t
tcagtacgagtatgcacgaccggtgctcgatttagtgtagtgtgaagggaaggggacccaacaaccacatccctcctgagaacgcccccagacgcacaactccttaccatcggactggacctggaggactcctcttttggtggcagcagccacaggtcgcccactcccaggtccagcttgtgctagtcgtggggtctggacggtagaaggacgccgtcggggcctcgagtggaacggtttccncgaccagtcttcgtggactaccgttccttacacgtttacgtttttctactccgtagttcggccgttgaccggtccgaccgggaccccccggacgaaaacgggtccgttacggacggggttccgggttggggtactacgggtactacgaacgttctacgtctaacgtcggtactacaactaaactacttacactacgtaagttcgacggtagggactacggtacgtacaaccgtaacgtacgtacggggaacctaccgtacgtccgaacgtaacgggtaacaccggtaccaacgtaacgtcggacgtaccgtgggaacgacgccgtacgtacgaacgttactacgtacgtaacggacgtaccggacttacgttaaacgtactttaccggtaggtaaccggtacgggttacgtacgttcggaccgtcgggtacgggttaacccggtacggttaacccctttaaccggttaaccgttaacccttacccgttaacgtaaaccgttggttacccgggtacggttaccggtaaacccggggg

SEQ ID NO: 62477 - DNA, 667 bp, Homo sapiens
  misc_feature: GYAE6OF02FO8TS.18.70.G04.1.454.CMB.1.raw
  modified_base (157)..(157): a, c, t, g, unknown or other
  misc_feature (157)..(157): n is a, c, g, or t
  modified_base (233)..(233): a, c, t, g, unknown or other
  misc_feature (233)..(233): n is a, c, g, or t
  modified_base (338)..(338): a, c, t, g, unknown or other
  misc_feature (338)..(338): n is a, c, g, or t
  modified_base (357)..(357): a, c, t, g, unknown or other
  misc_feature (357)..(357): n is a, c, g, or t
  modified_base (363)..(363): a, c, t, g, unknown or other
  misc_feature (363)..(363): n is a, c, g, or t
  modified_base (436)..(436): a, c, t, g, unknown or other
  misc_feature (436)..(436): n is a, c, g, or t
tcagtacgagtatgcacgaccggtgctcgatttagtgtagtgtgaagggaaaggggacccaacaaccacatccctcctgagaagcccccagagcacaactccttaccatggactggacctggaggatccttctttttggtggcagcagccacaggtncccactcccaggtccagcttgtgcagtcgtggggctggaggtgaagaagccgtggggcctcagtgtaaggtttccngacagcttctggactactccttcacttagttttctatcctattggctgccgccgacggccccggacaaaggtcttggagtgggtgggatggatcgaacgctgtanaatggtctacaactaaatnttacanaaggaagtttgcgagggctagagtcaactaagttacgtaaggactacgacgtccgacgaacgaacagacctanacgtaggacgctagacgcagacctgaattacgtcgtagaacggtacaacggtcgtaaggttaagtttaacgtttacgtacgggttacggacggttaagggtactttaccgggagtacggtaacgggggttaaccgtaccggttttaacccctttaacgttaaccgtttaacccttaaccgttaaccgttaaaccgtacggttaccgggtaccggttcgggtaaccgggggg

SEQ ID NO: 62478 - DNA, 676 bp, Homo sapiens
  misc_feature: GYAE6OF02GFOTV.18.70.G04.1.454.CMB.1.raw
  modified_base (451)..(451): a, c, t, g, unknown or other
  misc_feature (451)..(451): n is a, c, g, or t
tcagtacgagtatgcacgaccggtgctcgatttagtgtagtgtgaagggaaaggggacccaacaaccacatccctcctgagaagcccccagagcacaactccttaccatggactggacctggaggatcctctttttggtggcagcagccacaggtgcccactcccaggtccagcttgtgcagtctggggctgaggtgaagagcctggggcctcagtgaaggtttcctgcaagacttctggactactccttcacttagtttttctatcctattggctgcgccgaggccccccggacaaaggcttaggagttgggtgggatggatcaacgctgtcaatgggtctacaactaaaatatttcaacagtaagtttcgacgtaagggcaaggagtccgaaccatttaacgaaggggaccaccacgtacccgacggaagaaaccgacggccccttaanagttagggacggactagggacgaccgaggtcccgtaggtacgttaactcgttacggaaacgacgaccggtacttaggttaattacgtttaacgtgtagtaccggaagggtacttgggacctaaggtcgggtaacgtacgtttaccctttaaccgtaaccgttaaccgttacccttaacgttaaccgtaacggtttacgggtacggttacgggttaacccgggggg

SEQ ID NO: 62479 - DNA, 656 bp, Homo sapiens
  misc_feature: GYAE6OF02INTNI.18.70.G04.1.454.CMB.1.raw
  modified_base (545)..(545): a, c, t, g, unknown or other
  misc_feature (545)..(545): n is a, c, g, or t
tcagtacgagtatgcacgaccggtgctcgatttagtgtagtgtgaagggaaaggggacccaacaaccacatccctcctgagaagcccccagagcacaactccgttaccatggactggacctggaggatcctcttttggtggcagcagccacaggtgcccactcccaggtccagcttgtgcagtctggggctgaggtgaagaagcctggggcctcgagtgaagtttccgtgcaagacttcgtggatactccttcacttagttttctactcctattaggcttgccgtcccgacggacccccggaacaaacggtctttggaggttggggttgggtatgggtactcgaacggtctgtacgaagtcggttcctacaactaaatacttccaacgtagaacgtttgacgagggtccaagtagtacaaccgtagttaacgagggaacacgacgtaccgacgaagaacctagcctaacagtacggacgtctaggacgacgacgccgtagactatccgtagaacgacctacggtacttacgtaactagtttacgnggtacggacgtaaggtacttagaccgttacggtaggtacgttacgttacccttaacgaaccgttaacttaactaaccttacgaggttacggtacggttaccggtaacgggg

SEQ ID NO: 62480 - DNA, 820 bp, Homo sapiens
  misc_feature: GYAE6OF02IEVWS.18.70.G04.1.454.CMB.1.raw
tcagtacgagtatgcacgaccggtgctcgatttagtgtagtgtgaagggaaaggggacccaacaaccacatccctcctgagaagcccccagagcacaactccttaccatggactggacctggaggatcctctttttggtggcagcagccacaggtgcccactcccaggtccagcttgtgcagtcgtggggctgaggtgaagaagccgtggggcctcagtgtaaggtttcctgacaagaccttgtaggatacctccttactacttagtttttctatcctagttcggctggtccgacccgtaaccgggccccccgtaaagaaacggtcttacggaggttggggttgggacgttaggagttaccggtaaaccgtcggttagtaccgtaaagttcgggttaaccttaacaaaacgttaaaaacttcgtttaaccgaaccggtaaaggtaacgtttaggacggtaacggggtaccaaggtaacgttacccgaaacgttacgttaaaccggtaaacgggactaacctacgttaccccggaagaaacgtaaccgaacgtcccgtaaacgtacggttacgggacgttaccgtagggaactaccgaagttcccgttagtaacttacgttcgtaaggaaccggtacgtacgggtaaccttagtaactttaaaggttttccgtagggttaccggaacggtaacgggttacgttacgggaccgttagggtaacgggtaacgttacccggtttaacgtttaacccgtaacgtttaaaccttaacgttacctaaacggttacgtacgggtttaccggtacggttaaaccggggg

SEQ ID NO: 62481 - DNA, 740 bp, Homo sapiens
  misc_feature: GYAE6OF02JOALG.18.70.G04.1.454.CMB.1.raw
tcagtacgagtatgcacgaccggtgctcgatttagtgtagtgtgaagggaaaggggacccaacaaccacatccctcctgagaagcccccagagcacaactccttaccatggactggacctggaggatcctcttttggtggcagcagccacaggtcgcccactcccaggtccagcttgtgcagtctggggctggaggtgaaggagccgtggggcctacaggtgtaggtttcctgacaagtacttcgtggactactccttcactttagtttttacacttccagttcggtactcgccgtaccgaccggacccccggagtaaaccggtcgttacggtagggtaggggtagggtagtacggtagtccgtaaccgtcgtcgtacgtaagttcggtactacgaacgtaaaattacttacgaacgtaagtaacgttacgacggtaagggactaggtacggttaccgaacttaacgtaacggtacggaaaccgacgtacgtacccgtaagtaaccgaaacgtaccgtacctaacggtgtacgggtactacggtgtaacgaccgtacggtacctacgtattaccgtacgtacgtaaccgtacgtaacgttcgtaaacgtttacttacgttagttcggtcgtaacggtacgttacgtacggcgtaaggttaggaacggttacttaccgttaacgttaaccttacctaaccgttacgtacgtacggtacgggttaccggtaccggtaacggg

SEQ ID NO: 62482 - DNA, 666 bp, Homo sapiens
  misc_feature: GYAE6OF02JFP9B.18.70.G04.1.454.CMB.1.raw
  modified_base (390)..(390): a, c, t, g, unknown or other
  misc_feature (390)..(390): n is a, c, g, or t
tcagtacgagtatgcacgaccggtgctcgatttagtgtagtgtgaagggaaaggggacccaacaaccacatccctcctgagaagcccccagagcacaactccttaccatggactggacctggaggatcctcttttggtggcagcagccacaggtgcccactcccaggtccagcttgtgcagtctggggctgaggtgaagagccgtggggcctcagtgaaggtttcctgcaagacttctggatactccttcacttagtttttctactccattggtcttggccgtccacgggtcccccggaagaaacggtcttgaggtgggtgggagtggatcgaacgtctttcaagtggtctacaaactaaattatacgacaagtaagttcgacgaggganaggagtccactaagtacgtagggacacacgtccgacgagaaccacgacctactagtcggagtacgtgacggcgacgccgttagacttatcgttaagaaacgtaccggaccggtacgttaagttaactaagtttacgtacgttcgggacgtacgggtacttacggaccggtaggtacgggacgttaccgttaacccgtttaaccgtaaccgtttaacgttaaccttaaccgttaacttacggttacggtaccggttacgggtaacgggtaacccggg

SEQ ID NO: 62483 - DNA, 861 bp, Homo sapiens
  misc_feature: GYAE6OF02IZO9T.18.70.G04.1.454.CMB.1.raw
tcagtacgagtatgcacgaccggtgctcgatttagtgtagtgtgaagggaaaggggacccaacaaccacactccctcctgagaacgccccagagcacaacctccttaccatggactggacccgtggaggtacttccgtttcgtttttgggtggcagcacgccacgacggtcgccctacctcccgaccggtccgacgtcgttggtcgtcgtacgtcggtcggggtcgtaggagggtaggaaaggaacggtccggtcgggtccgtacggtaggttacggttacggtttccgtgccctaaaggacctttactacgggacttacgtcctttcgtaccttagttttttccaattcccgaatttcgggcctttcggcggtccccaagggacccccccccggggtataaaacggggcctttacgggaacggttggggttcgggaattcggggaacttcgaaacgtcgtagtccgtaagtcgggtactacgtaacaaagttacttaacgacttaaggaacgttacggacctaggggctaaggacgtactaccgtaagtttacctaagggtacaacggtaacgtacccggtacgtaacggaaacccgtaacgacccgtaaagacgttacgggaagtcgtagaacgtcgagacccttaggacgttacttacgtacgaaaccggtcgaaccgggtactacggttaactaaggtttcgtacgttacggtaccggtacggtaagttcgggtacgtaacggttcgggtaaccggttaacggttacccgtttaaacctaaccggtttaacccgttaacccgtttaacggtacccgttaagggtacccgggtacgggtttaaccgggtaaccggggg

SEQ ID NO: 62484 - DNA, 797 bp, Homo sapiens
  misc_feature: GYAE6OF02HJMSC.18.70.G04.1.454.CMB.1.raw
  modified_base (181)..(181): a, c, t, g, unknown or other
  misc_feature (181)..(181): n is a, c, g, or t
tcagtacgagtatgcacgaccggtgctcgatttagtgtagtgtgaagggaaaggggacccaacaaccacatccctcctgagaacgcccccagagcacaactccttaccatggactggacctggaggatccttctttttggtggcagcagccacgaggtgcccactcccaggtccagcttgngcagtcgtggggctggaggtaggaagtaggccgtggggccctcgaggtggtaacggttttcctgactaacggtacctttcgtagggtacttaccgttccctttactacgttttagtttttacctactaccctagtttcgggtcttcggccgtacccgaaccgggccccccggaaacgaaacggtccgttgggtaacgggttgggggtacggggtagtcgggagtacgaaccggcgttacgtacgtacgttacggtacttacgaaactaaacttacttaccaacgagttaaaggttcgacggtaagggacgtaaggtacgtaccaaccgttaacgttaacggtaacggtacgaccgtaacgtaccgaaccggaacggtaacaccggtaccaacgtaacggtacgggtaacacggtaagacggtaccggtaaccgccgtagtacctagttacgtaggaaaccgtacggtaccgtagttacgttaattcgttaagttgtcggtacggaggttacgttggacggttacggtagggttaccgtaccggtttaaccgttaccgtaacctttaaccgttaccttacggtacgttacgggtcggttaccggtgggtaacccggg

SEQ ID NO: 62485 - DNA, 705 bp, Homo sapiens
  misc_feature: GYAE6OF02GFK9D.18.70.G04.1.454.CMB.1.raw
  modified_base (139)..(139): a, c, t, g, unknown or other
  misc_feature (139)..(139): n is a, c, g, or t
  modified_base (323)..(323): a, c, t, g, unknown or other
  misc_feature (323)..(323): n is a, c, g, or t
  modified_base (341)..(341): a, c, t, g, unknown or other
  misc_feature (341)..(341): n is a, c, g, or t
  modified_base (478)..(478): a, c, t, g, unknown or other
  misc_feature (478)..(478): n is a, c, g, or t
  modified_base (486)..(486): a, c, t, g, unknown or other
  misc_feature (486)..(486): n is a, c, g, or t
tcagtacgagtatgcacgaccggtgctcgatttagtgtagtgtgaagggaaaggggacccaacaaccacatccctcctgagaagcccccagagcacaactccttaccatggactggacctggaggatcctctttttggnggcagcagccacaggtgcccactcccaggtccagcttgtgcagtctggggctgaggtgaagagccgtggggcctcgagtgtaaggtttcctgcaagtacttcgtggaactcctccttacactttagttttctactcctagttgctgcgaccgaccggccccggaacaacggcgtagaggtgggngggtagtgatacaacggntaggtcaagtcggtacctacaagtaaaatcgttacaagtagtaagttgacgagggacagaacgtcaacgtaacgttacgtaagggacaactacgtaccgacgaacgaacacgtacctacgtaacgtaggagtaccgngacgtacncggttcctaggtactagtacgtaacgaaacggaccgcggtaacttaggttaacgttaacgtttacttagggtacgtacgggaaggttactttagggacggttaagggtacgggttaaacgttacccggtttaaccttaaccgtttaaccgtaaaccgtttaacgtaccgtttaaaccgacgggtttaacggttacccgggtttaccgggtaaccggggg

SEQ ID NO: 62486 - DNA, 727 bp, Homo sapiens
  misc_feature: GYAE6OF02GMYKN.18.70.G04.1.454.CMB.1.raw
  modified_base (300)..(300): a, c, t, g, unknown or other
  misc_feature (300)..(300): n is a, c, g, or t
tcagtacgagtatgcacgaccggtgctcgatttagtgtagtgtgaagggaaaggggacccaacaaccacatccctcctgagaagcccccagagcacaactccttaccatggactggacctggaggatcctcttttggtggcagcagccacaggtgcccactcccaggtccagcttgtgcagtctggggctgaggtgaagacgccgtggggcctcagtgaggtttcctgactaaggtacttcgtggatacctccttacacttagttttcatcctattggctgcgccgacggcccccggaanaaggtcttaggacggtgggtgggtatggactacgaacgctagtcaagtcggtcaacgaactaaaattacttaccgaaactaggtaacgtttacgacggaacgggtcgtaagaacgttaccgaaccttaaagttaaccggtaacgggaacaaccgtacgtacccggacggtaacgaaaccgtaacgtaaccgtaacgtacgtacggaacgtacgtacggaacgaccgaacggtaccctagtaacgtaccgttacgtaaggtaacgaaccgtacgggttacgttacgttaactttaacgttacgtacgttacggacggttagtacgtacgtacgtaggtacggtaagtaccggttacccttaacgttaaccgttaacgttacccttaagttaaccttacggtacggttaccggtaccggttaaccgggg

SEQ ID NO: 62487 - DNA, 732 bp, Homo sapiens
  misc_feature: GYAE6OF02GX2PH.18.70.G04.1.454.CMB.1.raw
  modified_base (320)..(320): a, c, t, g, unknown or other
  misc_feature (320)..(320): n is a, c, g, or t
  modified_base (363)..(363): a, c, t, g, unknown or other
  misc_feature (363)..(363): n is a, c, g, or t
  modified_base (519)..(519): a, c, t, g, unknown or other
  misc_feature (519)..(519): n is a, c, g, or t
tcagtacgagtatgcacgaccggtgctcgatttagtgtagtgtgaagggaaaggggacccaacaaccacatccctcctgagaagcccccagagcacaactccttaccatggactggacctggaggatccttctttttggtggcagcagccacaggtgcccactcccaggtccagcttgtgcagtctggggctggaggtgaagagccgtggggcctcagtgtaaggtttcctgcaagaccttcgtaggacttactcccgtttacacgttttagtttttcacttcctaagtttcggcttgccgccgaccggaccccccgganaaacggtcttacggtaggtgggtgggagtggataccaacggtntgtactaagtcggttatacctaagtaaaacttacttaccaagtagtaagtttacgaccggtaggacaacggtacgtactaacctaagttaccggtaacgggaacctactacgtaccggacgaacgaacaccggtacccgtaacacggtacgggacncgtacggaacggacgtaacgaccgttacggtaataccttacgtaaacgaacgtacccgtagttaacccgttgttaaacgtttagttaaccgtgggtttacgccggttaaggttacttaggaccgtaggtaggtaacggtaaccgtttacgtttaaccactttaacgttaacttaaccgttaagtacggttacggttacggtggttaaccgggg

SEQ ID NO: 62488 - DNA, 650 bp, Homo sapiens
  misc_feature: GYAE6OF02I7FK6.18.70.G04.1.454.CMB.1.raw
  modified_base (584)..(584): a, c, t, g, unknown or other
  misc_feature (584)..(584): n is a, c, g, or t
  modified_base (622)..(622): a, c, t, g, unknown or other
  misc_feature (622)..(622): n is a, c, g, or t
tcagtacgagtatgcacgaccggtgctcgatttagtgtagtgtgaagggaaagggacccaacaaccacatccctcctgagaagccccagagcacaactccttaccatggactggacctggaggatccttctttttggtggcagcagccacgaggtcgcccactcccaggtccagcttgtgcagtcgtgggctggaggtagaagagccgtggggcctgacgtggtaaggtttcctgacgaagactttcgtaggattacctcctttcgactttagtttttctatacctagttcggcttcgccgccgtacggaccccccggaagaaacggtcgttaggaggttcggggtagggagtggacgtacgaacgtcgtagtactaagtgtactactaactaaatacttacgaacgtaagtaagttcgacgtagggcaacgtacgtaccgaacgtaacgttaacgtaagggaaccacgtaacgtccggaacggaacgaaactacggccttacgagtcggagtcgtagacgcacgtaccgtgaatctacaagacgacgacggtctagtattacgtagtgtgtacgtagtacgtnacgaggtacgagttacgtacttacttactagtaacgtntaacgtacgttacgacggttcgtacggg

SEQ ID NO: 62489 - DNA, 687 bp, Homo sapiens
  misc_feature: GYAE6OF02FTYAY.18.70.G04.1.454.CMB.1.raw
  modified_base (239)..(239): a, c, t, g, unknown or other
  misc_feature (239)..(239): n is a, c, g, or t
  modified_base (385)..(385): a, c, t, g, unknown or other
  misc_feature (385)..(385): n is a, c, g, or t
  modified_base (432)..(432): a, c, t, g, unknown or other
  misc_feature (432)..(432): n is a, c, g, or t
tcagtacgagtatgcacgaccggtgctcgatttagtgtagtgtgaagggaaaggggacccaacaaccacatccctcctgagaacgcccccagagcacaactccttaccatggactggacctggaggattccttctttttggtggcaggcagccacaggtgcccactcccaggtccagcttgtgcagttctggggctggaggtggaagaacgccgtggggcctcaggtgtaaggtttccngctagacttcgtaggactactccttctacttacgttttctactcctagttcggacgtgacctccgacggtcccgtaggaactaaggtctggtaggtcggggtagggtagtggaactcgaacgtcgtagtacaacgttggtacctanaaacgtaaaattcttacgtaacaaggtaagttcgacggtacgggtanaacggtacgtaccaaccgtaagtttaccgaaagggtaccacgtacgtccgaacgagaaccgacggtacctaacgaggttaggacgtcggacgacgacgtaccgtacgttagtacgtaccttaggtaacgaacgaacgtaacggtcttaagttacttagtttaaccgtggacgtacggtagtagttcggtaagcggttaggacgtacttaccgtaatacccgtaattccgtaatacgtacggtcggtacgtacggg

SEQ ID NO: 62490 - DNA, 723 bp, Homo sapiens
  misc_feature: GYAE6OF02FPAYW.18.70.G04.1.454.CMB.1.raw
  modified_base (514)..(514): a, c, t, g, unknown or other
  misc_feature (514)..(514): n is a, c, g, or t
  modified_base (615)..(615): a, c, t, g, unknown or other
  misc_feature (615)..(615): n is a, c, g, or t
  modified_base (639)..(639): a, c, t, g, unknown or other
  misc_feature (639)..(639): n is a, c, g, or t
tcagtacgagtatgcacgaccggtgctcgatttagtgtagtgtgaagggaaaggggacccaacaaccacatccctcctgagaagccccagagcacaactccttaccatggactggacctggaggatccttcttttggtggcagcagccacaggtgcccactcccaggtccagcttgtgcagtcgtggggctgaggtgaagaagccgtggggcctcgagtgtaaggtttcctgcaagtacttcgtaggacttacgtccttacctactttacgtttttctactacctatttggccttggccgcccggtaccgggtacccccggaacaaacgggtccgttggacggttagggggtgggtaacggtggtaacgtaccgaaccggtccgtaggtaccgtaaggttcgtacctacgaacttaaaactattaccaataggtaaggttagcggtagggcaaggtacgtacaaccgtaagttaaccgtaagggaaccactacgtacccggacgaacggaaccncggaccctaagacgtacgggactacgtaggaccacgacggtacctaggtaattcggtaactaggaaccgacgtacggcgttaagtaacgttacgtttacgngggtacgtaggaagttgtacgcgnggttacggaaggttcttaaccgttacgttaaccgttactaccttaaggtaaccgttgggtaccgttacgggcggttaaccgggg

SEQ ID NO: 62491 - DNA, 801 bp, Homo sapiens
  misc_feature: GYAE6OF02G07P7.18.70.G04.1.454.CMB.1.raw
  modified_base (138)..(138): a, c, t, g, unknown or other
  misc_feature (138)..(138): n is a, c, g, or t
  modified_base (242)..(242): a, c, t, g, unknown or other
  misc_feature (242)..(242): n is a, c, g, or t
tcagtacgagtatgcacgaccggtgctcgatttagtgtagtgtgaagggaaaggggacccaacaaccacatccctcctgagaagccccagagcacaactccttaccatggactggacctggaggatccttcttttggnggcagcagccacaggtcgcccactcccgaggtccagtccttgtcgactagtcgtaggggctggaggtagaaggacgccgtggggcctgagtgtaacggtttccngacgaagtacgttcgtaggacttacctcttacacgtttagttttcctattcctagttcggtacttcgcgaccgtaccgggacccccgaacgaaacgtcgtaggtaggtggggtacggagtacggtactacggaaaccgtcgtacgtacaaacggttcggtaacctaacgaaactaaaacgttacgtttaaccaacgtaggtaacggttaagcggtaacgggtactaggtaacgttaccaaacgttacgttaacggtacgggaaacaaccgttaacgtaccggaaaccgtaagtaacccgaaccgtaccgtaaacgacggttaacggaacgtacggtaacgtaacggcctaacggttcctaaagtcgttaaaccgtcgtaaaggaaccgtaccggtacgggttaaccttacgtttaaacttacggttaacttcgggtagtaacggttaaggttcgttacggacgtaggtaacggaaccggttaacgtttccgaaacgtttacttaaccggtacttaaccggttaggtaccgggtaacttcggggtaaggtaaaacccggg

SEQ ID NO: 62492 - DNA, 719 bp, Homo sapiens
  misc_feature: GYAE6OF02FMX3O.18.70.G04.1.454.CMB.1.raw
  modified_base (356)..(356): a, c, t, g, unknown or other
  misc_feature (356)..(356): n is a, c, g, or t
  modified_base (656)..(656): a, c, t, g, unknown or other
  misc_feature (656)..(656): n is a, c, g, or t
tcagtacgagtatgcacgaccggtgctcgatttagtgtagtgtgaagggaaaggggacccaacaaccacatccctcctgagaagcccccagagcacaactccttaccatggactggacctggaggatcctcttttggtggcagcagccacaggtgcccactcccaggtccagcttgtgcagtctgggctgaggtgaagagccgtgggcctcagtgaaggtttcctgacagtacttctggactactccttactacttagttttctactcctagttgctcgcgccgaccggtacccccggaacgaaacggtccgttaggagggtggggtacggggtatagggtaactacgaaccggtntacggtactaagtcggtacctacaaactaaaattcttacataggtaagttcggacgagggtcagtagtacctacctagtaacgtaacgggtaacacggtccgaagtaacgaaccgacgtacctaacgtaggtacgggaatccgagtaccgacgtacgaccgttagacttactacgtaacgaacgacccggtaacgtcgtaagttactttaaacgtttccggacgttagggacgtaagggttactacgttaggaccggtagggtaccggttaaaccggttacctttaacctaaacccgttnttaacccgtaacgttaccgtaacgggtacggttaaccggggttcggtaacggggtaaacccgg

SEQ ID NO: 62493 - DNA, 674 bp, Homo sapiens
  misc_feature: GYAE6OF02GJNXX.18.70.G04.1.454.CMB.1.raw
  modified_base (227)..(227): a, c, t, g, unknown or other
  misc_feature (227)..(227): n is a, c, g, or t
  modified_base (301)..(301): a, c, t, g, unknown or other
  misc_feature (301)..(301): n is a, c, g, or t
tcagtacgagtatgcacgaccggtgctcgatttagtgtagtgtgaagggaaaggggacccaacaaccacatccctcctgagaagcccccagagcacaactccttaccatggactggacctggaggatcctcttttggtggcagcagccacaggtgcccactcccaggtccagcttgtgcagtcgtggggctgaggtgaagagcgtggggcctcagtgaaggtttccngacaagtacttctggatacctccttctacttagtttttctatcctagttgcttgccgccgacggcccccggaanaacggcgttggaggtgggtgggagtggactcgaacggtctgtactagtcggtctacaactaaatactacgaacagtaagttcgagtacgggacaggacgtacaacgtagttaaccgaaggtacacgacgtaccgacgaagaaccgacgtacctaagaggttggacgtcgtacgacgactacgtcctaggtatacgttcgtagaacgtaccgaggttacgtagttacttaacgttacgtggtaggtacgtagggtacgtttcggaacgttagggtcgggtaaacgttacggtttaccctttaaaccgttaacgtttaacccgttactttaaccgtacgttaacggtacggttaccggttacgggttaaccgggg

SEQ ID NO: 62494 - DNA, 784 bp, Homo sapiens
  misc_feature: GYAE6OF02FKRXO.18.70.G04.1.454.CMB.1.raw
  modified_base (239)..(239): a, c, t, g, unknown or other
  misc_feature (239)..(239): n is a, c, g, or t
  modified_base (292)..(292): a, c, t, g, unknown or other
  misc_feature (292)..(292): n is a, c, g, or t
tcagtacgagtatgcacgaccggtgctcgatttagtgtagtgtgaagggaaaggggacccaacaacccacatccctcctgagaagcccccagagcacaactccttaccatggactggacctggaggatcctcttttggtggcagcagccacaggtgcccactcccaggtccagccttgtgcagtctggggctgaggtgaagaagccgtggggcctcagtgaagtttcctgcagacttcnggatctcctcacttgttttctatcctattggctgcgccgtacggcccccgganaaacggtcttcgacggtggtcgggtagtggtatcgaacgtcgtgtaccgtaagttcggtcctacaaacgtaaacttacttaccaacgtaagtaacggttgacgacggggtaccgaacggtacgttaaccgaaccgtaacgtttaaccgtaacgggggtaacctaccgtaaccgttaccccgggaccgtaaacggtaaacccgtaacccggtaccccgtaaccgtaaacggttacggggtaacgtccgttaacgggtacggaaccgtaccggtaccgtacggtaaacttaacggtcgtaacggtaaacgtaccggtaccgggtacgttaacgttaacgtttaacgtttaccgtacgttacggtaccggtaaggtacgttacgtacggtacggtaggtaaccgggttaccttaccgttaaccgtttaaccgtaaccgttaccgttaacccgtaggttaacccgtacgggttacccggttggtaaaccccggggg

SEQ ID NO: 62495 - DNA, 673 bp, Homo sapiens
  misc_feature: GYAE6OF02HVR8F.18.70.G04.1.454.CMB.1.raw
  modified_base (138)..(138): a, c, t, g, unknown or other
  misc_feature (138)..(138): n is a, c, g, or t
  modified_base (214)..(214): a, c, t, g, unknown or other
  misc_feature (214)..(214): n is a, c, g, or t
  modified_base (226)..(226): a, c, t, g, unknown or other
  misc_feature (226)..(226): n is a, c, g, or t
  modified_base (361)..(361): a, c, t, g, unknown or other
  misc_feature (361)..(361): n is a, c, g, or t
  modified_base (366)..(366): a, c, t, g, unknown or other
  misc_feature (366)..(366): n is a, c, g, or t
tcagtacgagtatgcacgaccggtgctcgatttagtgtagtgtgaagggaaaggggacccaacaaccacatccctcctgagaagcccccagagcacaactccttaccatggactggacctggagatcctctttttggnggcagcagccacaggtcgcccactcccaggtccagcttgtgcagtctgggctggaggtgaagagccgtggggcctnagtgaggtttcngacaagtacttctgatactccttcacttgttttctatcctagttcgctgcgtccacggcccccggacgaaaggcttacggaggtggggtgggagtggtagtacgaacgctagtctaagtcggtctcaactaaatntacanaagtacgtgacaggcagtacgaccagtacgtttaacgacggaacctactacgtaccgacgtaacgaaacgtaccgtaccgtaacagtacgggtaacgcgtaggacgacacgtacccgtagacttactcgtaacgtaacgaaccggtacgtacgtacgttaagttaccttaacggttggacgacggttaaggtattacggtacgtaagggtcggtaaacggttaccgtttaccgttaaccgttaaccgtaccgtttaaccgttaaccgttaacgtaccggtaacggggtccgttaacgggaaccgggg

SEQ ID NO: 62496 - DNA, 902 bp, Homo sapiens
  misc_feature: GYAE6OF02I3KQ4.18.70.G04.1.454.CMB.1.raw
  modified_base (138)..(138): a, c, t, g, unknown or other
  misc_feature (138)..(138): n is a, c, g, or t
tcagtacgagtatgcacgaccggtgctcgatttagtgtagtgtgaagggaaagggggacccaacaaccacactcccctcctgagaacgcccccagagcacaactccttaccagtggactggacctggaggattccttntttttgggtggcaggtcacggccacgtaggtcgcccactcccgacggtcccagtctttgtcgctacgttcgtggggtctaggtagggttagaaagggacgtcccggtcggggtacctcggtaaggttcgggtaaaggttttccctagggaaccttaaaggtacccgtttcgtaggtaacctttaaccttccctttaccgttaacgttttaaccggttttttacctaacgttccccttaagtttccggggtactttccggccggtaccccgtaaccggggtccccccggtaaaaggtaaacgggttcgttaggggtaacgggttaggggggttaccgggttaaggttacgggaaccttaaccgggtaaccttcgggttaacctaccgtaagtcggtaccttaacaaactaaagtttactacgaatacggtaagttcgaacggcgggtacaacggttagtaccgtaaacctagttaaccggttaggaaccacgttacgacccggttaagaacgtaaacccgggtaccctaagacggttcggaaactccggtaagacggtacacgttccgttagaacgtttctaaacgtggaaactccgtacggtatttacgttaagttacgttaccgttggtaacgtcgtaacgtcgtttacgggacgtgggttaaccgggaaccgtttacggttaacccttttaacggtaaccttttaacggaacttacccggttagacccgggtttaaggttaccggtacccgggttaacgggg

SEQ ID NO: 62497 - DNA, 740 bp, Homo sapiens
  misc_feature: GYAE6OF02IN4WF.18.70.G04.1.454.CMB.1.raw
tcagtacgagtatgcacgaccggtgctcgatttagtgtagtgtgaagggaaaggggacccaacaaccacatccctcctgagaagcccccagagcacaactccttaccatggactggacctggaggatcctcttttggtggcagcagccacaggtgcccactcccaggtccagcttgtgcagtctggggctgaggtgaagagccgtggggcctcgagtgaaggtttcctgacaagacttcgtggattacctccttcacttagtttttcctacttacctagttggtctcgcgtccgacggacccccggaacaaaggtcttcggaggtggggtacgggagtggtactacgaacgtctagtacaagtgtacctacaacgtaaaattctacacgtagtaacgttgacgagggactagacttaaccgactacgttaacgtaagggaccacgtaacgtcccgagaacgacgaacgtcctaacgtagttacggacgtactaggaccgacgtacggaccgttacgaacttaacgtacgtacggaaacggtactaacccgggtacgttagttaacgttaacctttaacgggtagttacggtaaacccgggtaggttacgtttacgggacgttagggttacgggtaaacggttccggtttaacccgtttaaccgttaacccgttaaacccggtttacttaacccggttaacgacggtttaacggttacccggttacggttaaacccggggg

SEQ ID NO: 62498 - DNA, 694 bp, Homo sapiens
  misc_feature: GYAE6OF02ICN82.18.70.G04.1.454.CMB.1.raw
  modified_base (251)..(251): a, c, t, g, unknown or other
  misc_feature (251)..(251): n is a, c, g, or t
  modified_base (279)..(279): a, c, t, g, unknown or other
  misc_feature (279)..(279): n is a, c, g, or t
  modified_base (288)..(288): a, c, t, g, unknown or other
  misc_feature (288)..(288): n is a, c, g, or t
  modified_base (342)..(342): a, c, t, g, unknown or other
  misc_feature (342)..(342): n is a, c, g, or t
tcagtacgagtatgcacgaccggtgctcgatttagtgtagtgtgaagggaaaggggacccaacaaccacatccctcctgagaagcccccagagcacaactccttaccatggactggacctggaggatcctctttttggtggcagcagccacaggtgcccactcccaggtccagcttgtgcagtctggggctgaggtgaagaagcctggggcctcagtgaaggtttcctgcaagacttctggatactccttnacttagttttcatccattggctgcgccnggccccganaaggcttgagtgggtggatggatcaacgctgtcaagtggtctacaactaaaatnttacaacagaagttgctagggcagagtcaacctagttactagggaccacacgtcccgacggaacggtaaccacggtacctaaacgacgttacgggaaacgtccggttaaggaaccggtaccgaaacggtcccgtttaaggtaaactttaacgttcccgttaaagggaaaacgtacccggtaaccgggtacctttacggtttaaacgttaaccgtttacgtaccgggttaggaccggtaagggtagttacgtacggtagggttagggaacggtaccgtttacccgtttaacgttaacccgttacttaccgttaacttaaccgaggttacgggtaacccgtcggttaacggggg

SEQ ID NO: 62499 - DNA, 809 bp, Homo sapiens
  misc_feature: GYAE6OF02HJXTW.18.70.G04.1.454.CMB.1.raw
tcagtacgagtatgcacgaccggtgctcgatttagtgtagtgtgaagggaaaggggacccaacaaccacatccctcctgagaagcccccagagcacaactccttacatggactggactggagatccttcttttggtggcagcagccacaggtcgcccacctcccgaggtccaggccttgtgctagtcgtggggctggaggtagaagaacgccgtcggggcctcgagtggtaagtttcctgacaagtacttcgtaggacttaccttccttctaacgtttagttttttccactttaccctagtttcggactttcggccgacccggaccggaccccccggaacgtaaacggtcgttcggtaaggggtcggggttagggactacgggtactaccgaaccggcgtttagaactaaagtcgggttactaaccgtaactaaaaacgttcttacaaccgttaagtaacggtttcgaccggaagggtactaacgtaaggtccctaaacgtaacttttaacgggaaccggggaaccttacgaccggttacccggaagtaaccgaaaccgtaaccgtaacccgtaacgtaacggttacgggaacgtacggttacggaggtaacctacggtaccgttaagtactttaacgtacgttaacggaaggttaaccgaccggttaacgttacgttaactttaacggtttaacgttagttacgggtaacgttaggtagtttacggacgtaggttaggtacgtacggttaccgttactaactttaccgtaacttaactaccgtaggtacggttacgtacggtaacggg

SEQ ID NO: 62500 - DNA, 760 bp, Homo sapiens
  misc_feature: GYAE6OF02GLL91.18.70.G04.1.454.CMB.1.raw
  modified_base (530)..(530): a, c, t, g, unknown or other
  misc_feature (530)..(530): n is a, c, g, or t
tcagtacgagtatgcacgaccggtgctcgatttagtgtagtgtgaagggaaaggggacccaacaaccacatccctcctgagaagcccccagagcacaactccttaccatggactggacctggaggatcctctttttggtggcagcagccacaggtgcccactcccaggtccagcttgtgcagtctggggctgaggtgaagacgccgtggggcctcgagtgtaacggtttcctcgacaacgtacttcgtggactacttcctttccactttatttttctactcctagttttcggccttggaccgcccgtaccgggcccccccggaagtaaacggccgttaggaggttggggtagggtagtgggtactaccgtaacgcgtggtactaagttcggtctaccgaaactaaagttattaccaacgtagtaagtttgacgagggacctaggtacgtaccactaagtttacgaacgggacacctacgtaccgacgaacgaaccgacgaacccttgaacgtcggaacgtcctagggacncgaacgtcgtaacgacttactacgtacggaaacgccgaaccgggttctaaggtttaactttaacgtttacgttcgggtacgttccgggaaaggttacttagggacgttacgggttagggtaacggttaaccgtttacccgtttaaacccgttaacggttttaaccccaaacccggtttacgtaaaccggttacggttaaccgggttacccggttaggtaaccccgggggg

SEQ ID NO: 62501 - DNA, 680 bp, Homo sapiens
  misc_feature: GYAE6OF02JV20V.18.70.G04.1.454.CMB.1.raw
  modified_base (212)..(212): a, c, t, g, unknown or other
  misc_feature (212)..(212): n is a, c, g, or t
  modified_base (225)..(225): a, c, t, g, unknown or other
  misc_feature (225)..(225): n is a, c, g, or t
  modified_base (237)..(237): a, c, t, g, unknown or other
  misc_feature (237)..(237): n is a, c, g, or t
tcagtacgagtatgcacgaccggtgctcgatttagtgtagtgtgaagggaaaggggacccaacaaccacatccctcctgagaagcccccagagcacaactccttaccatggactggacctggaggatcctctttttggtggcagcagccacaggtgcccactcccaggtccagcttgtgcagtcgtgggctgaggtgaagagccgtgggccnagtgaaggttccngcaagacttcgnggactactccttcacttagttttctatcctattcggactcggccgccgacggacccccggagaaacggtcttaggacgggtgggttagggacgtaggacttacgacgtcgtagtacgaagttcggtcctacaaacaaacgttattaccaacgtaaggtacggttgtacggagggtacaagtacggtacaccgttaataacgtacggaccagtacgtccgacgtaacgacgacgtacctacgacgtaggacgtgttacggagacctacggtacctagacgttaacgtacgtagaacggtaccgtacggtacgttagtaacttacgttacgtagtgaccggtaagtacgttagacgtaggtacggtaacggttcgttaccgttaacgttccttaacgttaaccgttaaccgtacgttacggtacggtacggtacggttaaccggg

SEQ ID NO: 62502 - DNA, 716 bp, Homo sapiens
  misc_feature: GYAE6OF02GWW4C.18.70.G04.1.454.CMB.1.raw
  modified_base (483)..(483): a, c, t, g, unknown or other
  misc_feature (483)..(483): n is a, c, g, or t
  modified_base (497)..(497): a, c, t, g, unknown or other
  misc_feature (497)..(497): n is a, c, g, or t
tcagtacgagtatgcacgaccggtgctcgatttagtgtagtgtgaagggaaaggggacccaacaaccacatccctcctgagaagcccccagagcacaactccttaccatggactggacctggaggattcctctttttggtggcagcagccacaggtgcccactcccaggtccagcttgtgcagtctggggctgaggtgaagagccgtgggcctcgagtgaagtttcctgacaagacttctggatactccttcacttagttttctaatcctattcggctgccgtccgaccggtaccccccggaagaaacggtctttaggacggttgggggtagggtagtgggtaactaccgaaaccggtcgttcggtactaaaggtcggttctacgaaactaaaaattcttacaacgtaagtaagttacgacgaggacaagactacgaacctaagtacgtaagggacctaacgtactcccggacgaacgtaacncgaccgtaactagngggaacgtcgtaggaacgctaaggtccgttaacgaattacgtcctaagaacggtaccgtacggtacctacggttaaattagttaaccgttgtacggtaagggacgtagttaccgaggtacggtaggtacggttaacttaccggttaaaccttaccgtttaaactaacccgtttaacctaaccgttaggttaacgggtaccgttacgggtaaacccgggg

SEQ ID NO: 62503 - DNA, 771 bp, Homo sapiens
  misc_feature: GYAE6OF02G6550.18.70.G04.1.454.CMB.1.raw
  modified_base (228)..(228): a, c, t, g, unknown or other
  misc_feature (228)..(228): n is a, c, g, or t
  modified_base (291)..(291): a, c, t, g, unknown or other
  misc_feature (291)..(291): n is a, c, g, or t
  modified_base (344)..(344): a, c, t, g, unknown or other
  misc_feature (344)..(344): n is a, c, g, or t
tcagtacgagtatgcacgaccggtgctcgatttagtgtagtgtgaagggaaaggggacccaacaaccacatccctcctgagaagcccccagagcacaactccttaccatggactggacctggaggatcctctttttggtggcagcagccacaggtgcccactcccaggtccagcttgtgcagtctggggctgaggtgaagaagcctggggcctcagtgaaggtttccngcaagacttctggactactccttcacttagtttttcatccattgctgcgccacggcccccganaacggcttgaggtgggtggagtggatacgacgctgacatggtcacactaaatntcacagtagttgcgaggactagacgtcacctattaacgtagggaccacgtacgtaccggacgtaacggaaaccgtacgtacccttaacgtacggtacgggtacggtccgttacggaaccggtaccgacgggttacccgttacgggtaacgtttaacgttaccgttaacgggaaacggtaaccgtaaccggggttaccttaacgggtttaaacgtttaacgttttaacggtttacggggttaccggttaacggtaacggggttacgtttaccgggtagggttaaccgggttaacggggttaacgggttaacccggtttaaccccgttttaacggtaaacccccgttttaaccgtttaaccgtttaaaccccttaacggtaaccggttttaaccgggggtacccggttaccggggttaaacccgggggg

SEQ ID NO: 62504 - DNA, 896 bp, Homo sapiens
  misc_feature: GYAE6OF02HG8VK.18.70.G04.1.454.CMB.1.raw
tcagtacgagtatgcacgaccggtgctcgatttagtgtagtgtgaagggaaagggacccaacaaccacatccctcctgagaagcccccagagcacaactccttaccatggactggacctggaggatcctctttttggtggcagcagccacaggtcgcccactcccaggtccagtcttgtgcagtcgtggggctgaggtagaagagccgtgggcctcgagtgtaaggtttcctgacaagtacttcgtggaacttccttccttctactttagttttttcctacttacctagtttcggtcgtgccgtaccgaccgggacccccccggaacgtaaaacgggtccgttagggtacggggttaggggggttggggtaacggttcggggacgttaaccgaaaccggtcgtttacggtacctaaagttcgggtactacctaaaacgtaaaacttactttacgaactaagtaaaggtttcgacggaacgggactaacggtacgtacccgtaaccttaaacgtttaacggtaacgggtaacctaaccgtaaccgttacccgaacggaaacgaaaccgaaccgtaccccgttaaacgacggttacgggacgtacgacggtacgacgtaccgtaccgtagtaagtacgttaaccgtaacggtaacgaaccggtaccggttaaccgtttaagtttaactttaaacggtttccgtttaacggttaccggggtaaccgggtaaggtttacgttaacgggtacggtaaggggttaacggggtaacggttaaccgggtttttacccttaaaccggttttaaaccccttaaccgtttaaaccccgttttaaacgttaacccggttaacgggtttaaccgggttacccgggtttaccggggttaaccccgggggg

SEQ ID NO: 62505 - DNA, 702 bp, Homo sapiens
  misc_feature: GYAE6OF02GW0HT.18.70.G04.1.454.CMB.1.raw
  modified_base (179)..(179): a, c, t, g, unknown or other
  misc_feature (179)..(179): n is a, c, g, or t
  modified_base (500)..(500): a, c, t, g, unknown or other
  misc_feature (500)..(500): n is a, c, g, or t
  modified_base (607)..(607): a, c, t, g, unknown or other
  misc_feature (607)..(607): n is a, c, g, or t
tcagtacgagtatgcacgaccggtgctcgatttagtgtagtgtgaagggaaaggggacccaacaaccacatccctcctgagaacgcccccagagcacaactccttaccatggactggacctggagatccttcttttggtggcagcagccacaggtgcccactcccaggtccagcttgtncagtcgtgggctgaggtgaagagccgtggggcctcgagtgtaaggtttcctgacaagtacttcgtaggacttaccttccttctactttacgtttttactactcctagttcggtcctggccgccgaccgggaccccccggtagaaacggtccttagggaggtggggtcggagtggtactacgtaacgccgtaggactaagtcgtactacaaacttaatacgttacaagtaacgtaagttcggacgagggacaggtacgtactactaagtacgagggtaacaccgtacgtaccggaacggaacgtaaccgacgtacccgtaanagggtacggacacgtagacggtacgaccgtacgtaggtactacgtacgtaacgaacgtccgtaacgtcgttagttaacttacgttacgtggcggtagaaaggttcgngtaggtcggtaggtaggttaacccgttacctttaaccgacgtttaaccttacgttaacctcgtaaccggttacgggtacggtaggttaaccgggg

SEQ ID NO: 62506 - DNA, 589 bp, Homo sapiens
  misc_feature: GYAE6OF02F0DQQ.18.70.G04.1.454.CMB.1.raw
  modified_base (215)..(215): a, c, t, g, unknown or other
  misc_feature (215)..(215): n is a, c, g, or t
  modified_base (310)..(310): a, c, t, g, unknown or other
  misc_feature (310)..(310): n is a, c, g, or t
  modified_base (443)..(443): a, c, t, g, unknown or other
  misc_feature (443)..(443): n is a, c, g, or t
tcagtacgagtatgcacgaccggtgctcgatttagtgtagtgtgaagggaaaggggacccaacaaccacatccctcctgagaagcccccagagcacaactccttaccatggactggacctggaggatccttctttttggtggcagcagccacaggtgcccactcccaggtccagcttgtgcagtcgtggggctgaggtgaagagcctggggcctnagtgaggtttctgcaagacttcgtggatacttccttctacttagttttctatcctattggctgccgccgacggcccccggacgaaaggcttaggnggtagggtgggagtggactcgaacgcgtgtacaatggtctacaactaaatatacacaagtaagttgacgagggtcagactacactagttacgtaacgggaccacgtacgtccgacgaacgaacgacgacctanagtggacgactaggacgcagctagatagtctaggacgacgacgtgtagtattaatcgttgtgacgtagtagttacgcgtaggtggtaacgtacgttaccttaacgtacttactactaccgttagagttcggtacgtcggtaacggg

SEQ ID NO: 62507 - DNA, 596 bp, Homo sapiens
  misc_feature: GYAE6OF02FPOUQ.18.70.G04.1.454.CMB.1.raw
  modified_base (180)..(180): a, c, t, g, unknown or other
  misc_feature (180)..(180): n is a, c, g, or t
  modified_base (211)..(211): a, c, t, g, unknown or other
  misc_feature (211)..(211): n is a, c, g, or t
  modified_base (225)..(225): a, c, t, g, unknown or other
  misc_feature (225)..(225): n is a, c, g, or t
  modified_base (232)..(232): a, c, t, g, unknown or other
  misc_feature (232)..(232): n is a, c, g, or t
  modified_base (278)..(278): a, c, t, g, unknown or other
  misc_feature (278)..(278): n is a, c, g, or t
  modified_base (317)..(317): a, c, t, g, unknown or other
  misc_feature (317)..(317): n is a, c, g, or t
  modified_base (330)..(330): a, c, t, g, unknown or other
  misc_feature (330)..(330): n is a, c, g, or t
tcagtacgagtatgcacgaccggtgctcgatttagtgtagtgtgaagggaaaggggtacccgaacaaccacaatccctcctgagaagccccagagcacaactccttaaccatggactggacctggaggatcctcttttggtggcagcagcacagtgcccatcccaggtccagcttagtgntagtctggggctgaggtgaagagctgggctnagtgaggtttctgnagcttcnggatactcttcactagttttcatccattggcttgcgcaggccccgnaaagctgagtggtggatggatcacgctgcaattggtctnacgaaatatcaanagtaagttacgcagggtcaggagtcacagttaacgtaggacacagtccgagaacgaaacaggactacagttaggaagtacgtaggacgacctaggtccgtagtacgtactacgtagtaaacgctaaacggtcgttagttacgtaagtttaacgtcggttagtaccggaaggtacttgggactaggtacggttaacggtgttaacccgtttacttaaccacgtttactaccggttaactacgttacgggtacttccggtaaccgggg

SEQ ID NO: 62508 - DNA, 713 bp, Homo sapiens
  misc_feature: GYAE6OF02JQ1LU.18.70.G04.1.454.CMB.1.raw
  modified_base (188)..(188): a, c, t, g, unknown or other
  misc_feature (188)..(188): n is a, c, g, or t
  modified_base (223)..(223): a, c, t, g, unknown or other
  misc_feature (223)..(223): n is a, c, g, or t
  modified_base (240)..(240): a, c, t, g, unknown or other
  misc_feature (240)..(240): n is a, c, g, or t
  modified_base (599)..(599): a, c, t, g, unknown or other
  misc_feature (599)..(599): n is a, c, g, or t
  modified_base (606)..(606): a, c, t, g, unknown or other
  misc_feature (606)..(606): n is a, c, g, or t
tcagtacgagtatgcacgaccggtgctcgatttagtgtagtgtgaagggaaaggggacccaacaaccacatcctcctgagaacgcccccagagcacaactccttaccatggactggaccgtggaggactccgttctttttgggtggcagcagccacaggtcgacccactcccaggtccagcttgtcgnagtctggggcctgaggtgaagagccgtggggcctntagtggtaaggtttccngcaagtacttcgtggaactcctaccttcacttagttttccaactcctagttcggcgttcgaccgccgaccgggtaccccccggaagtaaaccggtcgttacggagggtaccggggtagggtaacgggtcgtaacgtaccgtaaacggtccgtcgttaacgtaacgtcggtattaccgaaactaaaggttacttacgactacgtagttcgacgtagggacctagactactactagttaccgaggaacacgtagtccgagtaacgaacgtacgccgtaagacgtaggacgtacaggtcgacgtactcgacggtaatacggtactaggtaacgtaccgtacggcgttaacgtattacgtttntacgggngtacggttcgtagttacgagggtactcgggtaaccgggtactttaccgggtacttaaccttagttaacccgtacggttacgtacgccggttagggttcgtaacgggg

SEQ ID NO: 62509 - DNA, 193 bp, Homo sapiens
  misc_feature: GYAE6OF01CHKQY.18.89.I01.1.454.CMB.1.raw
  modified_base (191)..(193): a, c, t, g, unknown or other
  misc_feature (191)..(193): n is a, c, g, or t
tcagtacgagtatgcacgaccggtgctcgatttagtatgctagtaagggaagacaatggagagctctcactgtggtggacgttcggccaagggaccaaggtggaaatcaaacgaactgtggctgcaccatctgtcttcatcttcccgccatctgacatactcgtactgagcgggctggcaaggcgcatagnnn

SEQ ID NO: 62510 - DNA, 209 bp, Homo sapiens
  misc_feature: GYAE6OF02F0HIZ.18.89.I01.1.454.CMB.1.raw
  modified_base (191)..(209): a, c, t, g, unknown or other
  misc_feature (191)..(209): n is a, c, g, or t
tcagtacgagtatgcacgaccggtgctcgatttagtatgctagtaagggaagtacaatggagagctctcactgtggtggacgttcggccaagggaccaaggtggaaatcaaacgaactgtggctgcaccatctgtcttcatctttccgccatctgacatactcgtactgagcggctggcaaggcgcatagnnnnnnnnnnnnnnnnnnn

SEQ ID NO: 62511 - DNA, 424 bp, Homo sapiens
  misc_feature: GYAE6OF01C77SY.13.75.G09.1.454.CMB.1.raw
  modified_base (311)..(311): a, c, t, g, unknown or other
  misc_feature (311)..(311): n is a, c, g, or t
  modified_base (423)..(424): a, c, t, g, unknown or other
  misc_feature (423)..(424): n is a, c, g, or t
tcagtcacgtactacacgaccggtgctcgatttagtatagacatcagggagggcctggagtggattgggtacgtctacgatactgtgacctactacaagccgtccctcaagagtcgcgtcaccatgtcagtggacaggtcgaagaatcaattctccctgaacctgacctctgtgaccgccgcggacacggccgtgtattattgtgccagaggccttatggttgagggacttattctgacttctggttttgatatctggggccagggacaatggtcactgtctcttcagcctccaccaagggcccatcggtnttccccctggcaccctcctccaagagcacctctgggggcacagcggccctgggctgcctggtcaaggactacttcctagtacgtgactgagcgggctggcaaggcgcatagnn

SEQ ID NO: 62512 - DNA, 545 bp, Homo sapiens
  misc_feature: GYAE6OF01CLS7R.13.75.G09.1.454.CMB.1.raw
  modified_base (207)..(207): a, c, t, g, unknown or other
  misc_feature (207)..(207): n is a, c, g, or t
  modified_base (353)..(353): a, c, t, g, unknown or other
  misc_feature (353)..(353): n is a, c, g, or t
tcagtcacgtactacacgaccggtgctcgatttagtatagacatcagggggtgctttctgagagtcatggacctcctgcacaagaacatgaaacacctgtggttcttcctcctcctggtggcagctcccagatgggtcctgtcccaggtgcagctacagcagtggggcgcagggactgttgaagcctttcggagaccctgtcccctnacctgcgctgtctatggtgggtccttcagtggttactactggagctggatccgcagccccagggaagggctggagtggattggggaatcaatcatagtggaagcaccaactacaacccgtccctacaagagtcgagtccaccatancagtacgacacgtccaaagaaccctagttcctccctgaacgctgagctactgtgaccgccgcggacacggctgtgtatactgtgcgagacggaccccgaaagacggaaagtggacgtacgtagttgggaagtactactacgatggacgtcgtagggcaaacgggaccacggtcaccgtctcctcgcgtaccg

SEQ ID NO: 62513 - DNA, 533 bp, Homo sapiens
  misc_feature: GYAE6OF01BEVW9.13.75.G09.1.454.CMB.1.raw
  modified_base (527)..(527): a, c, t, g, unknown or other
  misc_feature (527)..(527): n is a, c, g, or t
tcagtcacgtactacacgaccggtgctcgatttagtatagacatcagggggtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgctgtctatggtggtccttcagtggttactactggagctggatccgccagcccccagggaagggctggagtggattggggaaatcaatcatagtggaagcaccaactacaacccgtccctcaagagtcgagtcaccatatcagtagacacgtccaagaaccagttctccctgaagctgagctctgtcgaccgccgcggacacggctgtgtattactgtgcgagacggccccgaaagaggaaagtggactacgagtttagggaatactactacagtgggacgtcgtaggggcaaagggccacggtcaccgtctcctcngtcccg

SEQ ID NO: 62514 - DNA, 529 bp, Homo sapiens
  misc_feature: GYAE6OF01CQSQQ.13.75.G09.1.454.CMB.1.raw
  modified_base (206)..(206): a, c, t, g, unknown or other
  misc_feature (206)..(206): n is a, c, g, or t
tcagtcacgtactacacgaccggtgctcgatttagtatagacatcagggggtgctttctgagagtcatggacctcctgcacaagaacatgaaacacctgtggttcttcctcctcctggtggcagctcccagatgggtcctgtcccaggtgcagctacagcagtggggcgcaggactgttgaagccctttcggagaccctgtccctnacctgcgctgtctatggtggtccttcagtggttactactggagctggatccgccagccccagggaagggctggagtggattggggaaatcaatcatagtggaagcaccaactacaacccgtccctcaagagtcgagtcaccatatcagtagacacgtccaaagaaccagttctcctgaagctgagctctgtgaccgccgcggacacggctgtgtatactgtgcgagaggacccgaagacggaaagtggactacgtattggaagtactactacgatggacgtgtagggcaaagggaccacggtccaccgtctcctcgacgtccg

SEQ ID NO: 62515 - DNA, 558 bp, Homo sapiens
  misc_feature: GYAE6OF01BIKT6.13.75.G09.1.454.CMB.1.raw
  modified_base (552)..(552): a, c, t, g, unknown or other
  misc_feature (552)..(552): n is a, c, g, or t
tcagtcacgtactacacgaccggtgctcgatttagtatagacatcagggggtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgctgtctatggtggtccttcagtggttactactggagctggatccgccagcccccagggaaggggctggagtggattggggaaatcaatcatagtggaagcaaccaactaccaacccgtccctacaagagtcgagtcaccatatcagtagacacgtaccaagaaccagttctccctgaacgctgagctctgtcgacccgccgcggacgacggctgtgtattactgtgcgaggacggaccccgaaaggaggaaagtcggactaacggtagtttagggaagttacgtactacgagtggacgtcgtggggacgaacgggaccgacggtccaccgtactccctcgngtcccg

SEQ ID NO: 62516 - DNA, 541 bp, Homo sapiens
  misc_feature: GYAE6OF01CM465.13.75.G09.1.454.CMB.1.raw
  modified_base (416)..(416): a, c, t, g, unknown or other
  misc_feature (416)..(416): n is a, c, g, or t
  modified_base (536)..(536): a, c, t, g, unknown or other
  misc_feature (536)..(536): n is a, c, g, or t
tcagtcacgtactacacgaccggtgctcgatttagtatagacatcagggggtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgctgtctatggtgggtccttcagtggttactactggagctggatccgccacgcccccagggaaggggctgggagtggattggggaatcaatcatagtggaagcaccaactacaacccgtccctacaagagtcgagtcaccatatcagtagacacgtccaagaaccagttctccctgaacgctgagctctgtgacccgccgcggacncggctgtgtattacgtgtgcgagacggaccccgaaagacggaaagtggactacgtagttgggaacgtactactacgagtggacgtgtgggacaaagggaccacggtcaccgtctcctcgngtccc

SEQ ID NO: 62517 - DNA, 587 bp, Homo sapiens
  misc_feature: GYAE6OF01CFW23.13.75.G09.1.454.CMB.1.raw
  modified_base (169)..(169): a, c, t, g, unknown or other
  misc_feature (169)..(169): n is a, c, g, or t
tcagtcacgtactacacgaccggtgctcgatttagtatagacatcagggggtgctttctgagagtcatggacctcctgcacaagaacatgaaacacctgtggttcttcctcctcctggtggcagctcccagatgggtcctgtcccaggtgcagctacagcagtggggcncaggactgttgaagccttcggagaccctgtccctcacctgcgctgtctatggtggtccttcagtggttactactggagctggactccgccacgccccgagggaacgggctggagtggagtggggaaatcaatcagtagtggaacgcaaccaactaccaacccgtccctacaagagtcgagtccaaccatactcaagtacgacacgtaccaaagaacctagttacctccctagaacgctagacgtctcgtgtcgacccgccgcggtaacacggctggtagtacttacgtgtcgcgacgacggaccccgaaaggacggaaagtggactaacgtagttaggaactactactacagtacggtacgtaggtacgggacgaaaccgggaccgacggtaccaccggtctaccgcgacgtaccccg

SEQ ID NO: 62518 - DNA, 708 bp, Homo sapiens
  misc_feature: GYAE6OF01C5ZSQ.13.75.G09.1.454.CMB.1.raw
  modified_base (697)..(697): a, c, t, g, unknown or other
  misc_feature (697)..(697): n is a, c, g, or t
tcagtcacgtactacacgaccggtgctcgatttagtatagacatcagggggtgctttctgagagtcatggacctcctgcacaagaacatgaaacacctgtggttcttcctcctcctggtggcagctcccagatgggtcctgtcccaggtgcagctacagcaggtggggcgcaggactgttgaagtccttcggacgaccccttgtcccctcaccctgccgctgtcttagtgggtcggttccttcaggttggtttactacgtggagtcgtggactcccgccaccggcccccgaggggaacgggctggaggtggagttaggggaaatcaaagtcaagtaggtaggaacgaccaacctaaacctaacccgtaacccccgtccctacgaaacggacggtaccgaacgtaccaaacctattactaccgaaggttacgaacctaaccgtaccgaaacgaacccttacgttacccttacccgtagaacgtccgtagacgtctcgtcggtacgacccggccgaccggctaacggtcgtgttagttaacttcgtagtcggacggaaggtacccgggaacccgaaagggaacgggtaaaggtcggaccgttaacggtgtttaggggaaacttaccgtacgacgtaggtacggtaccggtaggtacggggacaaaccgggacctacggtaccgtacccgtacgtccccngcgttaccccg

SEQ ID NO: 62519 - DNA, 690 bp, Homo sapiens
  misc_feature: GYAE6OF01A7VZM.13.75.G09.1.454.CMB.1.raw
  modified_base (169)..(169): a, c, t, g, unknown or other
  misc_feature (169)..(169): n is a, c, g, or t
  modified_base (204)..(204): a, c, t, g, unknown or other
  misc_feature (204)..(204): n is a, c, g, or t
  modified_base (249)..(249): a, c, t, g, unknown or other
  misc_feature (249)..(249): n is a, c, g, or t
tcagtcacgtactacacgaccggtgctcgatttagtatagacatcagggggtgctttctgagagtcatggacctcctgcacaagaacatgaaacacctgtggttcttcctcctcctggtggcagctcccagatgggtcctgtcccaggtgcagctacagcagtggggcncaggactgttgaagccttcggagaccctgtccctnacctgcgctgtctatggtggtccttcagttggttactacgtgganctggatccgccacgcccccagggaacgggctggagtggagttggggaaactcgaatcagtagtggaagcaaccaactaccaaccccgtccctacaagacgtcgagtcaccgatactcagtaacgacaccgtaccgaaacgaacctagttacctcccgtagaagcttagacgaccttcgtgttacggacccgtccggacggaaccgaccggcttaggttgttaactttacgtggtacgacggtaagggaaccgggaccccgtaaaggaacgggaaacgggttcgggtaaccgtaacggttaaggtttacggggaaagttaaccgttaaccgttaacgtaggttacgggaccgttacgggtagggggaacccctaaaaacgggggtcccctaacgggttacccaaccccggtttaccgtaccccttacgaccgttaaccccgg

SEQ ID NO: 62520 - DNA, 926 bp, Homo sapiens
  misc_feature: GYAE6OF01EBA2B.13.75.G09.1.454.CMB.1.raw
tcagtcacgtactacacgaccggtgctcgatttagtatagacatcagggggtgctttctgagagtcatggacctcctgcacaagaacatgaaacacctgtggttcttcctcctcctggtggcagctcccagatgggtcctgtcccaggtgcagctacagcaggtggggcgcaggactgtgaacgccttcggacgaccctgtccctcacctgcgtctgtctagtggtcggtccttcgtaggttcggttactacgtggacgtcgtaggactcccgaccgaccggacccccggaaggggaacggggtcgtagggaggtagggtacggttaggggaaactcgaatacgaagtaggtaggaacgccaaccaactacccaaacccgtccctacgaacggtacgtacgacgtaccaacaatacgtacgtaagtaacgaaccgtaccgtaaccgaaacgtaaaccctacgttaccctaccccgtagtaaacggtcgtacggaacgttcccgtacgtttacggtaaccccgggaccccggtaccccggggaaccggtaaccggtacccgggttaccgtttagggttaaccggtttaaacccgtttaaccggttcgggttaaccggaacccgggtaaaaccggggtacccggggaaaaacccccggtaaaaagggggtaaaacgggtaaaccggggtttaggggtaacccgttaaacggggtttaacgggttttaaaccgggggtaaaaccggtttaaaccttaaaccggtttaaacgggtaaccggtttaaccggggggtaaacccggttacgggggttaaacggggggtaaacccgggaaaaaaccggggtacccccggttaaaccggggttcccccgttaaaccccggtttccccgttaacccgttacccggaaacccggtttaacccccggg

SEQ ID NO: 62521 - DNA, 556 bp, Homo sapiens
  misc_feature: GYAE6OF01BPCBC.13.75.G09.1.454.CMB.1.raw
  modified_base (360)..(360): a, c, t, g, unknown or other
  misc_feature (360)..(360): n is a, c, g, or t
  modified_base (426)..(426): a, c, t, g, unknown or other
  misc_feature (426)..(426): n is a, c, g, or t
tcagtcacgtactacacgaccggtgctcgatttagtatagacatcagggggtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgctgtctatggtggtccttcagtgttactactggagctggatccgccacgcccccgagggaaggggctggagtggagttggggaaatcaatcagtaggtggaaagcaaccaactaccaaccccgtccctacaagagtcgagtcaccatancagtagacacgtcaagaaccagttcctccctagaacgctgacgctcgtgtcgacccgccgcggacncggctgtgtatactgtgcgagacggaccccgaaaggaggaagtggctaacgagttacggaagtacgtactacagtggaccgttgaggggacgaaagggccaacggtccgaccgtcctcctcgagtacccg

SEQ ID NO: 62522 - DNA, 565 bp, Homo sapiens
  misc_feature: GYAE6OF01CXIDX.13.75.G09.1.454.CMB.1.raw
  modified_base (169)..(169): a, c, t, g, unknown or other
  misc_feature (169)..(169): n is a, c, g, or t
  modified_base (344)..(344): a, c, t, g, unknown or other
  misc_feature (344)..(344): n is a, c, g, or t
  modified_base (389)..(389): a, c, t, g, unknown or other
  misc_feature (389)..(389): n is a, c, g, or t
  modified_base (402)..(402): a, c, t, g, unknown or other
  misc_feature (402)..(402): n is a, c, g, or t
  modified_base (557)..(557): a, c, t, g, unknown or other
  misc_feature (557)..(557): n is a, c, g, or t
tcagtcacgtactacacgaccggtgctcgatttagtatagacatcagggggtgctttctgagagtcatggacctcctgcacaagaacatgaaacacctgtggttcttcctcctcctggtggcagctcccagatgggtcctgtcccaggtgcagctacagcagtggggcncaggactgttgaagccttcggagaccctgtccctcacctgcgctgtctatggtggtccttcagtggttactacgtggagctggactccgccacgcccccgagggaaaggggctggagtggaagttggggaaatcaaatcatagtggaagacaccgaactaccaacccgtccctanaacgagtcgagtcacatatcagtagacacgtcaaagaccagttcncctgaagctaganctctgtagaccgccgacggtacacggctgtcgtatactgtgcgagacggacccgaagaacggaaagtggactagacgttagggaagtactactacgatcggtaacgtcgtagggactaaaacgggaccaacggttcgaaacccggttctaccctncggtaccc

SEQ ID NO: 62523 - DNA, 812 bp, Homo sapiens
  misc_feature: GYAE6OF01D7KGI.13.75.G09.1.454.CMB.1.raw
  modified_base (167)..(167): a, c, t, g, unknown or other
  misc_feature (167)..(167): n is a, c, g, or t
tcagtcacgtactacacgaccggtgctcgatttagtatagacatcagggggtgctttctgagagtcatggacctcctgcacaagaacatgaaacacctgtggttcttcctcctcctggtgcagctcccagatgggtcctgtccaggtgcagctacagcgagtgggcncaggacttgttgaacgtccgttacggacgtaccccttcgtcccctctaccgtgcgtcttgtcttagtgggttcggttccttcgagttcggtttactacgtggacgtcgtcggacgtcccgacccgacccggaccccggaacggggaacggggtcggtagggtaggtaggtacggttaacgggtaaacgtacgtaacgtacgtaagtacggtacggaacgaccgaacccgtaaaccgtaacccgtaaccccgtacccgtaacgtaacggtacggtaccgtaccgtaccgtaacctaacgttaacgtacgtaacgtaacgaaccgtaaccgtaaccgaaaccgtaaccgtaccgttaccctttttacccgacgtaacgtacgtacgtacgtaccgttcgtacggtaccggacccggtaccgggaccggtaccggtaccggtacgttacggttacgttacgttacgtacggtacggacggtaacggaaccggaaaccggtaaacggtaacgggtaacggtacggtacgttaacggttaacggttacggtaacgttaacgtaacgtacgtacggtacggtacggtacgggtacgggaacggaacggtaccggtacggtaccgtaccgttaccgtacctcgtccgtaccg

SEQ ID NO: 62524 - DNA, 681 bp, Homo sapiens
  misc_feature: GYAE6OF01AP4VP.13.75.G09.1.454.CMB.1.raw
  modified_base (169)..(169): a, c, t, g, unknown or other
  misc_feature (169)..(169): n is a, c, g, or t
  modified_base (253)..(253): a, c, t, g, unknown or other
  misc_feature (253)..(253): n is a, c, g, or t
  modified_base (351)..(351): a, c, t, g, unknown or other
  misc_feature (351)..(351): n is a, c, g, or t
tcagtcacgtactacacgaccggtgctcgatttagtatagacatcagggggtgctttctgagagtcatggacctcctgcacaagaacatgaaacacctgtggttcttcctcctcctggtggcagctcccagatgggtcctgtcccaggtgcagctacagcagtggggcncaggactgttgaagtccttcgggacgacccctgtcccctcacctgcgctgtctagtggtggtcctcagtggttacacgtggacncgtggatcccgccacgccccgagggacgggctggagtggagttagggaaatcgaatcgaagtaggtacggaccaccgtactacgacgtccccgtaccncgtaatacgtcgtacgtccacctagtcgacaggtacggacgtacgacccgtaaagaaccctacgttccacccgtgacgtcctcggtacccttcgtacgtacggtaccccgcccgggtaccgtaccgtaccggaccccttagttacccttcggtcgttacggccggtagaagtacgtcggaagtacgttacggtcgtccgaacggttccggccggggtaccttaaccgtttttggaacgttacgtccgggtacggggaaccttaacggggtcggttacgtcgggttacttcgttccgttccgttaccgtacggtcccgtacccgtaccccg

SEQ ID NO: 62525 - DNA, 599 bp, Homo sapiens
  misc_feature: GYAE6OF01DKPD2.13.75.G09.1.454.CMB.1.raw
  modified_base (233)..(233): a, c, t, g, unknown or other
  misc_feature (233)..(233): n is a, c, g, or t
  modified_base (250)..(250): a, c, t, g, unknown or other
  misc_feature (250)..(250): n is a, c, g, or t
  modified_base (555)..(555): a, c, t, g, unknown or other
  misc_feature (555)..(555): n is a, c, g, or t
  modified_base (592)..(592): a, c, t, g, unknown or other
  misc_feature (592)..(592): n is a, c, g, or t
tcagtcacgtactacacgaccggtgctcgatttagtatagacatcagggggtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggacgaccctgtccctcacctgcgctgtctagtggtcggtccttnagtggttactactgganctggactccgccacgccccgagggaacgggctggagtggagttaggggaaatcaatcaagtaggtaggaagtacaaccaaactaaccaaaccccgtccctaacgaagacgtcgagtcaccatatacagtaagacaacgtacaaacgacctagttcctaccgtagaaagtcgtagagtctacgttggtacgacccggccgacggaccgacggctgttagtattacgtgtcgacgacggacggaacccgaaaggaacggaagtgacgtacgtagttaggaataactaactacgagtggtacgtacgngggtacgaaacggaccgacggtacaccgtctacctgngtacccg

SEQ ID NO: 62526 - DNA, 809 bp, Homo sapiens
  misc_feature: GYAE6OF01B9GBR.13.75.G09.1.454.CMB.1.raw
  modified_base (170)..(170): a, c, t, g, unknown or other
  misc_feature (170)..(170): n is a, c, g, or t
tcagtcacgtactacacgaccggtgctcgatttagtatagacatcagggggtgctttctgagagtcatggacctcctgcacaagaacatgaaacacctgtggttcttcctcctcctggtggcagctcccagatgggtcctgtcccaggtgcagctacagcaggtggggcncgaggactggttagaagccttcgggagactcctcgtaccctcaccgtgcgctagtctagtggtcggtaccttcgagttcggttactacgtggacgtcgtaggtacgtcccggaccgaccggaccccccggaagggggtaaaccgggggtccgttaggggtaacggttacggggtaacggttttaagggggggaaaacttaccggtaaacgttaaccgtaaggttaacggttaacggggaaccggttaacccgaaacccgtaaacccggtaacccgttaaaacccccggtccccgttaacgaaacggtaacggtaccggtaacggttacctaaaccgtaattaacgtacccgtaaggtaaccgtaaaccgaaccgttacccgaaaacgtaaccgtacgttcccgtaccgtagaacgtccgtacgaacgtcctacgtcgtacggtacccgcggacggacgacggtcgtcgttagtacttacgtacggcgtacgaggaaccgggaaccggaaaggtaacgggaaagtcggaacgttaaccgtaggttacgggaacttacgtacgaacgtgtacgggacgttacggtcgggtaaacgaaccgggacccgttacggaccgtaaccggtcctccggtactaccgg

SEQ ID NO: 62527 - DNA, 592 bp, Homo sapiens
  misc_feature: GYAE6OF01D7H3I.13.75.G09.1.454.CMB.1.raw
  modified_base (462)..(462): a, c, t, g, unknown or other
  misc_feature (462)..(462): n is a, c, g, or t
  modified_base (583)..(583): a, c, t, g, unknown or other
  misc_feature (583)..(583): n is a, c, g, or t
tcagtcacgtactacacgaccggtgctcgatttagtatagacatcagggggtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtcccctcacctgcgctgtctagtggtggtccttcgagttggttactacgtggagctggatccaccacgccccccgagggaacggggcgtggaggtaggagttagggggaaatcaatcaagtaggtaggaagcaaccaactaaccaaccccgtcccctacaagtagtccgagtccacatatcagtacgacacgtaccaagaacctacgttacctaccccgtagaacgtcgtgacgctctgtcgaccgccggcgacacggctggtntatctgtcgcggagacggacccgaaagaggaagtggactagtagttacgggaagtactaagtacagtggacgtcggaggggacgaaaccgggaccacgggtacctacccggtcctcccgtntcggtaccc

SEQ ID NO: 62528 - DNA, 623 bp, Homo sapiens
  misc_feature: GYAE6OF01AB9U6.13.75.G09.1.454.CMB.1.raw
tcagtcacgtactacacgaccggtgctcgatttagtatagacatcagggggtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgctgtctatggtggtccttcagtggttactactggagctggactccgccacgcccccgagggaacgggctggagtggagttggggaaatcaatcataggtggaagcaaccaactaccaacccgtccctacaagcgtcgagtccactatactcagtacgacaccgtaccaaacgaacctacgtttccctacccgtagaacgcgtcgacgtcctcgtgtccgacccggccgcggaaccgacggtcgttgtcgttacttctggtcgacgacgaccggaacccgaaaggacggaaggtcggtacgtacggtagtttacgggaacttacgtacgtagtagtcgggaccggttcggacggggacgtaaaccggggacctacgggtacccgtacccgttccctccgtccgacgtaccccg

SEQ ID NO: 62529 - DNA, 750 bp, Homo sapiens
  misc_feature: GYAE6OF01DU1KJ.13.75.G09.1.454.CMB.1.raw
  modified_base (169)..(169): a, c, t, g, unknown or other
  misc_feature (169)..(169): n is a, c, g, or t
  modified_base (237)..(237): a, c, t, g, unknown or other
  misc_feature (237)..(237): n is a, c, g, or t
  modified_base (253)..(253): a, c, t, g, unknown or other
  misc_feature (253)..(253): n is a, c, g, or t
  modified_base (515)..(515): a, c, t, g, unknown or other
  misc_feature (515)..(515): n is a, c, g, or t
tcagtcacgtactacacgaccggtgctcgatttagtatagacatcagggggtgctttctgagagtcatggacctcctgcacaagaacatgaaacacctgtggttcttcctcctcctggtggcagctcccagatgggtcctgtcccaggtgcagctacagcaggtgggcncaggacttgttgaagccttcggacgtaccctgtccctcacctgcgctgtctagtggttcggtccttanaggttcgttactacgnggagcgtggactccgccgtaccggaccccgaggggagggctaggaggtaggtagttagggaatcgaagtacgagttaggtacggaacgacccaacctaaaccgtacccgtaaccccgtaccgtaacaacggtaacgtccggactaccaacgtaacttactacgaagttaccgaacgtaccgtaccaaacgccgttacgttcccgtacctagaacgtctacgtacgtcctacgtcggtccggacccggccggaccgggtaccncgggttctaggttacgttacgttacggttcggaacggtaccgacgggaacccgggaaccggtaaagggaacgggtaaacggtcgggttaaccggtacggtttaggttaacggggtaaacttacccgttaacgtaacggtacggtaccgggtacggttaccgggtacgggggaaaccgaaaccgggcccgttaaccggtccgtaaccccgttccgtaccctcggacccgttacccg

SEQ ID NO: 62530 - DNA, 802 bp, Homo sapiens
  misc_feature: GYAE6OF01AX8B4.13.75.G09.1.454.CMB.1.raw
  modified_base (171)..(171): a, c, t, g, unknown or other
  misc_feature (171)..(171): n is a, c, g, or t
  modified_base (779)..(779): a, c, t, g, unknown or other
  misc_feature (779)..(779): n is a, c, g, or t
tcagtcacgtactacacgaccggtgctcgatttagtatagacatcagggggtgctttctgagagtcatggacctcctgcacaagaacatgaaacacctgtgttcttcctcctcctggtggcagctcccagatgggtcctgtcccaggtgcagctacagcgaggtcggggcncaggactgttagaacgccttggacgtaccctcgtcccctacaccgtgcgtcttgtctagtgggtcggttccttcgtaggttcggttacctacgtggagtcgtggactcccgcccgaccggacccccgaggggaacgggtcgtggaggtggtagttaggggaaatcaatacgagtaggtaggaacgcctaaccaacctaaccgaaccccgtacctaacgaagtacgtacgacgtaccaaccctaatacgtacgtaagtaaccgaacctaaccggtaaccgaaacgtaaccccgttacgtttcccgttaaccccgtaggaaacggttccgtaacggtccgttaccgttacggtacggtaacccgggacccccggtacccgggacccggtaacccggcggttacccgttaggttaccgtttaacgttacggtacggttacggaccgggtaacggtaacccggggaaaccccgggaaaagggtaaccgggtaagggttaccgggtaaccggttaacggttaacgggtttaacgggtaaaccggttaacgtaccgtaaacgtagggtacggtaccgacgggtacgggaacgtaaacgggcccgtacggtaccncccgtactcctacgtcgtacccg

SEQ ID NO: 62531 - DNA, 847 bp, Homo sapiens
  misc_feature: GYAE6OF01BAAMV.13.75.G09.1.454.CMB.1.raw
  modified_base (148)..(148): a, c, t, g, unknown or other
  misc_feature (148)..(148): n is a, c, g, or t
  modified_base (168)..(168): a, c, t, g, unknown or other
  misc_feature (168)..(168): n is a, c, g, or t
tcagtcacgtactacacgaccggtgctcgatttagtatagacatcagggggtgctttctgagagtcatggacctcctgcacaagaacatgaaacacctgtgttcttcctcctcctggtgcagctcccagatgggtcctgtcccaggtncagctacagcaggtggggcncgaggactgttagaagtccttacggagaccctcgtccctcacctgccgctgtctagtgggtcgggtcttcgagtagttacctaggtggagtcgtggacgtcccgaccgaccggaccccggaaggggaacggggctggggaggttagggtacggtttaggggaaactactaaacgtctaaaggttacgggaaggaacggccctaaacccgaaaccgttaaccctaaaccccggttacccgtaaggaaaaccggaacgtttacggaaccggttaccaacccgtagttaacctacgtaaacggtacggaactaacgaacccggtaaacaaacccgtactttacccgaacccgtaggtaaactccgtaagggcctacgttccgtaccgttacgggaccccggtacggacccgggttaaccgcgtacgtttccggtatttagaaccggttggacggtacggtaacgggaccggttaaaccggggaaaaggtaacggggaacggttaccgggttactaaacccgggggtttaagggttaacgggtaaaaccggttaaccttaaacggtaaaacccggtttgggtaaaaccgggttaccggtagggggggtaccgggtaaaaaccgggacccgggtaaacgtaccccgtacggttacccgttccgacttaccggtaccgttacccg

SEQ ID NO: 62532 - DNA, 955 bp, Homo sapiens
  misc_feature: GYAE6OF01AVFG7.13.75.G09.1.454.CMB.1.raw
  modified_base (206)..(206): a, c, t, g, unknown or other
  misc_feature (206)..(206): n is a, c, g, or t
tcagtcacgtactacacgaccggtgctcgatttagtatagacatcagggggtgctttctgagagtcatggacctcctgcacaagaacatgaaacacctgtggttcttcctcctcctggtggcagctcccagatgggtcctgtcccaggtgcagctacagcagtggggcgcaggactgttgaagccttggacgacccctgtcccctnacctgccgctagtctagtgggtcggttccttgaggttcggtttactacggtggacgtcttagggactcccggacccaccggcccccgaagggggtaacggggccgtagggaggttagggtacggtttagggggaaaataccgaattaccgagttaggtacgggaaagccgaacccaaaccttaccaaaccccggttcccctacgtaaacggacggtacgaaccgttcccaaaccctagttaaccgacgtaaaccggttaacggacccgtaaacccggtaacccctaaaacgggtaaacccgtttaacggtttaccccgttaccccgtaacgggaaacgccgttacgggacgtacccgtttacggttccgtaccgggtaacccccgggcccgggtaccgggtaacccggttaacccgggtccggtttacggtttaaccggttacgttttaacggttccgggttacgggaaccgggaacccggggttaaaccggggaaaccccccggggtaaaaggggaaaccggggttaaaacggtccggggttaaaccgtttaaccggggttaaacgggtttaagggggttaaaacccttaaccgttaaaccggtttaccggtaaaggtacccggggttaccggttaccgggggtaacgggggaacccggttaaaacccgggggtaaccccggtaacccggggttaccccgaccccggtttaccgtaccccccgttcgggttacccgtaaccccccggg

SEQ ID NO: 62533 - DNA, 856 bp, Homo sapiens
  misc_feature: GYAE6OF01C5V23.13.75.G09.1.454.CMB.1.raw
  modified_base (53)..(53): a, c, t, g, unknown or other
  misc_feature (53)..(53): n is a, c, g, or t
  modified_base (100)..(100): a, c, t, g, unknown or other
  misc_feature (100)..(100): n is a, c, g, or t
  modified_base (600)..(600): a, c, t, g, unknown or other
  misc_feature (600)..(600): n is a, c, g, or t
tcagtcacgtactacacgaccggtgctcgatttagtatagacatcagggggtnctttctgagagtcatcggacctcctgcaacaagaacatacgaaaccnccttgtcggtttccttccctcctccgttggtcggcacgcctacccgaggtacgttcgggtccctcgtcccgaggtcgcgagtcctacgaggcgtgggcggggacacgtaggacttggttacgaacgtccgttacggaccgtcccgttcgtcccctacaccgtcgccgtcgttcgtacgttcggtcgggttccgttaccttacggtcggtttaaccggtttacctagggtacggacgttcggtacggtaccgccccggaaccgacccggtacccggggaaggggtaacggggtccgtaagggagggttaggtaacgggttaacgggaaacttaccgtaagtagttaaggttacgggtaaacggaaccgtaaccctaaacccgtaaacccaccgtaaccccgtacgaacgtaagtacgacgtactacctaaacgtactaacgacgtaacgtaccgaacctacgtaaccgaactaaccgtccgttaccgcgaagtacggtacncggtactcgtcggtacgacccggacccggtccgaacgggtccaggttacgttaccggttaagttaccgttacggacgggttacgaaccgggttaacgggaaccccgggaaaaggtaaggtacggggtaacgtccggtttaaacgtagggttaacggttaacgaaacgtaacgtacgaacgtaggaccggttacgggtagggaaacggtaaacgcccggaacgttccgacgtcgaaccttccgataccccggtaacg

SEQ ID NO: 62534 - DNA, 725 bp, Homo sapiens
  misc_feature: GYAE6OF01BXQY5.13.75.G09.1.454.CMB.1.raw
  modified_base (169)..(169): a, c, t, g, unknown or other
  misc_feature (169)..(169): n is a, c, g, or t
tcagtcacgtactacacgaccggtgctcgatttagtatagacatcagggggtgctttctgagagtcatggacctcctgcacaagaacatgaaacacctgtggttcttcctcctcctggtgcagctcccagatgggtcctgtcccaggtgcagctacagcaggtggggcncgaggacttggttagaacgtccgttacggacgtacccctgtcccctacgacctgcgtctgttacgtaggtgggttcggttccctttgacggtttacggttaacctcggtggacgtccgtaggacctcccgccgacccggaccccggtaaggggacgggtcgtagggtacggtacggtaggttaagggaaactcgtaaagtcgtaagtaggtaggaaccgaccaacccgtaacctaaccccgtaaccccgtccaacgaacggtacgtacggactaccgactagtactacgatacgacctacgacaacactacgtacctcgagaagtctagctcctcgtacgacgacccgccggacgaccgcggtcgtgtagttactcgtgtacggacggaacgaccggaaccgtaaagggacgggtaacgttacgggtactaacggttaggttacggtaacgtaccgttaacgtataacgggtcggtacggtagggaacggggtaacgaaacccgggttaccgaccggtacccttacccggtacttacctacgtcccggtaaccccg

SEQ ID NO: 62535 - DNA, 856 bp, Homo sapiens
  misc_feature: GYAE6OF01C4JO2.13.75.G09.1.454.CMB.1.raw
  modified_base (153)..(153): a, c, t, g, unknown or other
  misc_feature (153)..(153): n is a, c, g, or t
  modified_base (174)..(174): a, c, t, g, unknown or other
  misc_feature (174)..(174): n is a, c, g, or t
tcagtcacgtactacacgaccggtgctcgatttagtatagacatcagggggtgctttctgagagtcatggacctcctgcacaagaacatgaaacacctgtggttcttcctcctcctggtggcagcctcccagatcgggtcctcgtcccaggtncagctacagcgaggtggggcncaggactggttagaacgtcccgttcggacgtaccccttcgtccccttaccgaccgtcggccgtcgttacggttccgttaaggttcggggttccggggtttacccctttacggtacgggtttaccgggtttaaccttccggtagggacgttccggtaggtacctcccgtaaccgacccggtaccccggaaggggaacggggtcgtaggggtacggtagggtaagttaacggggtaaactacgtaacgtacgtaagtaagggtacggaaacgaccaacccgtaaacctaacccgaaaccccgttcccgtaacgaacggtaccggtacgtaaccgtacaactaagtacgtaacgtaacgtaacgacgtaaccgtaacgtaaacgaccgtacgttcccgtaccgacgtaactccgtaagcgtacttcggtacggtaccgggccccgaaccgggtacggtaaccgacgggttacgttacggttacgttacgtttccggttaggtcgtaacggacgggtaacccggaaccggtaaacgggtaaggacgtacgggtacgtaacggttaggttaacggaacggttaacctacgtaacgtacgggacgttacgggtacggaacggggtaaccggaaaccggtacccggacgttacccgaacccggttccgtaccgtccgtacgtaaccccg

SEQ ID NO: 62536 - DNA, 770 bp, Homo sapiens
  misc_feature: GYAE6OF01B1Z39.13.75.G09.1.454.CMB.1.raw
  modified_base (171)..(171): a, c, t, g, unknown or other
  misc_feature (171)..(171): n is a, c, g, or t
  modified_base (259)..(259): a, c, t, g, unknown or other
  misc_feature (259)..(259): n is a, c, g, or t
  modified_base (751)..(751): a, c, t, g, unknown or other
  misc_feature (751)..(751): n is a, c, g, or t
tcagtcacgtactacacgaccggtgctcgatttagtatagacatcagggggtgctttctgagagtcatggacctcctgcacaagaacatgaaacacctgtggttcttcctcctcctggtggcagctcccagatgggtcctgtcccaggtgcagctacagcgaggtggggcncaggacttgttagaacgtccttcggacgaccctcgtccctcacctgcgtctgtctagtggtcggttccttcgagttcggttactacgnggagcgtggactccgccgaccggaccccggaaggggaacgggcgtggggtaggtagggtaggttaaggggtaaactacgaatcgtaaggttagggtaacggaaacggaccctaaacccaaccgttaaccccgaaacccccgttccctaacgtaacggtacgttacggtacgtaccctaacgtaatactacggtaacgacgaacctaccgtaaccaaacggaccttaacggttcctaccgtagacgtacgtacgacgtctcggttacggtcccgaccggacccggtaaccgggaccgtacggttcgttggttacgtactttacggtcggttacggacgggtaccgggaacccgggaacccgggaaaggaacgggtaaacgtcgggtaacgttaaggtacgtttaagggaaaccgttacgtaacctagtacggtacggtaccgggtaggacgggtaaccggaaacgggtccgtacgttcccgaacccgttaccnccgtacgtcccgtacccgg

SEQ ID NO: 62537 - DNA, 678 bp, Homo sapiens
  misc_feature: GYAE6OF01ER1IA.13.75.G09.1.454.CMB.1.raw
  modified_base (591)..(591): a, c, t, g, unknown or other
  misc_feature (591)..(591): n is a, c, g, or t
  modified_base (596)..(596): a, c, t, g, unknown or other
  misc_feature (596)..(596): n is a, c, g, or t
  modified_base (598)..(598): a, c, t, g, unknown or other
  misc_feature (598)..(598): n is a, c, g, or t
  modified_base (605)..(605): a, c, t, g, unknown or other
  misc_feature (605)..(605): n is a, c, g, or t
  modified_base (615)..(615): a, c, t, g, unknown or other
  misc_feature (615)..(615): n is a, c, g, or t
  modified_base (638)..(638): a, c, t, g, unknown or other
  misc_feature (638)..(638): n is a, c, g, or t
  modified_base (660)..(660): a, c, t, g, unknown or other
  misc_feature (660)..(660): n is a, c, g, or t
  modified_base (663)..(663): a, c, t, g, unknown or other
  misc_feature (663)..(663): n is a, c, g, or t
  modified_base (671)..(671): a, c, t, g, unknown or other
  misc_feature (671)..(671): n is a, c, g, or t
  modified_base (673)..(673): a, c, t, g, unknown or other
  misc_feature (673)..(673): n is a, c, g, or t
tcagtcacgtactacacgaccggtgctcgatttagtatagacatcaggggagggcctggagtggattgggtacgtctacgatactgtgacctactacaagccgtccctcaagagtcgcgtcaccatgtcagtgacaggtcgaagaatcaattctccctgaacctgacctctgtgaccgccgcggacaccggccgtgtacttattgtgtcagacggtccttagtcggttaggaggggtctttacgttctcgtactttcgttggttttacgattacgttcggtcggggtaccgtaaggggaactaaggttcggtactacgttcgttccttcgtaccgaccgtaccctaacccgaaccggtaacggtccctaacgtttcccggttcccgttcccccggtacggtcccctaccccgttacccgtaccgtaacggaccgtaccctaccggtcggtacgggcctaaccgacggcccggtccgtcgggcgtacggtccggtacggtacgtaacggttaccttaaccgttccgtaggtacggtacgtcggtacggacggtcggtacgtacgggaacgtaacggcccgtagtaagtacgntacgntnactcganacgttcatcngacgcagtacgtgacgcgcgcgngtacgtacgcacgcgagcgtcngcncgtcacancncgcgc

SEQ ID NO: 62538 - DNA, 538 bp, Homo sapiens
  misc_feature: GYAE6OF02HB435.13.75.G09.1.454.CMB.1.raw
tcagtcacgtactacacgaccggtgctcgatttagtatagacatcagggggtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaaagaaccagttctccctgaagctgagctctgtgaccgccgcggacacggctgtgtattactgtgcgagacggaccccgaaaggaggaaagtggactacgagtttgggaagttactactacatgggacgtcgtggggacaaagggaccacgggtcaccgtctcctcagtccc

SEQ ID NO: 62539 - DNA, 560 bp, Homo sapiens
  misc_feature: GYAE6OF02G03A2.13.75.G09.1.454.CMB.1.raw
tcagtcacgtactacacgaccggtgctcgatttagtatagacatcagggggtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgctgtctatggtggtccttcagtggttactactggagctggatccgccagcccccagggaagggctggagtggattggggaaatcaatcatagtggaagcaccaactacaacccgtccctcaagagtcgagtcaccatatcagtagacacgtccaagaacccagttctccctgaagctgacgctctgtgaccgccgtggacacggctgtgtattactgtgcgagacggccccgaaaggagggtaaagtggactacggtagtttagggaagttacgtactactagtagggaacgttcgtagggggcaaacggggacccacgggtacacccgttcctaccgttcgagtcccg

SEQ ID NO: 62540 - DNA, 527 bp, Homo sapiens
  misc_feature: GYAE6OF02HGL4A.13.75.G09.1.454.CMB.1.raw
tcagtcacgtactacacgaccggtgctcgatttagtatagacatcagggggtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgctgtctatggtggtccttcagtggttactactggagctggatccgccagcccccagggaagggctggagtggattggggaaatcaatcatagtggaagcaccaactacaacccgtccctcaagagtcgagtcaccatatcagtagacacgtcaagaaccagttctccctgaagctgacgctctgtcgaccgccgcggacacggctgtgtattactgtgcgagacggccccgaaagcggaaagtggctacgatttgggaatactatacatggacgtcgtggggacaaagggaccacggtcaccgtctcctcagtccc

SEQ ID NO: 62541 - DNA, 547 bp, Homo sapiens
  misc_feature: GYAE6OF02H2OFD.13.75.G09.1.454.CMB.1.raw
tcagtcacgtactacacgaccggtgctcgatttagtatagacatcagggggtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgctgtctatggtggtccttcgagtggttactactggagctggatccgcagcccccagggaaggggctggagtggattggggaaatcaatcatagtgaagcaccaactacaacccgtcctcaagagtcgagtcaccatatcagtagacacgtaccaagaaccagttctaccctgaacgctagagctcctgtcgaccgccgcgacacggctgtgtattactgtgcgtagcggaccccgaaaggacggaaagtggacttaacgagttagggaagtactactacagtggacgttcgtggggcaaagggaccacgggtccacccgtctacctcgagtacccg

SEQ ID NO: 62542 - DNA, 611 bp, Homo sapiens
  misc_feature: GYAE6OF02I5X39.13.75.G09.1.454.CMB.1.raw
  modified_base (399)..(399): a, c, t, g, unknown or other
  misc_feature (399)..(399): n is a, c, g, or t
tcagtcacgtactacacgaccggtgctcgatttagtatagacatcagggggtgctttctgagagtcatggacctcctgcacaagaacatgaaacacctgtggttcttcctcctcctggtggcagctcccagatgggtcctgtcccaggtgcagctacagcagtgggcgcaggactgttgaagccttcggagaccctgtccctcacctgcgctgtctatggtggtccttcagtggttactacgtggagctggatccgccgacgcccccgagggaacggggctggagtggattggggaaatcaatcagtagtggaagcaccaactacaacccgtccctacaacgagtcgagtcacatatcagtagacacgtcaacgacagtctcctagacgctgactctcngtcgaccgtcgcggacgaccgcgtagttacgtattacgtcggtgtcgaacgacgggtaccccgaaaaggacgggaaagtcggtacgtaaccggtagtttacggggaaaacttacgttaacgtacgaagttaggaccggttacgtacgggggtacaaacggggtacccgaccgggttacgacccgttaccgttaccctacgtaccgttacccg

SEQ ID NO: 62543 - DNA, 751 bp, Homo sapiens
  misc_feature: GYAE6OF02J3D9R.13.75.G09.1.454.CMB.1.raw
  modified_base (169)..(169): a, c, t, g, unknown or other
  misc_feature (169)..(169): n is a, c, g, or t
tcagtcacgtactacacgaccggtgctcgatttagtatagacatcagggggtgctttctgagagtcatggacctcctgcacaagaacatgaaacacctgtggttcttcctcctcctggtggcagctcccagatgggtcctgtcccaggtgcagctacagcaggtgggcncaggactgttgaagtccttggacgaccctgtccctcacctgcgctagtctagtggtcggtccttcgagttcggttactcgtggatctggactccgccacgccccgaggggaacgggtctacggagtggtagtaggggaatcaatcgaagtaggtaggaacgaccaaccctaaacgtacccgaaccccgtcctacgaaacggtacggtacgaacgttaccaaccgtatacgtaccgaagttacgaccgtaccgtaccgaaacgtaacccgtacgttcccgtaccgtagaacgtcgtagacgtcgtacgttcgtaccggacccgtcccggacggtaaccgtacggtccgttaggttacgttacgttacggtggacgtacggaacgggacccggaaacccggaaaggtacgggttaaacggttccggtaacgttaacgggttaacgtttaacggggaaactttaccgtaacgttacgtaaggtccgggtaaccgggttcggtaaccggggaaccggtaaaccgggtcccgttaaccgggttacccacccggttacctccccggttacgtacccgtttaaccccgg

SEQ ID NO: 62544 - DNA, 431 bp, Homo sapiens
  misc_feature: GYAE6OF02GVQFV.13.75.G09.1.454.CMB.1.raw
  modified_base (425)..(431): a, c, t, g, unknown or other
  misc_feature (425)..(431): n is a, c, g, or t
tcagtcacgtactacacgaccggtgctcgatttagtatagacatcaggggagggcctggagtggattgggtacgtctacgatactgtgacctactacaagccgtccctcaagagtcgcgtcaccatgtcagtggacaggtcgaagaatcaattctccctgaaccctgacctctgtgaccgccgcggacacggccgtgtattattgtgccagaggccttatggttgagggacttattctgacttctggttttgatatctggggccaggggacaatggtcactgtctcttcagcctccaccaagggcccatcggtcttccccctggcaccctcctccaagagcacctctgggggcacagcggccctgggctgcctggtcaaggactacttcctagtacgtgactgagcgggctggcaggcgcatagnnnnnnn

SEQ ID NO: 62545 - DNA, 654 bp, Homo sapiens
  misc_feature: GYAE6OF02IBG5X.13.75.G09.1.454.CMB.1.raw
  modified_base (211)..(211): a, c, t, g, unknown or other
  misc_feature (211)..(211): n is a, c, g, or t
tcagtcacgtactacacgaccggtgctcgatttagtatagacatcagggggtgctttctgagagtcatggacctcctgcacaagaacatgaaacacctgtggttcttcctcctcctggtggcagctcccagatgggtcctgtcccaggtgcagctacagcagtgggcgcaggactggttgaagccttcggagaccctgtccctcacctgcnctgtctagtggtcggtaccttgaaggtggttactacgtggagcgtggactccgccacggccccgaggggagggcgtggagtggagttaggggaatcgaatcagtaggtggaagcaaccaactaaccgaacccgtccctacgaaaggacgttacgacgtcaaccgtatactcaagtacgaaccaacgtaccaaagaacctacgttcctacccgtagaacgtctagacgtctcgtgtacgaccgaccggacggaaccgacggtcgtagtagttacgttaacgtgttcgacggacggtacggaccccggtaaaggaacggtaaacggtcggtaacgtacgtaagttagggaacgttacctaacgtacgtaagtacggtaacgttacggtagggaaccgtaaacgggacccacggtaccgacccgtccgtacctacgacgttacccg

SEQ ID NO: 62546 - DNA, 562 bp, Homo sapiens
  misc_feature: GYAE6OF02FKOZF.13.75.G09.1.454.CMB.1.raw
tcagtcacgtactacacgaccggtgctcgatttagtatagacatcagggggtgctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgctgtctatggtgggtcctcagtggttactactggagctggatccgccagccccccagggaaggggctgggagtggattggggaaatcgaatcatagtggaagcaccaactacaacccgtccctacaagagtcgagtcaccatactcagtagacacgtccaaagaacccagttccaccctgaacgctagacgctctgtcgcccgccgcggaccacgggctgtctattacctgtgcgagacggacccgaaaggacggaaagtggactacgtattgggaatacctactacataggaaccgtgtacggggacaaacgggaccgtaacggtcctaccggtcctcccgtcacgtccg

SEQ ID NO: 62547 - DNA, 828 bp, Homo sapiens
  misc_feature: GYAE6OF02JLRNV.13.75.G09.1.454.CMB.1.raw
  modified_base (631)..(631): a, c, t, g, unknown or other
  misc_feature (631)..(631): n is a, c, g, or t
tcagtcacgtactacacgaccggtgctcgatttagtatagacatcaggggtggcgtttctgagagtcatggacctcctgcacaagaacatagaacacctgtggttcttcctcctcctggtggcagctcccagatgggtcctgtcccaggtgcagctacagcagtggggcgcgaggactgttggaacgccgtttcgggacggaccccttcggtccccctcacccgttcggccgcttcgtccttagttgggttcgggtcccttaccgtaggtcgggtttacctacgtgggtactcgtcggtatcccgcccgacggccccccggaggggaacggggcgtcgggacggtagggtaggttaggggggaaacttcgaaacgtcgtaagttacggtagggaacgacccaaccgtaaaccgtaccgtaaaccccgttacccccgtaaccgaaaggtccggtaaccggagttaccccgaaaccctaagttaacttacccgaaggtttacggaaaccctaccggttaaccgaaacgtaacccgtacgtttaccctaccccgttacgaacgtccgtagacgtcctacgtacgtggacccggcgccggaaccgcggccgttacggttcggttacgtttaacgngttcgggaccgtacgggaaccgggtacccgggtaaagacggggaaacgggtaccggaccggttaacggtaaggttaacgggtaattaaccggtaacggtactacggttcgggaaccggttagggtcggggaaccggtaaacgggacccggtaacggttaccggacccttaccgggtaccctaccgtacggttacccg

SEQ ID NO: 62548 - DNA, 725 bp, Homo sapiens
  misc_feature: GYAE6OF02IG5SE.13.75.G09.1.454.CMB.1.raw
tcagtcacgtactacacgaccggtgctcgatttagtatagacatcagggggtgctttctgagagtcatggacctcctgcacaagaacatgaaacacctgtggttcttcctcctcctggtggcagctcccagatgggtcctgtcccaggtgcagctacagcagtggggcgcaggactgttgaagccttggagaccctgtccctcacctgcgctgtctatggtggtccttcagttggttactactggagcttggatccgccacgcccccgaggggaacggggctagggacgtagggtagttgggggaaatcaagtcagttaaggtggaagtccaaccgaacctaccgtaaccccgtccctacgaacgtacggtaccgaacgttaccacctaagttactacaagtacgaaccacggtaccaaacgtaacctacgttcctacccgtaggaacgtcgtacgacgtaccttcgtacggttacggacccggcccggtacggaaccgtacggtccgtagttcgttagttaccgtaggtcgacggtaacggtaccgggtaccccggtaaaaggtacgggtaaacggtccgggtaacgtaaacggttaggttttaacggggaaaccgtttaaccgtaacgtacgtacggttacgggtaacggttcggtacggggaacggtaaacgggaacccgtacgggtaccttacccggtccgtacctaccggtacttacccg

SEQ ID NO: 62549 - DNA, 668 bp, Homo sapiens
  misc_feature: GYAE6OF02JCN32.13.75.G09.1.454.CMB.1.raw
  modified_base (191)..(191): a, c, t, g, unknown or other
  misc_feature (191)..(191): n is a, c, g, or t
  modified_base (233)..(233): a, c, t, g, unknown or other
  misc_feature (233)..(233): n is a, c, g, or t
  modified_base (459)..(459): a, c, t, g, unknown or other
  misc_feature (459)..(459): n is a, c, g, or t
  modified_base (661)..(661): a, c, t, g, unknown or other
  misc_feature (661)..(661): n is a, c, g, or t
tcagtcacgtactacacgaccggtgctcgatttagtatagacatcagggggtgctttctgagagtcatggacctcctgcacaagaacatgaaacacctgtggttcttcctcctcctggtggcagctcccagatgggtcctgtcccaggtgcagctacagcagtgggcgcaggactgttgaagccttcgganaccctgtccctcacctgcgctgtctatgggtcggtccctttnagttcggttactacgtggagtcgtggactccggccagccccccgaggggaacggggctgggacggtggtagttacggggaaattcgaagtccgagttacggtaggaacggacaaccgtaaaccttaccaaccccgtccccttacgaaacggtacgtacggaagtccaccatactcgaacgtacgaccacgtaccaaacgaacctagttacctacccgtgaacgtcncgacgtacttcgtggtcgacccggcccggtacgggaccgacgggtcctggttcgtttaattccgttaggtcggacgtaccggaacggtaccccggaaagggtaagggtaacgtcgggactaacggttacgttagggaacttacgttaacacgtagtcggaacttcggacggacgaaggtaccgacgtcgacccgtctacgcncgtaccg

SEQ ID NO: 62550 - DNA, 544 bp, Homo sapiens
  misc_feature: GYAE6OF02HGWEN.13.75.G09.1.454.CMB.1.raw
  modified_base (248)..(248): a, c, t, g, unknown or other
  misc_feature (248)..(248): n is a, c, g, or t
  modified_base (505)..(505): a, c, t, g, unknown or other
  misc_feature (505)..(505): n is a, c, g, or t
  modified_base (538)..(538): a, c, t, g, unknown or other
  misc_feature (538)..(538): n is a, c, g, or t
tcagtcacgtactacacgaccggtgctcgatttagtatagacatcagggggtgctttctgagagtcatggacctcctgcacaagaacatgaaacacctgtggttcttcctcctcctggtggcagctcccagatgggtcctgtcccaggtgcagctacagcagtgggcgcaggactgttgaagccttcggagaccctgtccctcacctgcgctgtctatgggtggtccttcgagtggttactactgganctggatccgccagcccccagggaacgggctggagtggattggggaaatcaatcatagtggaagcaccaactacaacccgtccctcaagagtcgagtcaccatatcagtagacacgtccaaagaaccagttctccctgaacgcttgacgtctctgtcgaccgccgcggacacggctgtagtattactgtgcgtacgacgacccgaaagaggaaagtggacgtacgtagttgggaattacgactactagtggacgtcgngggacaagggaccacggtcaccgtctccgtacngtcccg

SEQ ID NO: 62551 - DNA, 706 bp, Homo sapiens
  misc_feature: GYAE6OF02JD86J.13.75.G09.1.454.CMB.1.raw
  modified_base (169)..(169): a, c, t, g, unknown or other
  misc_feature (169)..(169): n is a, c, g, or t
  modified_base (563)..(563): a, c, t, g, unknown or other
  misc_feature (563)..(563): n is a, c, g, or t
  modified_base (657)..(657): a, c, t, g, unknown or other
  misc_feature (657)..(657): n is a, c, g, or t
  modified_base (696)..(696): a, c, t, g, unknown or other
  misc_feature (696)..(696): n is a, c, g, or t
tcagtcacgtactacacgaccggtgctcgatttagtatagacatcagggggtgctttctgagagtcatggacctcctgcacaagaacatgaaacacctgtggttcttcctcctcctggtggcagctcccagatgggtcctgtcccaggtgcagctacagcagtggggcncaggactgttgaagccctttcgggagacccctgtcccctcacctgcgctgtctatggtgggtcccttcgagtggttactacgtgggacgcttggactccgcccacgccccccgaggggaacgggggtctgggacggtgggtacgttagggggaaaattcgaaatctagtaacggtggaagccaaccgaaacctaaccaaaccccggtacccctacgaaaacggtacgtaccgacgtaccaacccgaattaactaccgtaaggtaacgaacgtaaccggtaccaaaacggaaaccctagtttccctacccgttagaaacgtcgtaggaaggtcttccgtagtaccggacccggtcccggacggtacgaccggttcttcggttagttactttaccngtcgcggaagtacgggaccccgaaagaacgggaaagtcggtacttaaccggtagttacggtaaacgttactacgtacagtacggacggttacgnggggaacaacgggaccaccggtacgtacccgtcgtaccncgtagtcccg

SEQ ID NO: 62552 - DNA, 805 bp, Homo sapiens
  misc_feature: GYAE6OF02I3XB6.13.75.G09.1.454.CMB.1.raw
  modified_base (319)..(319): a, c, t, g, unknown or other
  misc_feature (319)..(319): n is a, c, g, or t
tcagtcacgtactacacgaccggtgctcgatttagtatagacatcagggggtgctttctgagagtcatggacctcctgcacaagaacatgaaacacctgtggttcttcctcctcctggtggcagctcccagatgggtcctgtcccaggtgcgagctacagcgaggtggggcgcgaggacttggttgaacgtcccgtttcgggacgacccgttcgtcccctcaccgttgcgctacgtctagttggtcggttccttacgaggttcggttactacgtggacgtcgtggactccgccaccggccccggaggggaacgggtcgnggtacggtaggtacgttaggggaactcgaagtacgtacgtaggtacggacgtaccgaaccgtaactacccgaaccccgttaccgtacgaacggtaacgtaccgacgtaccgaacctagttaacgacgtaacggtaacgaccgtaaccgtaaccgaaacgtaaccgttacgttaccctaccgtaacggtaacgtccgtagaaccgttccttacgtaccggttaccgaacccggtccgtaacccgggaacgtccggtacgttgttaccgtttaacgttccgtcggttacgaccgggtaacggaacccgggtaacccggtaaaggtaaacggggtaaccgtacgggtaccttaaacgggttaggttaacggttaaacgttaccgttaacgtacgtaagttccgggtaacggtacggtacggggtaaaccgtaacggtacccgtacggttacccgaaccggttctaaccggttaccgtacgttaccccgg

SEQ ID NO: 62553 - DNA, 733 bp, Homo sapiens
  misc_feature: GYAE6OF02H0GI3.13.75.G09.1.454.CMB.1.raw
  modified_base (219)..(219): a, c, t, g, unknown or other
  misc_feature (219)..(219): n is a, c, g, or t
tcagtcacgtactacacgaccggtgctcgatttagtatagacatcagggggtgctttctgagagtcatggacctcctgcacaagaacatgaaacacctgtggttcttcctcctcctggtggcagctcccagatgggtcctgtcccaggtgcagctacagcaggtggggcgcgaggactgttagaagtccgtttcggacgaccctcgtcccctaaaaacnccgtgcgtctgtctagtggttggtccttcgaggttcggttactacgtggagcgtggactccgccacgcccccgaggggaacggggctagggacgtggagttagggggaaaatcgtaagtcaaggttaggtagggaacggaccaacccgaaacctaacccgtaaccccgttcccctacgaaacgtacgtaccgagtccaaccatactcaagtacgactacgtaaccaacgaacctacgttcctacccgagacgtctagacgtcgtctcgtacgaccggccggaccggacgaccggtcttacggttcgttacttacgtacggtcgaccggacggacgggtaaccccggaaagggtaaccggaaaggtcggtacgtaacggttacggttaacgggtaacgttaacgttaaccgtagtaacgttcgggtaacggttccgggtacggggaaccggtaaaccgggtaccggaaccgggttacccgtaacccgttaccgtaccgttaccgaccgttacccg

SEQ ID NO: 62554 - DNA, 219 bp, Homo sapiens
  misc_feature: GYAE6OF02I0SZN.13.75.G09.1.454.CMB.1.raw
  modified_base (197)..(197): a, c, t, g, unknown or other
  misc_feature (197)..(197): n is a, c, g, or t
  modified_base (201)..(219): a, c, t, g, unknown or other
  misc_feature (201)..(219): n is a, c, g, or t
tcagtcacgtactacacgaccggtgctcgatttagtatagacatcaggggtccgggagatcatgagggtgtccttgggttttggggggaagaggaagactgacggtccccccaggagttcaggtgctgggcacagcggccctgggctgcctggtacaaggactacttcctagtacgtgactgagcggctggcaggcnatannnnnnnnnnnnnnnnnnn

SEQ ID NO: 62555 - DNA, 807 bp, Homo sapiens
  misc_feature: GYAE6OF02G08BE.13.75.G09.1.454.CMB.1.raw
  modified_base (169)..(169): a, c, t, g, unknown or other
  misc_feature (169)..(169): n is a, c, g, or t
  modified_base (261)..(261): a, c, t, g, unknown or other
  misc_feature (261)..(261): n is a, c, g, or t
  modified_base (265)..(265): a, c, t, g, unknown or other
  misc_feature (265)..(265): n is a, c, g, or t
tcagtcacgtactacacgaccggtgctcgatttagtatagacatcagggggtgctttctgagagtcatggacctcctgcacaagaacatgaaacacctgtggttcttcctcctcctggtggcagctcccagatgggtcctgtcccaggtgcagctacagcaggtgggcncgaggactgttagaacgtccgttcggacgtaccctcgtccctcacctgcgctcgtactagttggtcggtccttcgagttacggttactacgnggancgtgactccgccacggaccccgaaggggaacgggccgtaggaggtggtacggttaggggaaactctaactcgtaacgtaggtaggaacgacctaacccgaacgttaacccgaacccgtaccccgaacgtaaacgggtaacggtcggtaacgtacctaaccgtaactaacgttacgtaaggttaaccaacgtaacccgtaaaccgaaagtaacccgttacgttaccctacccgtaaggtaaccgtcgtaacggacgttccgtacggttacgtaccggaccccggtaccgggtaccggtaccgtaaccgggtcgttacggtttaaccggttaactttacggtcgttacggaccggtaaaccgggaccggtaaaccccgggaaaagggtaccgggtaaacggttcggtaccgttaacgggttaacgggtttacggaaacgttaccgtaaactaccgtaggttacggggtccgtaacgggtacgggaaaccggaacggtaccgtaccggtacgttacccgtacccttccgtaccgccgttaacccg

SEQ ID NO: 62556 - DNA, 653 bp, Homo sapiens
  misc_feature: GYAE6OF02FUDRJ.13.75.G09.1.454.CMB.1.raw
tcagtcacgtactacacgaccggtgctcgatttagtatagacatcagggggtgctttctgagagtcatggacctcctgcacaagaacatgaaacacctgtggttcttcctcctcctggtggcagctcccagatgggtcctgtcccaggtgcagctacagcagtggggcgcaggactgttgaagccgttcggagaccctgtccctcacctgcgctgtctagtggtggtccttcagtcggttactcgtggagctggctccgccacgccccgagggaacgggctggagtggagttggggaaatcgaactcagtaggtggaagccaaccgaactaacccgaacccgtccctaccgaagacggtacgacgtacactaactataccgagtaacgacgaacgtaccgaaacgtaaccgaactttccgtccctacgaacgtctaggactcgtctcgtaccgaccgacccgcggaccgacggtaccgtcgttacggtacgttactgtgacggacggtacggacccggaaagggtacggaaggtcgacgttacgtaagttacgggtaacgtacgtaacctacgacgtaggacggttcggaacggggacggtaacggaaccggtaccggtaccgtacccggtactcccgttacgtccgtacccg

SEQ ID NO: 62557 - DNA, 896 bp, Homo sapiens
  misc_feature: GYAE6OF02F358O.13.75.G09.1.454.CMB.1.raw
  modified_base (168)..(168): a, c, t, g, unknown or other
  misc_feature (168)..(168): n is a, c, g, or t
tcagtcacgtactacacgaccggtgctcgatttagtatagacatcagggggtgctttctgagagtcatggacctcctgcacaagaacatgaaacacctgtggttcttcctcctcctggtggcagctcccagatgggtcctgtcccaggtgcagctacagcagtgggcncaggtactgttgaagccttcggagacccctgtaccctcacccgtgccgtctgttcctagtgggttcgggttcccttcgtaggtacggtttacctacgtgggatccgtggactcccgccgaccgacccccggtaaggggaacggggtcgtagggaggtgggtaaggttacgggggtaaaacttcgtaaacttaccggtaagtacgggtagggaaaccgtaccaacccgtaaacccttaacccgaacccccgttaccccgttaacgaacggtacgtaccggacgttaccaaccctagttacctacgtaacgtaacggtacccgtaaacccggtaaccgaaaacggtaacccttaacggtttacccctaacccgttcgtaaaaccggtcgtaacggttaacgtcccgttagttccgggtacggaacccggcccgggaaccgggtacccgaccgggtcttacgggtttaacgttagtttaccggtggttccgaaccgggtaacgggaaccgggtaaccccggaaagggtaacggggtaaaacggttcgggaaccgttaaaccgggttagtttaacggggtaaacctttaaccggtaaccctttacggaacgggttccgggttaaacggtacgggttaacgggggtaccgggtaaaaccgggtaacccgttacccgggttaaccccgtacccggtttaccccgttacccgtacccgttaccggttacccccgg

SEQ ID NO: 62558 - DNA, 792 bp, Homo sapiens
  misc_feature: GYAE6OF02IIIPN.13.75.G09.1.454.CMB.1.raw
  modified_base (144)..(144): a, c, t, g, unknown or other
  misc_feature (144)..(144): n is a, c, g, or t
  modified_base (202)..(202): a, c, t, g, unknown or other
  misc_feature (202)..(202): n is a, c, g, or t
tcagtcacgtactacacgaccggtgctcgatttagtatagacatcaggggtgctttctgagagtcatggacctcctgcacaagaacatgaaacacctgtggttcttcctcctcctggtggcagctcccagatgggcctgtcccnggtgcagctacagcagtgggcgacaggactgttgaagccttcggagaccctgtccctnacctgcgctgtctatggtggtccttgagtggttacacgtggacgcgtggatccgccacgccccccgagggtaacggggctcggaggtggtaacgttagggggaaattccgaaattccgaagtaggtagggaaacgacgtaaccccgaaacgtaacccgaacccccggttaccctaccgtaaagacggttacggaacgttacccgaaccgaactaataccgaagtacgtaaccacgtaacccaaagtaaacccaagttcctacccgtagaactaccgttagaacgtcgttctacggtaccggtacccggaccgtaccgggaacgtacccgggtcgttaacggttacgttaacgttaaccgttgttaacgtacggaaccgggttaaccgggaccccggaaaaaggtacgggaaaacggtcggaaccgttaacgtaacggtttaagggaaacccgttaaccgaaccgttaacgaacggttacgggtaaccgttacggttaccggggaacccgggtaaacgggtaaccccggttaacgggtacccgtaaccccgtttcccggtaaccccgttaccggtaaccgttaacccccgg

SEQ ID NO: 62559 - DNA, 758 bp, Homo sapiens
  misc_feature: GYAE6OF02GC9LS.13.75.G09.1.454.CMB.1.raw
tcagtcacgtactacacgaccggtgctcgatttagtatagacatcagggggtgctttctgagagtcatggacctcctgcacaagaacatgaaacacctgtggttcttcctcctcctggtggcagctcccagatgggtcctgtcccaggtgcagctacagcaggtggggcgcaggactgttagaagccttacggacgaccctgtccctcaccgtgcgctgtctagtgggtcggtcttcgaggttcgttactgtggacgctggctccgccacgccccgagggacgggcgtggaggtggagttaggggaatcgaagtacgagtaggtaggaacgccgaccaaaccgtaacccgaacccgtaccccgtacaacgtaacggtcggtaacgtaccgaactaagtaactaccgtaaggtaaccgaccaacccggtaacctaaacgacccgttacgttacccgttaccgtagaaaccgtcgtacgacgtacgttctacggtaccggacccggccgggtaccgaaccggtcggtcgttcggttaacgttacgttacgtaggtacggacggaccgacggggtaaacccgaagggtaacggtaaacggtggtaaccgttaagttaacggttacggaaacgttacgtaaccgttacgtcggttacggtaaccgggttaccggacgggggtaaacccggtaaacggggtaccgttacccggggtaacccgtacccggttcccgtacccggttaccggaccgttaaccccgg

SEQ ID NO: 62560 - DNA, 882 bp, Homo sapiens
  misc_feature: GYAE6OF02IWN8K.13.75.G09.1.454.CMB.1.raw
tcagtcacgtactacacgaccggtgctcgatttagtatagacatcagggggtgctttctgagagtcatggacctcctgcacaaagaacatgaaacacctgtggttcttcctcctcctggtggcagctcccagatgggtcctgtcccaggtgcagctacagcagtggggcgcaggactgttagaacgtccgtttcggacgtaccccgtgtcccctctaccctggccgtccttgtcctagttcggggtcggttcccgttgtaggttcggttttaacctacggttaggggacggtcgttcgggacgtccccggacccaccgggtaccccccgggaacgggggtaacggggggtccgtagggggacggggttagggtaagggtttaacggggggtaaaacttacgtaaacgtacgtaaggttaagggtacgggaaacggacctaaacccgtaaaccgtaaccccgttaaacccccggtaccccgttaaccggtaaacggtacggttacccggtaaccggtcctaaccgtaacgttaactaaccgtaacggttaacggaaaccctaaccggtttaacccgaaacgtaacccgtttacggtttacccttaaccccggtcggtaaacgtccgtacggtacggtccttcgtcggtaccggtaccccggccggtaccgggaaccggtaccggtcgttcggttagttacgtttacgtcggtcgtacggacggtaccggaaacccgggaagaccgggaaggtacggtacgttaacggttaggttaacgggtaacttaacgtaaccgtacgtaacggtcgggtccgtacgggtacggggtaacgaaccgggtcccgtacggacccttcccggtcctcccggtacgccggtaccc

SEQ ID NO: 62561 - DNA, 770 bp, Homo sapiens
  misc_feature: GYAE6OF02IF7VO.13.75.G09.1.454.CMB.1.raw
  modified_base (110)..(110): a, c, t, g, unknown or other
  misc_feature (110)..(110): n is a, c, g, or t
  modified_base (376)..(376): a, c, t, g, unknown or other
  misc_feature (376)..(376): n is a, c, g, or t
  modified_base (507)..(507): a, c, t, g, unknown or other
  misc_feature (507)..(507): n is a, c, g, or t
tcagtcacgtactacacgaccggtgctcgatttagtatagacatcagggggtgctttctgagagtcatggacctcctgcacaagaacatgaaacacctgtggttcttccnctcctgtggcagctccagatgggtcctgtccaggtgcagctacagcagtgggcgcaaggactgttggaacgtccgttcggacgccctggtccctcacctgcgtcctggtctagtgggtcggttcccttagaaggtggttaacctggtaggacgtctggactcccggaccacggtccccgaaggggtagggctgggtagtacggaggttaggggaaactcaaagtctaagtacggtaggaacgctaaaccgaacgtaaccgtacccnccgtaacaaaggtacgtacgggtaacctacgtaaccgatacgtacctaaggttaaaccgaaccgtaaccgtaacaaaacggtaacccttaacgtaccttacccggaacgtaaggtccgtaggaactcccgnttacgacggaccgccgggtacgaacgtacggtgtaacgtacggttaacttggaggtacgacgtaaacggggtcccggaaacccgaaaggaacggggtaaacgttcgggtaaccgttaaacgggtacgttaacgggaaacgttaccggttaactacaacgggttacgggtaacgggttaccggttagggggaaccgtaaaaccgggggcccgttaaccggtaacggcccccggttactttaccgggtaaccgacttaccccggg

SEQ ID NO: 62562 - DNA, 888 bp, Homo sapiens
  misc_feature: GYAE6OF02JLPQG.13.75.G09.1.454.CMB.1.raw
tcagtcacgtactacacgaccggtgctcgatttagtatagacatcagggggtgctttctgagagtcatggacctcctgcacaagaacatgaaacacctgtggttcttcctcctcctggtggcagctcccagatgggtcctgtcccaggtgcagctacagcaggtgggcgcaggctgttagacgtccgttaggacgaccctggtcccctcacctgcgtcgtgtcgtagttgggttacggtccttactaggttcggttaacctacgtcgggagtcgtacggtaacgtcccggtacccgaaccggacccccggaagggggaaacgggggtccgtagggtagggtgggttaaacggttacgggggaaacttacgtaacgtacgtaagtaaggtacggaacgtaccgaacccgtaaactaaccccgaaacccgtcccctacgaacgtacggtaccggtaagtacccgaaacgtaactaactacggtaaaggtaaccggtaccctaaacggtacccgtaaaacgaaccttacggttcccgtacccgtaacggtaacgtaccgtacggacgttccttacgttacggttaccggaaccccggtaccgggtaacccggtaaccgggtacccgggttaccgttaggttaaccgtttaacggtttacgttaccgggtacgtaccgggaccgggtaaccgggaaaccccggttaaaggaaaacccggggtaagggttaacggttaccgttaaaccgggttaacgggtttaaacggtaacggttaaccgttaaccggtagtaaaccgggtttaccgggtcgggtacggtaaaccgggggtacgaaaccgggttaaccgaccgggttaccgaccgttacccgtccgttacgaacttaccccg

SEQ ID NO: 62563 - DNA, 682 bp, Homo sapiens
  misc_feature: GYAE6OF02GG7UY.13.75.G09.1.454.CMB.1.raw
  modified_base (169)..(169): a, c, t, g, unknown or other
  misc_feature (169)..(169): n is a, c, g, or t
  modified_base (252)..(252): a, c, t, g, unknown or other
  misc_feature (252)..(252): n is a, c, g, or t
  modified_base (265)..(265): a, c, t, g, unknown or other
  misc_feature (265)..(265): n is a, c, g, or t
tcagtcacgtactacacgaccggtgctcgatttagtatagacatcagggggtgctttctgagagtcatggacctcctgcacaagaacatgaaacacctgtggttcttcctcctcctggtggcagctcccagatgggtcctgtcccaggtgcagctacagcagtggggcncaggactgttgaagcccgtcggagaccctgtccctcacctgcgctgtctagtggtcggtccttcgagttggttactcgtggancgtggatccgccncgccccgagggacgggcgtggagtggtagtagggaatcaatcgagtagtggaacgtacaacctaacgtaccgaacccgtcccacgaacgtacgtaccggactaccgaacgtatacgtactaagtacgaacgtaaccgtaaccaaaggtaaccctacgttacccgttacccgtagaacgtccgtagtaacgtcgttccgtagtcccgaccggtcccggacgtaaccgaccggtctagttacggttacttaacggtcgttacgaccgggaacgaccgggtacccggaaaggtacgggtaaagtcggtaacgtacgttaaggtacgtaaacgtacgtaacgtacgtacggaggtacgtggtacggaaccggttaacggaccgttacggtaccgtaccgttacgtacctcgacttacccgg

SEQ ID NO: 62564 - DNA, 743 bp, Homo sapiens
  misc_feature: GYAE6OF01DFK89.49.2.A02.1.454.CMB.1.raw
tcagagtcgagagacacgaccggtgctcgatttagactcatctacggagggaaagggggaggaacctgctcgagttacggacccagtagggaacctatggaagccccagctcagcttctcttcctcctgcctactcgtggtctcccagataccaccggagtaaattgtgttgactactaagtctccggccacctgtctttgctccaggggacagtgccaccgtctcctgcagggccagtcagagtgttagtagcttcttagcctggtaccaacgacgtaaacctggaccaggctcccaggtctccgtcactctatcgagtcggcagtccgaacgagggccctagtaggaccaattccccgaaggcctagggttccaaggtggacctaggtcggggttactggttacgaacgaaggtaccttacactttacctaccgaaccctaattccgaagacgtaacgcccttaagtacgacccgtagaaacgtacttacgtagtcttaaggttttaacttacgtagttacgaacgtcgtaacgtacggtaagtacccgtaaacggtcggtacccttaccgttaccgtttaaccgtttttccggggaccgggttaaaccggggttaacccgtaaaggggttacgggaaacggtaaaccggttaaccggtaaaaaccgggtaacggtttacggggtaccgggtaccggttaccggacccgtaaccctaacgttcccgttccggtttaacccg

SEQ ID NO: 62565 - DNA, 706 bp, Homo sapiens
  misc_feature: GYAE6OF01DXGM6.49.2.A02.1.454.CMB.1.raw
  modified_base (340)..(340): a, c, t, g, unknown or other
  misc_feature (340)..(340): n is a, c, g, or t
tcagagtcgagagacacgaccggtgctcgatttagactcatctacgagggaaagggggaggaactgctcagttacggacccaggagggaaccagtggaacgccccagctcagcttctcttcctcctgctactctggcctcccagactacccgaccggaagtaaattgttgttgacacagtcctccggccaccctgtctttgtcctccgagggacagtcgccctaccctctcctgcgacgggccagtcaggtagttgttaagtagtctttcgttacgccgttaggtaaccaaacgaacgaaacccgtcggacccgacggtccctcccgaggtcctccctanactctagtgtatcgctactaccaaacgacgggaccctacggtcggacctacgtccccgaagtcccgtaggttcaggtcggacgtagggttcgggtctggtacgaacgtaagtaccttacacctcctacaacctatccacgtccgacgtaccgtaaggacgtacctaaggtaaacgttcttccgtaggtactttaaggttttacttaccgtgtaccgaacgtcgtacgtaccgtaacgacctaacggtccggtacccttcgttaccgttaccggttccggggaacggtaacgggtaaccgaagggtaggaacgtacgtaacgaaacggtacgtggacggtctacggacctacgtatcgttgttaccc

SEQ ID NO: 62566 - DNA, 664 bp, Homo sapiens
  misc_feature: GYAE6OF01C2VLJ.49.2.A02.1.454.CMB.1.raw
  modified_base (312)..(312): a, c, t, g, unknown or other
  misc_feature (312)..(312): n is a, c, g, or t
  modified_base (380)..(380): a, c, t, g, unknown or other
  misc_feature (380)..(380): n is a, c, g, or t
  modified_base (418)..(418): a, c, t, g, unknown or other
  misc_feature (418)..(418): n is a, c, g, or t
  modified_base (425)..(425): a, c, t, g, unknown or other
  misc_feature (425)..(425): n is a, c, g, or t
tcagagtcgagagacacgaccggtgctcgatttagactcatctacgaggggaaagggggaggaactgctcagttaggacccagagggaaccatggaagccccagcctcagcttctcttcctcctgctactctggctcccagactaccaccggagtaaattggtgttgacacagtcctccggccaccctgtctttggcctccgaggggacctagtcgcccaccctctcctgccgaggccagtcagtagtcgttagagcttcgtagcctaggtaccaacgaagtaacctggaccaggcctcccgaggcctcctnactctatgatcgacagtccaagcggacccagtcggctactcccgaagcccgtaggttccagttccggnacgggttggtctggtcgaactagccttacactctaccncttaacncgacgacgtacgaccgtagacgtactacggtaattcgttcgagttacgtttaagtttactccgtagtcctacgtacgtacgtacgtaacgacttaaccggtccgtacctacgttaccgttacggggttacgggaccggtaacggtaacgggtagggtacggtaacgtaaaccgaacgtaaaccggtggttaccggtccggtacctccggtaaaccctacgttcctaccgttctaacccg

SEQ ID NO: 62567 - DNA, 636 bp, Homo sapiens
  misc_feature: GYAE6OF01BDCB1.49.2.A02.1.454.CMB.1.raw
tcagagtcgagagacacgaccggtgctcgatttagactcatctacgagggaaagggggagggaactgctcagttaggacccagagggaaccatggaagccccagctcagcttctcttcctacctgctactctggcctcccagattaccgaccggagaaattgtgtttgacacagtcttccggccaccctgtctttgtctccgaggggacagtgccgaccctctcctggcgagggccagtcagagtgttacgtagctttcttacgccttggtaaccaacgaacgaaaccgtggacccagggccctcccgaggccttcctcatctatgatcgcactacccaacgacgggccagtcggccacgtcccgaggccgtaggttcaggtcggcgtggtgggtcgtgtagacgagtaccttacgctcctacacctagtccgagccaacgccgtaagccgtaccgtagaaacgttacttcgttacgacgttacgttttaattacgtcgttacacggtcaacggtacgtagaactaacgtcgtacctctacgtaccgttaccgggacgggaacggccgtaagggtacgaggtacctagaaacggtcgtagggtacgtcgtaggaccgaccgtgttccgtggttacc

SEQ ID NO: 62568 - DNA, 835 bp, Homo sapiens
  misc_feature: GYAE6OF01A3W6B.49.2.A02.1.454.CMB.1.raw
tcagagtcgagagacacgaccggtgctcgatttagactcatctacgagggaaagggggaggaactgctcagttaggacccagagggaaccaatggaagccccagctcagcttctcttcctcctgctactctggcctcccagactaccgaccggagaaattgtgttgacacagtcctccggccaccctgtctttgtctccgaggggacaggtcgcccgaccctcgtccgtggaccgaggggcccaggtccgaggtagttggttaaggtacgtcctttcgttacgccgttacgggttaaccaaacgtaacgtaaaacccgtcggtacccctaacgggtcccttaccccgaagggtcccttacccgtaccgtacttccctaagtcggtaacgtcggacctaaccgtacccgaaacggtaccggggaccctaacggtcgggacctacgtaccccggaacgtacccgtagggttaccagggttcggaccgtagggttcgggttcttcggttacgaaccgtaccggttaccttaccgtaaccttaccctaccgaaccctataccgaacgaccgtaccgtaccgtaacgtacgtaccctaaggtaaacgttcttacgtcgttacgttaacgttttactaccggtagtccgtaagtaccgtaacggtacgttaaccggactacccggttcggtacccttacgttaccgtaccgggttcgggaccgggtaaccgggtaaccgtacggggtaaccgaacggtaacgtaacccggtaaacgggtaccggtacgtacggtacccgttacggaccctttaacgtccgtttcggttccgtttaccccgg

SEQ ID NO: 62569 - DNA, 756 bp, Homo sapiens
  misc_feature: GYAE6OF01D6UMF.49.2.A02.1.454.CMB.1.raw
  modified_base (242)..(242): a, c, t, g, unknown or other
  misc_feature (242)..(242): n is a, c, g, or t
tcagagtcgagagacacgaccggtgctcgatttagactcatctacgaggggaaagggggaggaactgctcagttaggacccagacgggaaccatggaagccccagctcagcttctcttcctcctgctactctggcctcccagactaccgacggagtaattgtgttgtactactagtcgtcccggacctacccgttgttctttcgtcctccggagggactagtcgccctacctctcgtggcgnggccagtcgaagtgttgtagtagtcttactacgtcctacggtaaccaacgaacgtaaccgtcggaccgacggtccctacccgaggtcccttaccgtactacgttacttacgtaggtacttacggactaaccgtaacccgaaaccggccggggtacccctacggtccggacctacccgtacccggaggtacccggttagggttacgaccgggttcggacgttaggttcgggttaccgtgtaaccgtaacgttacgtaccttactacctacgtacctactagtaccgactaccgacgtaccgtacggacgtaacgttagaacttcgttaccgtactagtttaactttacgtaccgcgttacagtaccgtaggtacctacgacgtaacgccgttacccttacgtaccggttaccggtacgggaacggtaccgggtaaagtacgggaagtaacgtaccgtaaacgaacggttcgtaggaccgtaccgtacgaccttatcggtttaatcccttacccgg

SEQ ID NO: 62570 - DNA, 844 bp, Homo sapiens
  misc_feature: GYAE6OF01CNWPK.49.2.A02.1.454.CMB.1.raw
  modified_base (826)..(826): a, c, t, g, unknown or other
  misc_feature (826)..(826): n is a, c, g, or t
tcagagtcgagagacacgaccggtgctcgatttagactcatctacgaggggaaagggggaggaactgctcagttaggacccagagggaaccatggaagccccagctcagcttctcttcctcctgctactctggcctcccagactacccacggaagaaattgtgttgacacagtcctccggccaccctgttctttgtctccgagggacagtcgccctaccctctccgtgcgacgggccagtcagtagttgttagtacgtctttacttacggccgttacggtaaccaaacgaacggtaaacccgtgggacccgagggtccctacccggacggtccctaccctactaacttacctagtcgtaacttccggacctaaccgttacccgaaaaccggaccgggtaccctaaccggtcggaccctaaccgtcccccgaaacggtcccgttaagggtttaccgagggtccggtcgtaggggttcgggttcgtaggtacggtaacctacggtaccttaccgtacccgttacctaacctaacccgtacgtcaaccgggtacctacggtaccccgtagggtaaccgtccgttaaacggtaaggttactttaccgtagttacgttttaacgttttaacgttccgtagttaccggacgttaccgtaacgggtccgtaaacgaccggttaaccgtcccgtttaccttccgttaccggttacccgggtttacgggggaacccgggtaaacgggttaaccgggaggggttacgaaacggttaaacccggtaacggaaaaccggttcggttcgggaacttccggtaccgacctaaccggtttntccggtttacgttacccc

SEQ ID NO: 62571 - DNA, 853 bp, Homo sapiens
  misc_feature: GYAE6OF01ETI59.49.2.A02.1.454.CMB.1.raw
tcagagtcgagagacacgaccggtgctcgatttagactcatctactagggtaagggggaggaactgctcagttaggacccagagggaaccatggaagccccagctcagcttctcttcctcctgctactctggctcccagataccaccggagaaattgtgttgacacagtctccgcacctgtcttgtctccagggacgagtgccaccctcctcctcgcacgggccgacgtcgacggagttgtttaaggtacgtctttacgttacgtccgtacggtaaccaaacgtaacggaaaccgtcggaccgacgtcccgacccgtacggtcccttacctactacgttactagtagtacgtacgtaccaaccgttaccggaaaccgtacgggtaccccaccggttaccggcccgttaacgtccccggaacgtccggtaacgggttaccggtagggttcggacggtaacgggtcgggttacttacggtacgtaactaccggtaaccttaccaccgtcccgtaacaccccgttaagtacccgacgtaacgacggtttaccttaaccgggacgtttaaccctttaaacgggtaaacgtttccgtacgtttaccggtaaccgttttaacggtttttcccgacggttccgggtaaccgtacggttacccgttacggggaccgggttaaccgaaccgggtttaaccggtcgggttcccttaaccgggtaaccgtaaccgggtttcgggggaacggtaccggaaccgtttacggggaaccttaggttacccgaaacggtttaaacccgcgttttccggtacccgtaccgttcccaacgttaaccttaccttccgttaagggtttacccc

SEQ ID NO: 62572 - DNA, 792 bp, Homo sapiens
  misc_feature: GYAE6OF01AIBNV.49.2.A02.1.454.CMB.1.raw
tcagagtcgagagacacgaccggtgctcgatttagactcatctacgtaggggaaaggggaggaactgctcagttaggacccaggagggtaacctatggtaacgcccccagctcagccttctaccttccctcctgccttacctcctggtcctccctagactacccgaccggtacgttaattgtgttagactactagtccgtcccggccctaccctgttctttgctccgagggactggtcgcccaccctcgtccgagccgtcgggccaggtcgacggtaggttgttacggtagtccgtttcgttacgtcccgttacggtaacccctaacgacgaaacccggttcggccgacggcctcccgaggtcctcctacgtctcgtagtgactggcctaccgtccgaaacggcgggcccacgtcgggacacccgtacccgtagtacccgtttgggttaccgaggtcggacgttaggggttcgtcgtagtaccgtagaaccggttcccttaccggtacccttcctaacccctactccgttacgacgacgttacccgtacgtaacgtaccgtacccgtaataaccgtttgttaccgtacttacgttttaacgtttaagtccgttacgacgttacggaccgttacgggttccgaacgttccgtaacccggttcggttaccttccgttacggtttaccgggtccgggtaacggtcgggaaccggtttaaggaccgaggttaaccgacgttaaacggtcggttaggccgacgtacacccgttagtcccgttacgttctacccccgg

SEQ ID NO: 62573 - DNA, 696 bp, Homo sapiens
  misc_feature: GYAE6OF01BXO65.49.2.A02.1.454.CMB.1.raw
  modified_base (686)..(686): a, c, t, g, unknown or other
  misc_feature (686)..(686): n is a, c, g, or t
tcagagtcgagagacacgaccggtgctcgatttagactcatctacgaggggaaagggggaggaactgctcagttaggacccagagggaaccatggaagccccagctcagcttctcttcctcctgctactctggctcccagataccaccggagtaaattgtgttgacacagtctccggccaccctgtctttgtctccgaggggacagtcgcccaccctctcctgcgagggccagtcagtgtgttagtagctttcgttagcctaggtaaccaacacgaaacctggccagggtcctcccgaggcctcctcacttctatgatgctactccaacgacgggccatcggcactcccgagtccgtaggttcaggtcggacgtagggttcgggtacgtcggtgaaccgtacggtacctttacccgaacctttccctacctaaccctaagttcccgaaggtaccctaaccggtacccgttaagggaccgttaacccgttaaggtaaacgttctttacgtaccggttaacgtttagtttttaacgttactacggttacacggtacgtacggtacgttaaccgaccgtaaccggttcggtacccttaccgttccgttacggtttacccggggaacggtacgggtaaaccgtaggggtacgtagaactacggaaacggtcgtggtcgcgtcgactaacnttctgttacc

SEQ ID NO: 62574 - DNA, 970 bp, Homo sapiens
  misc_feature: GYAE6OF01D3430.49.2.A02.1.454.CMB.1.raw
tcagagtcgagagacacgaccggtgctcgatttagactcatctacgagggaaagggggaggaactgctcagttaggacccagagggaaccatggaacgcccagctcagcttctcttcctctgctactctggcctaccagactaccgaccggaagtaattgtgttcgacacgtacgtccgtcccggaccctacccgttgttcgtttcgtaccgttaccggaacggggtactacgtccgtaccctaccccttcgtccgtacgacgacgggtccaacggtcgaaggtaggtttgttacgtacgttccgtttacgttacgtccgttaacggtaaccaaaacgaacgtaaacccggtcggaaccgaccggtcccgtcccgacgtacctcctactactacgtatacgtactacgtctaaccgtaccgaaacggccggtaccgtaacggtcggtacctaaccgtacccgtaacggtacccggtttaaacggttcggtaacgggtcgggtaaccggttaggggttccgggtgttaacggtaccggtaacgttaccgttacctaccttaccgtccgtaaccctaacccgtcgttaaccgacgtaaccggttacccggtaacccgttaaacggaccgttaaaccgggttaacgttaacgttaaccgtttacggtaacgttttaaccgttttaaaccgggtttttacctaacggtttaacgtaaccgtacggttaaaccgtcgggtaaacccggttaacccgtaaccggttaacggttccccgttaccgtttacccgtttaacccggggttacccggggttaccggggtaaaccgggtaaaccggggtaaccgggtaacgggtaaccgttaaacgggtaaacccttaaaggggtaaaacccggttgggttacccgggtagtaacccggacccggtttaaacccgtacccgtttcgtttaaccgggttaccctttaaccggg

SEQ ID NO: 62575 - DNA, 725 bp, Homo sapiens
  misc_feature: GYAE6OF01CTFCE.49.2.A02.1.454.CMB.1.raw
  modified_base (349)..(349): a, c, t, g, unknown or other
  misc_feature (349)..(349): n is a, c, g, or t
  modified_base (430)..(430): a, c, t, g, unknown or other
  misc_feature (430)..(430): n is a, c, g, or t
  modified_base (499)..(499): a, c, t, g, unknown or other
  misc_feature (499)..(499): n is a, c, g, or t
  modified_base (560)..(560): a, c, t, g, unknown or other
  misc_feature (560)..(560): n is a, c, g, or t
  modified_base (655)..(655): a, c, t, g, unknown or other
  misc_feature (655)..(655): n is a, c, g, or t
tcagagtcgagagacacgaccggtgctcgatttagactcatctacgaggggaaagggggaggaactgctcagttaggacccaggagggaaccatggaacgcccagctcagcttctccttcctcctgctactcgtggcctaccagactaccgacggagtaattgtgtagacacgagtccgtccggccctaccgttgttcttcgtctaccggagggacctggtccgccctacctctccgtggaccgacgggaccagtcaggtagttagttagtacgtctttactacggaccgttacggaaccaaacgtacggtaaccgtcggaccagggtccctacgacgtcctccgttanacttcgtatacgtatcgaccgtactacccgaaggtaccggacctacgtccggactaccgacccgaacgtcggtaacgggtnacgggtcggtacggttaggcggttacagtacccgaggtacctttaccgacttaccctgtccaacggtanaccagacgtacacgaagcctacgagtacttcggtactaggtatttaaccgttagtcgtacncgtacgtacgaacgttgaacccgtacgttacggttaccctcgttacccgttacggtacgttacggggaaccggtacgggtaaaggacggggtaanaacgggtaaccgtacgtaacgggtaccgtggtacggactcgggtacctacggttactcgttacggttacc

SEQ ID NO: 62576 - DNA, 774 bp, Homo sapiens
  misc_feature: GYAE6OF01CHD0Y.49.2.A02.1.454.CMB.1.raw
tcagagtcgagagacacgaccggtgctcgatttagactcatctacgaggggaaagggggaggaactgctcagttaggacccagagggaaccatggaacgccccagctcagccttctcttcctcctgctactctggcctaccagactaccgaacggaagtaaattggtgttagacacacgtccgtcccggcctacccttgttctttcgtcctccggaggggactagtcgacccctaccctctcctcgcgacgggctacgtgagtagttgttagtacgtctttacgtacgtccgtacggtaacaacgaaccgtaaccgtcggaccgacggcctaccgacggtcctacctacattactagtcatcgactactaccaacggacgacacgtcggacctaccgtacccgacgtaccggaggttacgacgggtcggtcggtaaggggttcgggttactacggttacgaaaccgttacgttaacccttaccctaacccttacccgtaacctaccgaacttcggaacccgtaccgaaccggtacccgtaggtaaccggtaccgttaaaggtaacggttacctttacggtacttaacgtttaccgtttaagtttacccgtggtaccgacgtacggtacggttaacgtacgtaaccgtaccggtaccgttcctaccgttacggttacccgggacgggtacgggacgggtaaaccgtagggtaaggaaccgtacgtaacggaaacggtcgagggtcgactacgtaacgactacgttcgttcgttac

SEQ ID NO: 62577 - DNA, 674 bp, Homo sapiens
  misc_feature: GYAE6OF01DQ8IE.49.2.A02.1.454.CMB.1.raw
  modified_base (364)..(364): a, c, t, g, unknown or other
  misc_feature (364)..(364): n is a, c, g, or t
  modified_base (406)..(406): a, c, t, g, unknown or other
  misc_feature (406)..(406): n is a, c, g, or t
  modified_base (549)..(549): a, c, t, g, unknown or other
  misc_feature (549)..(549): n is a, c, g, or t
  modified_base (558)..(558): a, c, t, g, unknown or other
  misc_feature (558)..(558): n is a, c, g, or t
  modified_base (564)..(564): a, c, t, g, unknown or other
  misc_feature (564)..(564): n is a, c, g, or t
  modified_base (610)..(610): a, c, t, g, unknown or other
  misc_feature (610)..(610): n is a, c, g, or t
  modified_base (632)..(632): a, c, t, g, unknown or other
  misc_feature (632)..(632): n is a, c, g, or t
tcagagtcgagagacacgaccggtgctcgatttagactcatctacgaggggaaagggggaggaactgctcagttaggaccagagggaaccagtggaacgccccagctcagtcttctccttcctcctagccttactctcggcctaccgagtactaacccgacgggaataattggtgttcacactgtcctcccggacctccttgttctttgccgtaccggagggacctaggtcacccctcctctcgtgacgaggacctaggtcaggtgttagtaacgtctcttacgcgtctacgtaacaaacaccggtaacgtcggcctacggaccctccggacgtcctacctgtactactagcgtatcgctaacnccgaacggccgcactcgaccacggcctaggtccaggtttcgnggtacgtacggtgggttggtcaggtacacgttacgtactcgtaccttccaacgtaactacgaccgacgaccgtacgacgtcgaacgttctaaaggacttctacgttaacttacgtttattaaccgtgtaccgtggacttacgngtaacggtnaccgtntccgtcgttactaccggttcgggacggtacgggtaactaaccgggnggttaactaacggtaccgtaanaaggttcgacgtgtacccgcacttacgttcttgtccgtttac

SEQ ID NO: 62578 - DNA, 898 bp, Homo sapiens
  misc_feature: GYAE6OF01A9VVK.49.2.A02.1.454.CMB.1.raw
  modified_base (165)..(165): a, c, t, g, unknown or other
  misc_feature (165)..(165): n is a, c, g, or t
  modified_base (207)..(207): a, c, t, g, unknown or other
  misc_feature (207)..(207): n is a, c, g, or t
tcagagtcgagagacacgaccggtgctcgatttagactcatctacgaggggaaagggggaggaactgctcagttaggacccagagggaaccatggaagccccagctcagcttctcttcctcctgctactctggctccagactaccacggagaattgtagttgacncgtagtctaccggccacctgttctttgtcctcgaggggtacngtcgcctccctctcctggcgagggtccagtcgaggtggttacgttaggtacgtcttttcctaggtccttacgggaaccctaaacgtaaccggtaaaaccgttccgggacccgtacgggtacccaccccggtaccggcctttaccctacgaacttcttagtacggtctaccgtacaccgttacccgaacggaccgggtaccctacggtacgggtaccaccgtaccccgaagttacccggtaacgggttacgtaacgggtacgggaccggttaggggtttacggttacggtacgggtaccgtaacggtaccgggttaaccttaacccggtaccttacctaccgaacccgtagttaccgacgtaaccgtaccgaacctacgggtaaccgtacccggttaagtaaaccgttagttaccggttacgttaaccgtttaagttttaaccgtttaccgtacgttaaccgaacggttaccgtaacgtcgtaaaccggttaacccgtaccggttaccctaccggtttacctacccgggtttaacgggttacccgggggaaccgggggttaacccgggaaacccgggtttggggtaaaccgggtaacggttaaaccgggttaacccggaaaacccggttcgggtaacggtcggttaccgttaaccggaccttaacccgtacgtttcggtttacccgttaccc

SEQ ID NO: 62579 - DNA, 755 bp, Homo sapiens
  misc_feature: GYAE6OF01BCJ3D.49.2.A02.1.454.CMB.1.raw
tcagagtcgagagacacgaccggtgctcgatttagactcatctacgaggggaaagggggaggaactgctcagttaggacccagagggaaccatggaagccccagctcagcttctcttcctcctgctactctggctccagataccaccggagaaattgtgttgacacagtctccggccaccctcgtctttgtctccgaggggaccagtcgccacccgtctcctgcacgggccaggtcacgagttgttaacgtagactttcttacgccttggtaaccaacgagaaaccctggaccaggcctcccgaggcctccgtcattctatcgagtcgcatccgaacgcggccacgtggccactcccgagtccctaggttcacggtggacgaggttgggtacctggtacgactagtaccgtttaccaccgttcctaccgacccgtacgtaccgacggacgtaacggaccctaaggaccgttaccgttaggaaacgttacgtttcgttacggtactttaacggtttttaacgttacgttaccggtaaccggtaccggtacgttaaccgggtaccgggttaaaccggtaccggttaaaccggtaccggttcccgtttaccgttacccgtttacggggtttaccgggacgggtaaccgggtaaccggtaaaggggtacggtaacggtaacccgttaaacggaaacccggttcgttaacggggtccgtaccgtacccgaccctaaccggtacttccgttacgttacccg

SEQ ID NO: 62580 - DNA, 725 bp, Homo sapiens
  misc_feature: GYAE6OF01CHBPP.49.2.A02.1.454.CMB.1.raw
  modified_base (170)..(170): a, c, t, g, unknown or other
  misc_feature (170)..(170): n is a, c, g, or t
  modified_base (173)..(173): a, c, t, g, unknown or other
  misc_feature (173)..(173): n is a, c, g, or t
  modified_base (450)..(450): a, c, t, g, unknown or other
  misc_feature (450)..(450): n is a, c, g, or t
  modified_base (599)..(599): a, c, t, g, unknown or other
  misc_feature (599)..(599): n is a, c, g, or t
tcagagtcgagagacacgaccggtgctcgatttagactcatctacgaggggaaagggggaggaactgctcagttaggacccagagggaaccagtggaacgccccagctcagcttctcttcctcctagctactcgtggctccaagactaccgaccgggataattggtgttnacncagttccgccggccacctgttcgtttgtctaccggaagggactagtcgccctacctctcaggcacgggtccagtagagtagttagttagtacgctttacgtataccgtacggtaacaaaacgacgtaaaccgtggaaccgacggtaccaccgtaacggtccttccactacttacctatgaacgtcgacctaacaaccggaacgtacgggacccttaacgcgacctacgacccgaacgccggtaagggttaccgagggtaccggtgacgggttcggtntaggtaccgaactaacgtacttccgaaacgtactccaacgtacacgacggacgaccgtcgtaacggacgtacctaaggtaaacgttcttacgacgtttaacgtttaagtttactacgtagtacgaaccgtagtaacgtacggtaaaccngttaaaccggtcgttacctaacccggttcgtacggttacgggacggttacgggaacgtagggacgaacgtaaagtaaccgaaagttcgggactggtacggccgaaactcctgtccgtttctaaccg

SEQ ID NO: 62581 - DNA, 743 bp, Homo sapiens
  misc_feature: GYAE6OF01DWCGX.49.2.A02.1.454.CMB.1.raw
  modified_base (163)..(163): a, c, t, g, unknown or other
  misc_feature (163)..(163): n is a, c, g, or t
  modified_base (167)..(167): a, c, t, g, unknown or other
  misc_feature (167)..(167): n is a, c, g, or t
  modified_base (414)..(414): a, c, t, g, unknown or other
  misc_feature (414)..(414): n is a, c, g, or t
  modified_base (700)..(700): a, c, t, g, unknown or other
  misc_feature (700)..(700): n is a, c, g, or t
tcagagtcgagagacacgaccggtgctcgatttagactcatctacaagggaaagggggaggaactgctcagttaggacccagagggaaccatggaagccccagctcagcttctcttcctcctgctactctggcctcccagatacccacggagtaattgtgttnacanacgtctccgccacctgttctttgtctcgagggacagtcgccctaccctctccgtgcgacggccagtcagtagtagttagtacgtcttcgtagccgtacggaaccaaacgaagaaaccgtcggaccgaacgtcctacccgaggtcctcctactagtactatggacttcgacaacgtacccaacgacggtcccagcggtaccacgtacccgacgaccggtagtacgaggtacggacgtaggtggttacngggtacaaacggtacgtccttaacgtaccttccaacgacgtaactaccgaacgcaaccgtccttaacgacgtaaccgttaagaaagttacttcgtaacgtttaccgtttaattttacgtaacttcggtacgaactacgttaccggtagttaacccgtaacggtacgtttacccgggtaaccttccggttaacccggttacgggtttaccgggaccggttaaaccggggaacgtaaacggggtaccggtaaagtaacgtaaacgtaaaccggacggttaacgggttnaacccggaggttaaccctacgtaccgtttccgttagttacccg

SEQ ID NO: 62582 - DNA, 690 bp, Homo sapiens
  misc_feature: GYAE6OF02FFDQT.49.2.A02.1.454.CMB.1.raw
tcagagtcgagagacacgaccggtgctcgatttagactcatctacgaggggaaagggggaggaactgctcagttaggacccagagggaaccatggaagccccagctcagcttctcttcctcctgctactctggctcccagataccaccggagtaaattgtgttgacacagtctccggcctaccctgtctttgtctccgaggggacagtcgcccaccctctcctgcagggccagtcagagttgttagtacgcttcttagccttaggtaaccaacgacgtaaacctggccaggcctccgaggtcctcctcatctatgatgcataccaagcggcctacgtcggaccaccgtcccgagtcccgtagggtttcaggttcggacgtagggttcgggtctggtacgacgtagtaccttaccgacctctaccacctatcacgcctagtcctaaggactcccgtagaacgttcttaccgagtactttaaggttttaactaccgttagtacgaagtaccgtacgggtaccgtaagacccgtaaccgtcggtaccctttacgttaccgtaccggtttaccggggaccgggttaaccggggaacccgtaggggtacggaaccgtaacggtaacccgtaaaacgggtaaccgttggaccggtacgtacggtaaccctacgttacgttccgttaccggtttccc

SEQ ID NO: 62583 - DNA, 646 bp, Homo sapiens
  misc_feature: GYAE6OF02JU4U3.49.2.A02.1.454.CMB.1.raw
  modified_base (331)..(331): a, c, t, g, unknown or other
  misc_feature (331)..(331): n is a, c, g, or t
  modified_base (378)..(378): a, c, t, g, unknown or other
  misc_feature (378)..(378): n is a, c, g, or t
tcagagtcgagagacacgaccggtgctcgatttagactcatctacgaggggaaagggggaggaacgtgctcagttacggacccagagggaaccatggaaggccccagctcagcttctcttcctcctgctactctggctcccagataccaccggagaaattgtgttgacacagtctccgccaccctgtctttgtctccgagggacagtcgccaccgtctcctgacagggccagtccagacgtgttaagtgcttcttagcctggtaccaacagtaaacctggaccaggtcctccaaggctacctcaactctatcgatacgcaattccaaaccngggccctaacgtcggacacgtcccaagccctaggttcaagtggaccnggtgggtctggacgtacaagtctcgaactctaccaaccatcacgaccaacggtcctaagacgtccctaggaaacgtcttctagccttaaggtttaccgtaactcggtttccgaagttcccgaaggacggttaacgacttaaccgtccgggaccttccgttaactccggtttacggcggttaacgggaccctaagggttggaaacgcgttaacgaaaccggacgtttacgggagtccgtaagtaccccgagttaacctccgtcgttacc

SEQ ID NO: 62584 - DNA, 597 bp, Homo sapiens
  misc_feature: GYAE6OF02IOOQ3.49.2.A02.1.454.CMB.1.raw
tcagagtcgagagacacgaccggtgctcgatttagactcatctacagtgaaagggggaggaactgctcagttaggacccagagggaaccatggaagccccagctcagcttctcttcctcctgctactctggctcccagataccaccggagaaattgtgttgacacagtcctccggccaccctgtctttgtctccgaggggacagtgccaccctctcctgcacgggccagtcgagagtgttagtagtcttcttagcctaggtacccaacagaaacctggccaggcctcccgaggcctcctcatctatgatgcatccaacgaggccacgtgacactccgagcctaggttcagtggctaggtcgggtctggtcgactagtacttacaccttctaccacctaatccaagtccaacgtcctagacgtctagtaaacgtcttcgtgtaccttaagttttactacttgtactaggtccaggtacgttaacgccaacggttcggcccttacgttaccgtcgtttacgggacggtaaccgggacgaagggtcgaagtaactaaccggtaaacgtaacgtggtcgacgtcgaccgccgtattcgtcg

SEQ ID NO: 62585 - DNA, 726 bp, Homo sapiens
  misc_feature: GYAE6OF02JE0S1.49.2.A02.1.454.CMB.1.raw
  modified_base (269)..(269): a, c, t, g, unknown or other
  misc_feature (269)..(269): n is a, c, g, or t
tcagagtcgagagacacgaccggtgctcgatttagactcatctacgagggaaagggggaggaactgctcagttaaggacccagagggaaccatcggaagccccagctaccagcttctcttccctccctgcttactctggcctccctagataccaccggagaaacttgtgttagactacagtctccggcccaccctgtctttgactccgacggggacaaggtcgccgaccctctccctgcaggccagtcagagtgtactagtcttcttanccgttgtaccaacacgaacctggccaggcctccgagctcctcatccagtgatcgacctacacccgaacgacgggtacccacgtcggacctacgtcccaacgccgttacggttcgacggtcggccgaaggttcggggtctaggtcgtaacgacggtaaccttcgtaacgtcctaccaccgtaacttccgaacgcgtaccggtacctacggtaccgaccggtagtaaacgctttaccgtcttacttacggtttaacttaccgtacgtaccgtaacgtcgtaccgggttacgtaaacgtaccgtaaaccgggtccgtaacccggtgtaccggtttacccgttacgggtacccggggtaacggtaccgggttacggacggtaacggtaaccgtaaccggtaaacgtacccgttacggtccggtactacccgtcctacccggtacctttcgtacccgttacc

SEQ ID NO: 62586 - DNA, 859 bp, Homo sapiens
  misc_feature: GYAE6OF02FPHVP.49.2.A02.1.454.CMB.1.raw
tcagagtcgagagacacgaccggtgctcgatttagactcatctacgagggaaagggggaggaactgctcagttaggacccagagggaaccatggaagccccagctcagcttctcttcctcctgctactctggctccagataccgacggaagaaattgtgttgacacagtcctccggccacccttgttctttgtctccgagggacagtcgcccaccctctccgtgcgacgggcagtcagtagttggttacgtagtcctttacgttacggcccgttacgggtaaacccaaacgtacggtaaaacccgtcgggaccctaacgggtccccttacccggaacggtcccttacccgtcgtaacttaccgttacgtacggtacgttacggtcctaaccgtacccggaaaaccggaccggggaccctaccggttacggtaaccctaaccgtaaccccggtacgggtaacccgttacggggtttcgtaacgggtcgggtaacgtagggttacggggttcgttacggtggaaccgtacggtaaccttccgtaccctttaccgtaacctaaccgtacgtaaccaccggtaccaaccggacgttaaacggaccggtaccgttaaggtaacggttacgtttaacgtacggttaacgttttaaggttttaaccgtttaccgttacgtaccgtaacggtccggtaacggttccgttaaccggtacccgtacggaccgttccctagtttaccgaccggggtttcgggaacgggaccgggtaacggttagggtacggtaacgaacggtaaaccgtaaaccggtacggttacgggtacgtaccggtagtacccttacgtacgttacgttccgttacc

SEQ ID NO: 62587 - DNA, 731 bp, Homo sapiens
  misc_feature: GYAE6OF02FNEMN.49.2.A02.1.454.CMB.1.raw
  modified_base (173)..(173): a, c, t, g, unknown or other
  misc_feature (173)..(173): n is a, c, g, or t
  modified_base (711)..(711): a, c, t, g, unknown or other
  misc_feature (711)..(711): n is a, c, g, or t
tcagagtcgagagacacgaccggtgctcgatttagactcatctacaggggtaaaggggggaggaactgcctcgaagttacggacccagagggtaaccatggaagccccagctcagcttctcttcctcctgctactctggcctccagataccacgggataaattgtgttgacanagtctccggtaccacctgtctttgtctccgaggggacagtcgccacctcgtcctgcgacgggccacgtcgagtacgttgttagtacgtctttacttagccttaggtaacccaacgtaacggaaaaccgtggacccgtacggacctacccgacggtcctacctcacgttacctaggttacgactagcctaacgtacccgaaacggacgggacccacggtcggacacctcccgacggtccgtacggtcgacggcggacgtacgggttggtccgttcgttcgaacgtacgtacctttcgaacccttccaccgtaaccgtacgtaccaccggtaccaacggtcccgtaaagggtaccgtcccgttaacggtaaagttccgttacgtacgttacgtttaaattttaacgtacgttacgtaccgtacgtcgtacgacgttacgtacgtacgtccggtccttcgtacccgttaacgggtccggaacggtaacgggtacggtagggtacgacggtaactaacggtaaaccggtgttcggtggtacncgacctactgtccttgtacc

SEQ ID NO: 62588 - DNA, 661 bp, Homo sapiens
  misc_feature: GYAE6OF01EK9P2.48.17.B06.1.454.CMB.1.raw
  modified_base (436)..(436): a, c, t, g, unknown or other
  misc_feature (436)..(436): n is a, c, g, or t
tcagagtatacatacacgaccggtgctcgatttagtcgatagtgaaggggggggtcacaagaggcagcgctctcgggacgtctccaccatggcctgggctctgctgctcctcaccctcctcactcaggacacagggtcctgggcccaggctgccctgactcagccagcctccgtgtctgcctctcctggacagtcggtcaatctttcctgcactggaaccgcctatgactattggaaaatataaccttgtctcctggtaccagcaacacccaggacaaacgaccccaaattaattattatacggtacaataagagaccgtgagggtctctgctcgcttctcgtggtacaagtctggcgacgacggcctcccacacatctcgtggctcgagtctaggaccgacgacggtccttaccttagttcgactcgccttcctntatacgtacgtaggtacttcccggctttacgtttactcgttcggttacgtttttccgggacgggtaaccgggtaacctaacggtcctaaccggttaccccggttacccgttaaccggtacccgaccggtaccccgtaaacgggtcccgtaccccggtccccccgttaccgggttccctaacccgtttcccgttaccccggtttcccccctacccccgttttcccg

SEQ ID NO: 62589 - DNA, 801 bp, Homo sapiens
  misc_feature: GYAE6OF01D1X88.48.17.B06.1.454.CMB.1.raw
  modified_base (222)..(222): a, c, t, g, unknown or other
  misc_feature (222)..(222): n is a, c, g, or t
tcagagtatacatacacgaccggtgctcgatttagtcgatagtgaagggggggtcacaagaggcagcgctctcgggacgtctccaccatggcctgggctctgctgctcctcaccctcctcactcaggacacagggtcctgggcccagtctgccctgactcagcctgcctcatgtctggtctcctagacagtcgatccaccgtctcctgcacgtacggaaccngctaagtgtattggtttgggccgtttaagcgtacccgtttgttccgttcccgttacggttaacccaaaccaaacccgaccccgaaggaacccaaaaccgacccccctaaaacttcgtttacgtaattttagtcgtaagactacgaaccgtaacggcccggacccgtacgtacgggttccttttaccgtaaacttccgtctttccgtacgttcgtaccgttacccgaagtttccgtacggaacctaaccgacccggtcccttacccgtacgaacttaaacgtccgttacggtcggtaccttaccgtacgggtaccgttagggaaaccggtacgggtacggtacgttagttaagtttaagtttacgttcgtctacggtacttactaagttagtcgtaagtacgggttacgttacgtttacggtttcgggttacggttcggacggtacggtaaccgggaaccgttaacggtaccggttaccggttacccggttacccggttacgggacccgtaacccggaacccgtaaccgggtccccgttaccccgggtacccccccgtttcgggtacccctttaccccgg

SEQ ID NO: 62590 - DNA, 728 bp, Homo sapiens
  misc_feature: GYAE6OF01C1JS0.48.17.B06.1.454.CMB.1.raw
  modified_base (187)..(187): a, c, t, g, unknown or other
  misc_feature (187)..(187): n is a, c, g, or t
  modified_base (214)..(214): a, c, t, g, unknown or other
  misc_feature (214)..(214): n is a, c, g, or t
tcagagtatacatacacgaccggtgctcgatttagtcgatagtgaagggggggtcacaagaggcagcgctctcgggacgtctccaccatggcctgggctctgctgctcctcaccctcctcactcagcatagggtcctggcccaggctgccctgactcagccagcctcgtgtctgcctctcctggacngtcgtacatcttcctgcactaggaccncctatcgactagttaggaaaattactaaccttgtcctccgtagtacccagacctaaccacccgaggtaccaaacgacccctaaattaacttatttaacgacggtactaaagtaagacgtaccgtcgaacgggtctacgtcgtctacgtcttacgtcgtcggtaccagttcaggcacgccgtcccgtcctacgactacgtccgtcgacggtcctaccgacggtcgtacgaacgtaccggacgttccttacccgtaagttccgactcgtcccttaccgtacttaacgttagtaggtacggttacgtcccggttaccgtttacgtttaacgttcgttacggtttacgttttaccgggaccgggttaaccggtaacccgtaggtacccgttacccggtaccccgtaccgtacccggttaccgaaccggtaccccgtaaccggtcccgtaacccccgtccccggtaccgttaccctacccgtttaccggttacccccttccccgtaccccgttttaccc

SEQ ID NO: 62591 - DNA, 638 bp, Homo sapiens
  misc_feature: GYAE6OF02I7TUN.48.17.B06.1.454.CMB.1.raw
  modified_base (191)..(191): a, c, t, g, unknown or other
  misc_feature (191)..(191): n is a, c, g, or t
  modified_base (209)..(209): a, c, t, g, unknown or other
  misc_feature (209)..(209): n is a, c, g, or t
  modified_base (221)..(221): a, c, t, g, unknown or other
  misc_feature (221)..(221): n is a, c, g, or t
tcagagtatacatacacgaccggtgctcgatttagtcgatagtgaagggggggtcacaagaggcagcgctctcgggacgtctccaccatggcctgggctctgctgctcctcaccctcctcactcaggacacagggtcctgggcccaggctgccctgacccagccagcctccgtgtctgcctctcctggacngtcggtcaattctttccngcactggacccnctatgacattaggaaaattactaaccttgtctcctggtaccagcaacaccagcaaacgcccccaaattaattattatacggtacaataagacgtacgtcgagggtctctgctcgcttctctggtccaagtctggcgacacggcctcctcactaactctcgtggcctcgagtctgacgacgacgtccttcctattcgctcgtcctcctactattacgtaggttacggtacttcccggtctttaccgttatcgttagttacgttttcgggacgggtaacgggaccctaaggtccgtacgtacccgttaccgtacgttcgaaccggtcccgaacgggtccctacccggtccccccgttacggttacccgtaacccgtttccgttaccccggtttaccccctacccccgtttcccttaccg

SEQ ID NO: 62592 - DNA, 536 bp, Homo sapiens
  misc_feature: GYAE6OF02GYVFL.48.17.B06.1.454.CMB.1.raw
tcagagtatacatacacgaccggtgctcgatttagtcgatagtgaaggggggggtcacaagaggcagcgctctcgggacgtctccaccatggcctgggctctgctgctcctcaccctcctcactcaggacacagggtcctgggcccaggctgccctgactcagccagcctccgtgtctgcctctcctggacagtcggtcaatctttcctgcactggaaccgcctatgacattaggaaaatataaccttgtctcctggtaccagcaacacccagcaaagcccccaaattattattatacggtcaataagagaccgtcaggggtctctgctcgcttctctgggtccaagtctggcgacacggcctccctcacaatctctgggctccgaggctgacgacgaggtcttcctattgctgctcctcatattgtaggctccgacttcttatctgtacttttcggcggagggaccaagctgaccgtcctacgtcgacgccaaggctccgcccctcggtccaccttcctcgttcccacccttccc

SEQ ID NO: 62593 - DNA, 563 bp, Homo sapiens
  misc_feature: GYAE6OF02HEAQ6.48.17.B06.1.454.CMB.1.raw
  modified_base (192)..(192): a, c, t, g, unknown or other
  misc_feature (192)..(192): n is a, c, g, or t
  modified_base (238)..(238): a, c, t, g, unknown or other
  misc_feature (238)..(238): n is a, c, g, or t
  modified_base (311)..(311): a, c, t, g, unknown or other
  misc_feature (311)..(311): n is a, c, g, or t
  modified_base (426)..(426): a, c, t, g, unknown or other
  misc_feature (426)..(426): n is a, c, g, or t
tcagagtatacatacacgaccggtgctcgatttagtcgatagtgaaggggggggtcacaagaggcagcgctctcgggacgtctccaccatggcctgggctctgctgctcctcaccctcctcactcaggacacagggtcctgggcccaggctgccctgactcagccagcctccgtgtctgcctctcctggacngtcgtcaatctttctgcactggaaccgctatgacattaggaaaatntaaccttgtctcctggtaccagcaacaccagcaaacgccccaaattattattatacgtcaataagagaccgtnagggtctctgctcgtcttctctggtccaagtctggcacgacggcctccctcacaatctctacggctcgagctgacgacgagtcttctatgctcgctctcatatgtagactccggnttcgttatcttgtacgtttcgggacggacgggtaacacggtctacgacccgttaccgtacgtccgaacgtcccgaacggtcctccggtcccccgttcggtccctaccgttcccgttaccgttccccaccctttcccg

SEQ ID NO: 62594 - DNA, 693 bp, Homo sapiens
  misc_feature: GYAE6OF02H8NVP.48.17.B06.1.454.CMB.1.raw
  modified_base (223)..(223): a, c, t, g, unknown or other
  misc_feature (223)..(223): n is a, c, g, or t
tcagagtatacatacacgaccggtgctcgatttagtcgatagtgaagggggggtcgacgaagaggcagcgctctcgggacgtctccaccatggcctgggctctgctgctcctcacctcctcactcaggacacagggtcctgggcccaggctgccctgactcagccagcctccgtgtctcgcctctcctggacagtcggtcaattctttcctgcactggaaccncctatgacattacggaaaaatacttaaaccttgtctcctcggtaccagacaacaccaagacaaacgacccctaaattaattattaatacgtacaaagtaagacgaccgtacgtacgggtactctcgtctcgtctttcctcgtcgggtacctaagtcgtggaccgacgaccggtaccctccctacaacaacttctcgtgggcctccgaacggtctacgacggtaacgacggtcttacctagtttcgcttcgccttacctactaacttacgttacggtaacgtacgtccgtcctttactttacgttacgttcgttacggttttccggggaccgggtaaaggttaacccgaaaggtcccgtacgggttaccctaccgttaaccggttacgaacccgtaccggtaacggcccttacccggtcccccggttcgtaccgtacccttcgtttcccgttcccccggccctttacccgg

SEQ ID NO: 62595 - DNA, 768 bp, Homo sapiens
  misc_feature: GYAE6OF02GS50L.48.17.B06.1.454.CMB.1.raw
tcagagtatacatacacgaccggtgctcgatttagtcgatagtgaaggggggggtcacaagaggcagcgctctcgggacgtctccaccatggcctgggctctgctgctcctcaccctcctcactcaggacacagggtcctgggcccaggctgccctgactcagccagcctccgtgtctgcctctcctggacagtcgtcaattctttctgcactcggaaccgcctatcgactattaggaaaattactaaccttgtctaccgtggtaccagacaaccaccaggacaaacgaccccctaaaattaactttatttaactaaccggtacaaagttaagacgtaccgtacgtacggggttcttacgtcgccttcggtacctttccgttccgttacggggttaccctaaaggttccgttacgggaccgaccgtaaccgggtcccttaccccgtaccaaccgtaacttccttaccggttacgggcccttacccgaacgggcctacggaaccggtacggacgggtcctttaccgttagttcgctacgtcccttaccctatacgtttacgtaggtacggtaccgttcccggtcttctttacgttcgttacggttaccgtttttccggggaccgggtaacgggtaaccgtaaacgtcgttacccgtacccgttacccgttaccgtacccgtaaccggacccgtaacggtcccgtccccggtccccgttaccggtcccttaccgttaccccgtttcccgtaccccctacccctttacccg

SEQ ID NO: 62596 - DNA, 791 bp, Homo sapiens
  misc_feature: GYAE6OF02G9518.48.17.B06.1.454.CMB.1.raw
  modified_base (208)..(208): a, c, t, g, unknown or other
  misc_feature (208)..(208): n is a, c, g, or t
  modified_base (264)..(264): a, c, t, g, unknown or other
  misc_feature (264)..(264): n is a, c, g, or t
  modified_base (398)..(398): a, c, t, g, unknown or other
  misc_feature (398)..(398): n is a, c, g, or t
tcagagtatacatacacgaccggtgctcgatttagtcgatagtgaagggggggtcacaagaggcagcgctctcgggacgtctccaccatggcctgggctctgctgctctcaccctctcactcaggacacagggtcctgggcccaggctcgccctgactcagccagcctccgtgtctgcctctcctggacagtcggtcaattctttccngcactggaaccgctatgactattaggaaaatctaacttgtctctggtacagcaacnccagcaacgccccaaattaattacttatacgtcaaagtaagacgtaccgtcgagggtctacctgactcgtcttctcgtagggtaccaagtcgtcggacgaccaccggccctccctacaccgtaactccgttacngggtcctaccgacgggtcctacggtaaccgaccggtaacgggttcctttacccgttaacgttcggtcccgttacggtccctttcccgttacggtaactttaacggtttacgggttaacgggtaaccctttcccggggtaccctttaacgttttaccggttaccgtttacggtttacgggtttttaccggggaccggggttaaaccggggtaaacccgtaaccggttccggtaaccgttacccccggtaccgtttaaccggtttaccggaacccggtacccccggtagggttaccccgttaccccggtacccccccgggtttaccgttacccggtaaccccgttttcccggtttaaccccggtttaccccccctaccccgtttttaacccccgg

SEQ ID NO: 62597 - DNA, 631 bp, Homo sapiens
  misc_feature: GYAE6OF02FRZFD.48.17.B06.1.454.CMB.1.raw
  modified_base (210)..(210): a, c, t, g, unknown or other
  misc_feature (210)..(210): n is a, c, g, or t
  modified_base (389)..(389): a, c, t, g, unknown or other
  misc_feature (389)..(389): n is a, c, g, or t
  modified_base (419)..(419): a, c, t, g, unknown or other
  misc_feature (419)..(419): n is a, c, g, or t
tcagagtatacatacacgaccggtgctcgatttagtcgatagtgaaggggggggtcacaagaggcagcgctctcgggacgtctccaccatggcctgggctctgctgctcctcaccctcctcactcaggacacagggtcctgggcccaggctgccctgactcagccagcctccgtgtctgcctctcctggacagtcggtcaattctttccngcacgtggaaccgcctatcgacattaggaaaattactaaaccttgtacctcctggtaccacgcaaccacccgagaccaaaccgaccccctaaaattaacttatttaactacggtacaaataagacgaccgtcgaagggtctctgctcgtcttcgtcgtggtaccaagtcgtggccgacncgtcctcccacacaatctctgggcctccgngtctgacgacggagtcttactattcgctcgtcctcctactatagttgtacgtacgtcccggtcttacttacttacttgttacggttttcgggacgggtacggaccgtagtcgtacgacccgtacgtacgtcgaaccgtacccgaacggtcccgtccgtacccccgttccgttaccgtaccttccgttcccgtttccccgtaccccttacccg

SEQ ID NO: 62598 - DNA, 586 bp, Homo sapiens
  misc_feature: GYAE6OF02GLXPV.48.17.B06.1.454.CMB.1.raw
  modified_base (184)..(184): a, c, t, g, unknown or other
  misc_feature (184)..(184): n is a, c, g, or t
  modified_base (220)..(220): a, c, t, g, unknown or other
  misc_feature (220)..(220): n is a, c, g, or t
  modified_base (239)..(239): a, c, t, g, unknown or other
  misc_feature (239)..(239): n is a, c, g, or t
  modified_base (275)..(275): a, c, t, g, unknown or other
  misc_feature (275)..(275): n is a, c, g, or t
  modified_base (377)..(377): a, c, t, g, unknown or other
  misc_feature (377)..(377): n is a, c, g, or t
  modified_base (386)..(386): a, c, t, g, unknown or other
  misc_feature (386)..(386): n is a, c, g, or t
  modified_base (399)..(399): a, c, t, g, unknown or other
  misc_feature (399)..(399): n is a, c, g, or t
  modified_base (414)..(414): a, c, t, g, unknown or other
  misc_feature (414)..(414): n is a, c, g, or t
  modified_base (445)..(445): a, c, t, g, unknown or other
  misc_feature (445)..(445): n is a, c, g, or t
tcagagtatacatacacgaccggtgctcgatttagtcgatagtgaaggggggggtcacaagaggcagcgctctcgggacgtctccaccatggcctgggctctgctgctcctcaccctcctcactcaggacacagggtcctgggcccaggctgccctgactcagccagcctccgtgtctgcctcncctggacagtcgtcaatctttcctgcactggaaccncctatgacattggaaaatntaacctgtctcctggtaccagcaacacctagcaaancccccaaaattaatatttatacggtctaaataaagagaccggtcaaggggtcctctacgctcgtcttctctgggtccaaagtctggcacgaccgcctccccnacaatctcncgggctccagctnacgacgagcttcctnttacgctgctcctcatatgtagatcccggtntcttatctgtacttttcgggacggtagggaccaagtctcgtaacccgtcccgtacgtccgacggtacccaaagggccctaccgtacccccggtcggtaccgtaccgttaccgtttccggttacccccgcccgtttaccccg

SEQ ID NO: 62599 - DNA, 823 bp, Homo sapiens
  misc_feature: GYAE6OF02HTD7N.48.17.B06.1.454.CMB.1.raw
  modified_base (695)..(695): a, c, t, g, unknown or other
  misc_feature (695)..(695): n is a, c, g, or t
tcagagtatacatacacgaccggtgctcgatttagtcgatagtgaaggggggggtcgacaagaggcagcgctctcgggacgtctccaccatggcctgggctctgctgctcctcaccctcctcactcacggacacgagggtcctcgggcccaggctcgccctgacctcacggccagccctccggtgttcctcggtccctctccctgggaactcggttccgggtactaattccttttcctggacctacgttacgggaaacccgtccttaagtgaacctaagtttaagggaaaaactttacttaaacctttcggttaccttccgttacggtaccgagaaccaaacctacccgaacggaaccaaaaccggtaaccccctaaaaattttaaactttaacgttttaacgtaaaccggttaactaaaacgttaaacgtaacgtaaccgtacggtaacggggtttcctcgttacgtccgtcgtaccttttccgtaccgttacgggtactaacgtccgtaggtaccggtaaccgaccggtccttaccccgacctaaccgtaacttcccgttacggtcgggtcccgttaccgacgggtactacgggtaacgaccggtacggtttccttaaacccgttgttaccgtcgtcgtaccttcctacttaagttcgtagtaccggttcgtaccgtccgttctttaccgttnttacggttacgttcgggtacgggacgggtaaccgaggtccctacggtcccgttacgccgttcgaaccgtccgtaacggccgtccctcccggtcgtaccctcgttaccgttcctacccttcccgttacc

SEQ ID NO: 62600 - DNA, 674 bp, Homo sapiens
  misc_feature: GYAE6OF02JB93T.48.17.B06.1.454.CMB.1.raw
  modified_base (193)..(193): a, c, t, g, unknown or other
  misc_feature (193)..(193): n is a, c, g, or t
  modified_base (207)..(207): a, c, t, g, unknown or other
  misc_feature (207)..(207): n is a, c, g, or t
  modified_base (247)..(247): a, c, t, g, unknown or other
  misc_feature (247)..(247): n is a, c, g, or t
  modified_base (518)..(518): a, c, t, g, unknown or other
  misc_feature (518)..(518): n is a, c, g, or t
tcagagtatacatacacgaccggtgctcgatttagtcgatagtgaaggggggggtcacaagaggcagcgctctcgggacgtctccaccatggcctgggctctgctgctcctcaccctcctcactcaggacacagggtcctgggcccaggctgaccctgactcagggccagcctcgtgtctgcctctcctgacngtcgtcattcttcngcacgtggaccgctatcgactattaggaaattactacttntctcctgtaccagacaacctaccagaccaaccaccctaaattaattacttatacgtactaataagacgtaccgtcgaggtctcgtctcgtcgactttctcggtcgtacctacggtctcggaccgaccacgtccctacccgtacaactacgtcgtcgtacggcctacggacgtctacggaccgtaacggtcgttccgtttaccttagttcgtaccgttcgtcccttactacgtaaactgttaacggttacgtacgtcccgtactttacgttntaccgttcgtttacggttccgggaacggtaccgtaactaacgtccgtaaccgtccgttaccgtacgtaccgtaccgaacccggtacgtccccgtcccggtaccccgttaccgttactccccgtttccgttaccccggttcccccctcgttaccccg

SEQ ID NO: 62601 - DNA, 426 bp, Homo sapiens
  misc_feature: GYAE6OF01B7IRK.38.41.D08.1.454.CMB.1.raw
  modified_base (421)..(426): a, c, t, g, unknown or other
  misc_feature (421)..(426): n is a, c, g, or t
tcagtcgatcacgtcacgaccggtgctcgatttagtcacgcgagaaagggaaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactactggggccacggaaccctggtcaccgtctcctcagcctccaccaagggcccatcggtcttccccctggcaccctcctccaagagcacctctgggggcacagcggccctgggctgcctggtcaaggactacttccacgtgatcgactgagcgggctggcaaggcgcatagnnnnnn

SEQ ID NO: 62602 - DNA, 431 bp, Homo sapiens
  misc_feature: GYAE6OF01AVGTH.38.41.D08.1.454.CMB.1.raw
  modified_base (424)..(431): a, c, t, g, unknown or other
  misc_feature (424)..(431): n is a, c, g, or t
tcagtcgatcacgtcacgaccggtgctcgatttagtcacgcgagaaagggaaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactactggggccacggaaccctggtcaccgtctcctcagcctccaccaagggcccatcggtccttccccctggccaccctcctccaagacgcacctctgggggcacagcggccctgggctgcctggtcaaggactacttccacgtgatcgactgagcgggctggcaaggcgcatagnnnnnnnn

SEQ ID NO: 62603 - DNA, 444 bp, Homo sapiens
  misc_feature: GYAE6OF01D29S7.38.41.D08.1.454.CMB.1.raw
  modified_base (436)..(444): a, c, t, g, unknown or other
  misc_feature (436)..(444): n is a, c, g, or t
tcagtcgatcacgtcacgaccggtgctcgatttagtcacgcgagaaagggaaaggggctggagtgggtctcaggtattactggtagtggtaataccgcatactacgcagactccgtgacgggccggttcaccatttccagagacaattccaagaacacgctgtctctgttaatgaacagcctgagagtcgaggacacggccatatattactgtgcgaaagatgtggggtggctggcccttgactccgtggggccagggaaccctggtcaccgtctcctcacgcctccaccaacgggcccatcggtcttccccctggccacccctcctccaacgacgccaccctcgtcgggggcacgacgccggcccgtgggctcgcctggtcaaggacctacttccacgtgatcgacgtgaggcgggctggacgaaggcgcatagnnnnnnnnn

SEQ ID NO: 62604 - DNA, 438 bp, Homo sapiens
  misc_feature: GYAE6OF01CWP1D.38.41.D08.1.454.CMB.1.raw
  modified_base (428)..(438): a, c, t, g, unknown or other
  misc_feature (428)..(438): n is a, c, g, or t
tcagtcgatcacgtcacgaccggtgctcgatttagtcacgcgagaaagggaaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactactggggccacggaaccctggtcaccgtctcctcagcctccaccagggccccatcggtccttcccctggccacccctcctccaagacgcacctcgtgggggcacagccggccctgggctcgcctggtcaacggactacttccacgtgatcgactgagcgggctggcaaggcgcatagnnnnnnnnnnn

SEQ ID NO: 62605 - DNA, 421 bp, Homo sapiens
  misc_feature: GYAE6OF01AM0AK.38.41.D08.1.454.CMB.1.raw
  modified_base (412)..(421): a, c, t, g, unknown or other
  misc_feature (412)..(421): n is a, c, g, or t
tcagtcgatcacgtcacgaccggtgctcgatttagtcacgcgagaaagggaaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactacgtggggccacggaaccctggtcaccgtctcctcagcctccaccagggcccatcggtctcccctggcaccctcctccagagcacctctggggcacagcgccctggctgcctgtcaggctactccacgtgatcgactgagcgggcgtggcaggcgcagtagnnnnnnnnnn

SEQ ID NO: 62606 - DNA, 442 bp, Homo sapiens
  misc_feature: GYAE6OF01BT5TI.38.41.D08.1.454.CMB.1.raw
  modified_base (410)..(410): a, c, t, g, unknown or other
  misc_feature (410)..(410): n is a, c, g, or t
  modified_base (430)..(442): a, c, t, g, unknown or other
  misc_feature (430)..(442): n is a, c, g, or t
tcagtcgatcacgtcacgaccggtgctcgatttagtcacgcgagaaagggaaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactacgtggggccacggaaccctggtcaccgtctcctcagcctccaccaagggcccatcggtcttccccctggccaccctcctccaagacgcacctctgggggcacagccggccctgggctgcctggtcaaggactactccacgtgactcgactgagccgggntcggcaacgggcgcagtagnnnnnnnnnnnnn

SEQ ID NO: 62607 - DNA, 443 bp, Homo sapiens
  misc_feature: GYAE6OF01ELOSU.38.41.D08.1.454.CMB.1.raw
  modified_base (429)..(443): a, c, t, g, unknown or other
  misc_feature (429)..(443): n is a, c, g, or t
tcagtcgatcacgtcacgaccggtgctcgatttagtcacgcgagaaagggaaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactactggggccacggaaccctggtcacagtctcctcagcctccaccaagggcccatcggtccttccccctcggccaccctcctccaagacgcacctctcggggcacgagccggcctgggctgcctggtcaaggactacttccacgtgactcgactgacgcgggctggcaaggcgacatagnnnnnnnnnnnnnnn

SEQ ID NO: 62608 - DNA, 554 bp, Homo sapiens
  misc_feature: GYAE6OF01CFQQU.38.41.D08.1.454.CMB.1.raw
  modified_base (518)..(518): a, c, t, g, unknown or other
  misc_feature (518)..(518): n is a, c, g, or t
  modified_base (520)..(554): a, c, t, g, unknown or other
  misc_feature (520)..(554): n is a, c, g, or t
tcagtcgatcacgtcacgaccggtgctcgatttagtcacgcgagaaagggaaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactactcggggccacggaaccctggtccaccgtctccgtcacgccctccaccgacgggcccacgtcggtccttcccccgtggccacccctcctccaagacgccaccctcgtgggggccacgacggccggaccccgtggggcctcggcccgttgggtaccgaaacgggtacccttaacctttccccgtaacggttcggtaacttcccggtacgttacggaacgggccggggacgttcggggaccgaaacggggcccgaaccgtaagtaaggngnnnnnnnnnnnnnnnnnnnnnnnnnnnnnnnnnnn

SEQ ID NO: 62609 - DNA, 442 bp, Homo sapiens
  misc_feature: GYAE6OF01C26PE.38.41.D08.1.454.CMB.1.raw
  modified_base (204)..(204): a, c, t, g, unknown or other
  misc_feature (204)..(204): n is a, c, g, or t
  modified_base (438)..(442): a, c, t, g, unknown or other
  misc_feature (438)..(442): n is a, c, g, or t
tcagtcgatcacgtcacgaccggtgctcgatttagtcacgcgagaaagggaaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctntattactgtgcgagagatcagacggagtatagcagcagctctgactactggggaccaacggaaccctaggtcaccgtctcctcagcctccaccaagggccccatcggtcctccccctggccaccctcctcccaagagctaccctcgtggggccacagcggccctggggctgcctggtacaacggactaccttccaacgtgatccgactgaggcgggctggcaaaggcgcatagnnnnn

SEQ ID NO: 62610 - DNA, 465 bp, Homo sapiens
  misc_feature: GYAE6OF01BJ8YQ.38.41.D08.1.454.CMB.1.raw
  modified_base (204)..(204): a, c, t, g, unknown or other
  misc_feature (204)..(204): n is a, c, g, or t
  modified_base (444)..(444): a, c, t, g, unknown or other
  misc_feature (444)..(444): n is a, c, g, or t
  modified_base (451)..(465): a, c, t, g, unknown or other
  misc_feature (451)..(465): n is a, c, g, or t
tcagtcgatcacgtcacgaccggtgctcgatttagtcacgcgagaaagggaaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctntattactgtgcgagagatcagacggagtatagcagcagctctgactacgtggggccacggaaccctggtcaccgtctcctcagcctccaccacggcccatcggtccttccccctcggccaccctcctccaagacgcacctcgtggggccacgacgccggcccgtgggctcgccgtcggtcgtaacggacctacgttccgacgtcgatccgacgtcggaggcgggtcgtgggacgaaggcncgatagnnnnnnnnnnnnnnn

SEQ ID NO: 62611 - DNA, 510 bp, Homo sapiens
  misc_feature: GYAE6OF01CNMA4.38.41.D08.1.454.CMB.1.raw
  modified_base (484)..(510): a, c, t, g, unknown or other
  misc_feature (484)..(510): n is a, c, g, or t
tcagtcgatcacgtcacgaccggtgctcgatttagtcacgcgagaaagggaaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactacgtggggccacggaaccctggtcaccgtctcctcacgccctccaccaacgggcccacgtccggtccttccccctggcccacccctccctaccaagacgccaccgtcggtcgggggccaacgacggccggccccgtgggcctcgcccgttacggtacgaacgggtaccttacccgttaccgacggttagactccgacgtgacggccgggtctcgggaccaagggcgacagtagnnnnnnnnnnnnnnnnnnnnnnnnnnn

SEQ ID NO: 62612 - DNA, 438 bp, Homo sapiens
  misc_feature: GYAE6OF01ESB2P.38.41.D08.1.454.CMB.1.raw
  modified_base (259)..(259): a, c, t, g, unknown or other
  misc_feature (259)..(259): n is a, c, g, or t
  modified_base (350)..(350): a, c, t, g, unknown or other
  misc_feature (350)..(350): n is a, c, g, or t
  modified_base (427)..(427): a, c, t, g, unknown or other
  misc_feature (427)..(427): n is a, c, g, or t
  modified_base (433)..(438): a, c, t, g, unknown or other
  misc_feature (433)..(438): n is a, c, g, or t
tcagtcgatcacgtcacgaccggtgctcgatttagtcacgcgagaaagggaaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcccaacggtgaccacctttggtgtcttttgattttcngtggccaagggacaatggtcaccgtctcttcacgcctccaccgaagggccccatccggttccttcccccgtggccgccctgcctccagganccacctccgagacgcacagcgcccgtgggctgcctgtcaaggctactccagtgatcgactgagcggctggcaaggcncatagnnnnnn

SEQ ID NO: 62613 - DNA, 481 bp, Homo sapiens
  misc_feature: GYAE6OF01C9W5Q.38.41.D08.1.454.CMB.1.raw
  modified_base (358)..(358): a, c, t, g, unknown or other
  misc_feature (358)..(358): n is a, c, g, or t
  modified_base (369)..(369): a, c, t, g, unknown or other
  misc_feature (369)..(369): n is a, c, g, or t
  modified_base (378)..(378): a, c, t, g, unknown or other
  misc_feature (378)..(378): n is a, c, g, or t
  modified_base (414)..(414): a, c, t, g, unknown or other
  misc_feature (414)..(414): n is a, c, g, or t
  modified_base (456)..(481): a, c, t, g, unknown or other
  misc_feature (456)..(481): n is a, c, g, or t
tcagtcgatcacgtcacgaccggtgctcgatttagtcacgcgagaaagggaaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcgagacggagtatagcagcagctctgactacgtcggggccaacggacccttggccaccgtctccgtcacgccctaccaaccgaacgggcccacgtccggttcccttcccccgtggcccacccctcctaccaagacnccaccgtcggnggggcacgngccgccgtggctgcctggacaacggtctactcagtnactcgactggacggtcggcgtgggacgaacggcgacgatagnnnnnnnnnnnnnnnnnnnnnnnnnn

SEQ ID NO: 62614 - DNA, 529 bp, Homo sapiens
  misc_feature: GYAE6OF01C7QAE.38.41.D08.1.454.CMB.1.raw
  modified_base (214)..(214): a, c, t, g, unknown or other
  misc_feature (214)..(214): n is a, c, g, or t
  modified_base (347)..(347): a, c, t, g, unknown or other
  misc_feature (347)..(347): n is a, c, g, or t
  modified_base (354)..(354): a, c, t, g, unknown or other
  misc_feature (354)..(354): n is a, c, g, or t
  modified_base (500)..(529): a, c, t, g, unknown or other
  misc_feature (500)..(529): n is a, c, g, or t
tcagtcgatcacgtcacgaccggtgctcgatttagtcacgcgagaaagggaaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtncgagagatcagacggagtatacgcagcagctctagactacgtcggggccacggaaccctggtcaccgtctcctccacgccctccaaccgaacggtccccaatccggtccttccccccgtgcccacccttcccncaagacnccacctcgtacggggcacgacggtccggcccgttgggccgtcgcccgtagggtaccgaaacggtaccctaacctttacccgaacggttagaacttccggaactcgggaacggcgggacgtcggggacaaagggtccgacagagcannnnnnnnnnnnnnnnnnnnnnnnnnnnnn

SEQ ID NO: 62615 - DNA, 626 bp, Homo sapiens
  misc_feature: GYAE6OF01EV9JU.38.41.D08.1.454.CMB.1.raw
  modified_base (247)..(247): a, c, t, g, unknown or other
  misc_feature (247)..(247): n is a, c, g, or t
  modified_base (256)..(256): a, c, t, g, unknown or other
  misc_feature (256)..(256): n is a, c, g, or t
  modified_base (545)..(545): a, c, t, g, unknown or other
  misc_feature (545)..(545): n is a, c, g, or t
  modified_base (606)..(606): a, c, t, g, unknown or other
  misc_feature (606)..(606): n is a, c, g, or t
tcagtcgatcacgtcacgaccggtgctcgatttagtcacgcgagaaagggaaaggggctggagtgggtctcaggtattactggtagtggtaataccgcatactacgcagactccgtgacgggccggttcaccgtctccagagacaattccaagaatacggtctatctggaaatgaacagcctgagagccgaggaccacggccctctattactgtgcgagagatcagacggagtaatagcagcagctntgactacgnggggaccacggaaccctggtcaccgtctcctcagtcctcaaccgaagggccccagtccggtccttcccccgtggaccacccctcctaccaagacgcaccgtcgtaggggcctacgacgccggtcccgtgggctcggtccgtggtaccgaaacggtaccttaaccgtttcccgaacggtttcgaacgttacggaccttacggggaacggtccgggggtaccgttacgggacctaaacgggggtccctactaagtaacggctagtcagcgtagacgcgtatccgacagtanacggtatacgtacacgtagacgtcgtacgacgtacgagacgtacgatacgtacgtacgtanacgtactacagcgtgtgtac

SEQ ID NO: 62616 - DNA, 543 bp, Homo sapiens
  misc_feature: GYAE6OF01DNKYC.38.41.D08.1.454.CMB.1.raw
  modified_base (455)..(455): a, c, t, g, unknown or other
  misc_feature (455)..(455): n is a, c, g, or t
  modified_base (502)..(504): a, c, t, g, unknown or other
  misc_feature (502)..(504): n is a, c, g, or t
  modified_base (506)..(508): a, c, t, g, unknown or other
  misc_feature (506)..(508): n is a, c, g, or t
  modified_base (510)..(510): a, c, t, g, unknown or other
  misc_feature (510)..(510): n is a, c, g, or t
  modified_base (512)..(514): a, c, t, g, unknown or other
  misc_feature (512)..(514): n is a, c, g, or t
  modified_base (516)..(543): a, c, t, g, unknown or other
  misc_feature (516)..(543): n is a, c, g, or t
tcagtcgatcacgtcacgaccggtgctcgatttagtcacgcgagaaagggaaaggggctgggaggtgggtctcaggtattactggtagtggtaataccgcatactacgcagactccgtgacgggccgttcaccgtctccagagacaattccaagaatacggtctatctggaaatgaacagcctgagagcccgaggacacggccctctattactgtgcgagagatcagacggagtatagcagcagctctgactacgtggggaccaacggaccctggtccacccgtcctcctcacgccctacccacgaacgggccctacgttccggttccccttcccccgcggcccctacccctccctaccgaacggaccgccctacccgtcgggtcggggaccacgacggccggtcccggtgggcctcggtccgtggtaacgaacggtaccttaccctccacggtnaactcgactgggacggcggcgtgggacgaagggctacgtaagtacgnnncnnntngnnngnnnnnnnnnnnnnnnnnnnnnnnnnnnn

SEQ ID NO: 62617 - DNA, 783 bp, Homo sapiens
  misc_feature: GYAE6OF01EB9ZR.38.41.D08.1.454.CMB.1.raw
  modified_base (188)..(188): a, c, t, g, unknown or other
  misc_feature (188)..(188): n is a, c, g, or t
  modified_base (197)..(197): a, c, t, g, unknown or other
  misc_feature (197)..(197): n is a, c, g, or t
  modified_base (244)..(244): a, c, t, g, unknown or other
  misc_feature (244)..(244): n is a, c, g, or t
  modified_base (249)..(249): a, c, t, g, unknown or other
  misc_feature (249)..(249): n is a, c, g, or t
  modified_base (663)..(663): a, c, t, g, unknown or other
  misc_feature (663)..(663): n is a, c, g, or t
  modified_base (746)..(746): a, c, t, g, unknown or other
  misc_feature (746)..(746): n is a, c, g, or t
tcagtcgatcacgtcacgaccggtgctcgattttagtcacgcgagaaagggaaaggggctggagtgggtctcaggtattactggtagtggtaataccgcatactacgcagactccgtgacgggccggttcaccgtctccagagacaattccaagaatacggtctatctaggaaatgaacagcctgagngccgagacnccgcctacttattactgtgcgagacagtccgattcggagtatcgacngtacnccgtcttacgcgtacgttaaccgtcggggacccaaccggtaaccctcggtccctaaccgtcctccgtccacggaccctaccgtaccgaaccggtcccctaacgttccgtttaccccgttccccgttacctcggaaccccgtttaccccgtaacgtaacgggacctacccgttaaccgggtcccggggttccgtaaccgaacggaccgggtacccccgttcggggtccgtacggtacccgttacgggttacccgtaaaccggtaaccgttaacccgtttacccgtaacccggttacggtaaccgttaccggtaccgttacgggtaacgggtaccgggggtaccggttaccggggtacggtaaaccgggtaacccggtaccgtaacggttaccgtacggcctacgtacgagtacgngcgtacgtaccttccgcgtacgtaccgacgtactaacgtacgttacgttgacgtaccgtacgctacgtgtctacggtacgtcncgtaacggtacgtaccctacgacgcgtccgtagtacg

SEQ ID NO: 62618 - DNA, 597 bp, Homo sapiens
  misc_feature: GYAE6OF01ASSCY.38.41.D08.1.454.CMB.1.raw
  modified_base (328)..(328): a, c, t, g, unknown or other
  misc_feature (328)..(328): n is a, c, g, or t
  modified_base (551)..(551): a, c, t, g, unknown or other
  misc_feature (551)..(551): n is a, c, g, or t
  modified_base (554)..(554): a, c, t, g, unknown or other
  misc_feature (554)..(554): n is a, c, g, or t
  modified_base (556)..(559): a, c, t, g, unknown or other
  misc_feature (556)..(559): n is a, c, g, or t
  modified_base (565)..(565): a, c, t, g, unknown or other
  misc_feature (565)..(565): n is a, c, g, or t
  modified_base (567)..(569): a, c, t, g, unknown or other
  misc_feature (567)..(569): n is a, c, g, or t
  modified_base (571)..(574): a, c, t, g, unknown or other
  misc_feature (571)..(574): n is a, c, g, or t
  modified_base (576)..(589): a, c, t, g, unknown or other
  misc_feature (576)..(589): n is a, c, g, or t
  modified_base (591)..(597): a, c, t, g, unknown or other
  misc_feature (591)..(597): n is a, c, g, or t
tcagtcgatcacgtcacgaccggtgctcgatttagtcacgcgagaaagggaaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactacgtggggccacggaaccctggtacaccgtctcctcacgccctaccaccgacggcccctactccggtccttcccccgngccacccctccgtaccaagacgcctacccgtcggtcgggggccaaccgaggcccggtcccgtcggggccctcggtcccgttacgggtaacccgaacgggtaacccctttaacccgtttccccgaacgggtttacggaacccggtccggtaacccggttgggaccgggtccggggccggttacgggtaccggaaaccggggccggtaacccgtaaggttagcgngcngnnnngcgcgngnnngnnnngnnnnnnnnnnnnnncnnnnnnn

SEQ ID NO: 62619 - DNA, 428 bp, Homo sapiens
  misc_feature: GYAE6OF02JBVDO.38.41.D08.1.454.CMB.1.raw
  modified_base (418)..(428): a, c, t, g, unknown or other
  misc_feature (418)..(428): n is a, c, g, or t
tcagtcgatcacgtcacgaccggtgctcgatttagtcacgcgagaaagggaaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactactggggccacggaaccctggtcaccgtctcctcagcctccaccaagggcccatcggtcttccccctggcaccctcctccaagagcacctctggggcacagcggccctgggctgcctggtcaaggctacttccacgtgatcgactgagcggctggcaaggcgcatagnnnnnnnnnnn

SEQ ID NO: 62620 - DNA, 426 bp, Homo sapiens
  misc_feature: GYAE6OF02G8DH9.38.41.D08.1.454.CMB.1.raw
  modified_base (420)..(426): a, c, t, g, unknown or other
  misc_feature (420)..(426): n is a, c, g, or t
tcagtcgatcacgtcacgaccggtgctcgatttagtcacgcgagaaagggaaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactactggggccacggaaccctggtcaccgtctcctcagcctccaccaagggcccatcggtcttccccctggcaccctcctccaagagcacctctgggggcacagcggccctgggctgcctggtcaaggctacttccacgtgatcgactgagcgggctggcaaggcgcatagnnnnnnn

SEQ ID NO: 62621 - DNA, 479 bp, Homo sapiens
  misc_feature: GYAE6OF02HZO2N.38.41.D08.1.454.CMB.1.raw
  modified_base (264)..(264): a, c, t, g, unknown or other
  misc_feature (264)..(264): n is a, c, g, or t
  modified_base (437)..(438): a, c, t, g, unknown or other
  misc_feature (437)..(438): n is a, c, g, or t
  modified_base (440)..(449): a, c, t, g, unknown or other
  misc_feature (440)..(449): n is a, c, g, or t
  modified_base (451)..(463): a, c, t, g, unknown or other
  misc_feature (451)..(463): n is a, c, g, or t
  modified_base (465)..(466): a, c, t, g, unknown or other
  misc_feature (465)..(466): n is a, c, g, or t
  modified_base (468)..(479): a, c, t, g, unknown or other
  misc_feature (468)..(479): n is a, c, g, or t
tcagtcgatcacgtcacgaccggtgctcgatttagtcacgcgagaaaggggaaaggggcggtggagtggggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactactggggccncggaaccctggtcaccgtctcctcagccctccaccaagggcccatcggtcttccccctggccaccctcctcaagagcacctcgtcggggcacgagcggccctgggctcgcctgtacgaaggcctacgttccaacgtgactcgactgagcgggctgggaccaaggcgcagtagnngnnnnnnnnnnannnnnnnnnnnnngnngnnnnnnnnnnnn

SEQ ID NO: 62622 - DNA, 444 bp, Homo sapiens
  misc_feature: GYAE6OF02FY66Y.38.41.D08.1.454.CMB.1.raw
  modified_base (434)..(444): a, c, t, g, unknown or other
  misc_feature (434)..(444): n is a, c, g, or t
tcagtcgatcacgtcacgaccggtgctcgatttagtcacgcgagaaagggaaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgacctactggggccacgggaacccctggtcaccgtctcccgttcagccctcccaccaaagggccccatccggtcttcccccctggccacccctcctcccaagagcacctctgggggcacagcggccctgggctgcctggtcaaggactacttccacgtgatcgactgagcggctggcaggcgcatagnnnnnnnnnnn

SEQ ID NO: 62623 - DNA, 466 bp, Homo sapiens
  misc_feature: GYAE6OF02GSDJE.38.41.D08.1.454.CMB.1.raw
  modified_base (398)..(398): a, c, t, g, unknown or other
  misc_feature (398)..(398): n is a, c, g, or t
  modified_base (424)..(424): a, c, t, g, unknown or other
  misc_feature (424)..(424): n is a, c, g, or t
  modified_base (430)..(432): a, c, t, g, unknown or other
  misc_feature (430)..(432): n is a, c, g, or t
  modified_base (435)..(466): a, c, t, g, unknown or other
  misc_feature (435)..(466): n is a, c, g, or t
tcagtcgatcacgtcacgaccggtgctcgatttagtcacgcgagaaagggaaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactacgtggggccacggaaccctggtcaccgtctcctcagcctccaccaacgggcccactcggtcttccccctggccaccctccctccaagacgccacctcgtcgggggcacgagccggcctgggctgcctgtcaaggactactccacgtnactcgactgacgcggctggacaggcncatagnnngtnnnnnnnnnnnnnnnnnnnnnnnnnnnnnnnn

SEQ ID NO: 62624 - DNA, 559 bp, Homo sapiens
  misc_feature: GYAE6OF02JXQWV.38.41.D08.1.454.CMB.1.raw
  modified_base (254)..(254): a, c, t, g, unknown or other
  misc_feature (254)..(254): n is a, c, g, or t
  modified_base (512)..(512): a, c, t, g, unknown or other
  misc_feature (512)..(512): n is a, c, g, or t
  modified_base (529)..(529): a, c, t, g, unknown or other
  misc_feature (529)..(529): n is a, c, g, or t
  modified_base (531)..(534): a, c, t, g, unknown or other
  misc_feature (531)..(534): n is a, c, g, or t
  modified_base (536)..(542): a, c, t, g, unknown or other
  misc_feature (536)..(542): n is a, c, g, or t
  modified_base (544)..(559): a, c, t, g, unknown or other
  misc_feature (544)..(559): n is a, c, g, or t
tcagtcgatcacgtcacgaccggtgctcgatttagtcacgcgagaaagggaaaggggcgtggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagacgatcagacggatatagcagcagctctgactacnggggccacggaacctggtcaccgtctcctcacgcctccaccaacgggccccagtccggtaccttccccccgtggcctaccccttccctaccctaacgaccggtccaacccgttccgtaccggggccaccgaggcccggcccgttgggggcctcggccctgggtacgaacggtaccttacgttcccgacggttcgactccggaactcggacgtccgggcctaaggcccggtaaaggcccgacgtaacgttacggctgcngtcagagcttgaaagcngnnnncnnnnnnncnnnnnnnnnnnnnnnn

SEQ ID NO: 62625 - DNA, 640 bp, Homo sapiens
  misc_feature: GYAE6OF02HPM4I.38.41.D08.1.454.CMB.1.raw
  modified_base (528)..(528): a, c, t, g, unknown or other
  misc_feature (528)..(528): n is a, c, g, or t
  modified_base (565)..(565): a, c, t, g, unknown or other
  misc_feature (565)..(565): n is a, c, g, or t
tcagtcgatcacgtcacgaccggtgctcgatttagtcacgcgagaaagggaaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctagactacgtggggccaccggaaccctggtaccaccggtctcctccacgtccctccaccaacggacccaatccggtccttccccctggcctaccctcctaccgaacgacgccgtaccctcgtcggggaccacgacgccggacccgtcggggcctcggccgtcgggtaccaaacggtaccgttacgttaccgacggttacggacgttccggaacgttcggacggccggggtaccgttacgggacgtaaacgggccgaccgtaacgtacgggtacacgagaccgngtcgcgcgtacgcgacgtcgacgtacgacgacgtcgngtacgtacgtacgtacgagagacgtacgtcgtacgtcgtcgtacgtacgtacgtacgacgtcgtactgtagtacg

SEQ ID NO: 62626 - DNA, 588 bp, Homo sapiens
  misc_feature: GYAE6OF02JZ9J8.38.41.D08.1.454.CMB.1.raw
  modified_base (519)..(519): a, c, t, g, unknown or other
  misc_feature (519)..(519): n is a, c, g, or t
  modified_base (529)..(529): a, c, t, g, unknown or other
  misc_feature (529)..(529): n is a, c, g, or t
  modified_base (546)..(546): a, c, t, g, unknown or other
  misc_feature (546)..(546): n is a, c, g, or t
  modified_base (551)..(551): a, c, t, g, unknown or other
  misc_feature (551)..(551): n is a, c, g, or t
  modified_base (555)..(555): a, c, t, g, unknown or other
  misc_feature (555)..(555): n is a, c, g, or t
  modified_base (558)..(558): a, c, t, g, unknown or other
  misc_feature (558)..(558): n is a, c, g, or t
  modified_base (563)..(563): a, c, t, g, unknown or other
  misc_feature (563)..(563): n is a, c, g, or t
  modified_base (565)..(565): a, c, t, g, unknown or other
  misc_feature (565)..(565): n is a, c, g, or t
  modified_base (567)..(568): a, c, t, g, unknown or other
  misc_feature (567)..(568): n is a, c, g, or t
  modified_base (570)..(570): a, c, t, g, unknown or other
  misc_feature (570)..(570): n is a, c, g, or t
  modified_base (572)..(572): a, c, t, g, unknown or other
  misc_feature (572)..(572): n is a, c, g, or t
  modified_base (575)..(575): a, c, t, g, unknown or other
  misc_feature (575)..(575): n is a, c, g, or t
  modified_base (577)..(577): a, c, t, g, unknown or other
  misc_feature (577)..(577): n is a, c, g, or t
  modified_base (579)..(579): a, c, t, g, unknown or other
  misc_feature (579)..(579): n is a, c, g, or t
  modified_base (581)..(582): a, c, t, g, unknown or other
  misc_feature (581)..(582): n is a, c, g, or t
  modified_base (584)..(586): a, c, t, g, unknown or other
  misc_feature (584)..(586): n is a, c, g, or t
tcagtcgatcacgtcacgaccggtgctcgatttagtcacgcgagaaagggaaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactactgggccacggaacctggtcaccgtactcctcacgcctccaccaacgggcccactcggtaccttcccccgtcggccacccgtcctaccaaggacgccaacctccgtcgggggtacacgacgaccggccctggggcctcggccgtcgggtaccgaaacggtacctaaccgtttcccgacggttcggtacgtaccggtacgttcggaacggccggggaccgttagggacccgaaacgggtcccggacgtaacgttaacggcacgcgacgngcggccttanccgacgcgagcgcgcgngcgcncgcncgngcgcncncnncngnacngncncnncnnncg

SEQ ID NO: 62627 - DNA, 727 bp, Homo sapiens
  misc_feature: GYAE6OF02FRNSC.38.41.D08.1.454.CMB.1.raw
  modified_base (665)..(665): a, c, t, g, unknown or other
  misc_feature (665)..(665): n is a, c, g, or t
  modified_base (673)..(673): a, c, t, g, unknown or other
  misc_feature (673)..(673): n is a, c, g, or t
tcagtcgatcacgtcacgaccggtgctcgatttagtcacgcgagaaagggaaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggatatagcagcagctctgtactacgtcggggccaccggaccctggtctacccgtctcctacgacgtccctaccgaaccgaacggggtccccagttcccgggttccctttaccccccgtcgggtcccctacccccgttcccgtaacccgtaacggaccgtccctaacccgttcgggttcgggggaccctaaccgacgggtcccgggtaccccggtcggggtcccgttaccgggtcccggttacgggtttaccggaaaaccgggttaacccgttaaccgtttccccggtaacgggttacggtaccgttaccgggtaccgttaggaacccgggttccggggtaccgttcgggaaccggtaacggggtccgtaacgtaacggtacggtacgcgtcgacgcttcgctacgtcgtactagacgtcgcgtactagtcgacgttnattaccgngtcgtatcgtacgtcgacgtactcgctcgtacgacgtgttcgaccgtagtcgcg

SEQ ID NO: 62628 - DNA, 669 bp, Homo sapiens
  misc_feature: GYAE6OF02HZIEJ.38.41.D08.1.454.CMB.1.raw
  modified_base (293)..(293): a, c, t, g, unknown or other
  misc_feature (293)..(293): n is a, c, g, or t
  modified_base (603)..(603): a, c, t, g, unknown or other
  misc_feature (603)..(603): n is a, c, g, or t
  modified_base (610)..(610): a, c, t, g, unknown or other
  misc_feature (610)..(610): n is a, c, g, or t
  modified_base (617)..(617): a, c, t, g, unknown or other
  misc_feature (617)..(617): n is a, c, g, or t
  modified_base (619)..(619): a, c, t, g, unknown or other
  misc_feature (619)..(619): n is a, c, g, or t
  modified_base (622)..(622): a, c, t, g, unknown or other
  misc_feature (622)..(622): n is a, c, g, or t
  modified_base (626)..(626): a, c, t, g, unknown or other
  misc_feature (626)..(626): n is a, c, g, or t
  modified_base (632)..(632): a, c, t, g, unknown or other
  misc_feature (632)..(632): n is a, c, g, or t
  modified_base (636)..(636): a, c, t, g, unknown or other
  misc_feature (636)..(636): n is a, c, g, or t
  modified_base (650)..(650): a, c, t, g, unknown or other
  misc_feature (650)..(650): n is a, c, g, or t
  modified_base (652)..(652): a, c, t, g, unknown or other
  misc_feature (652)..(652): n is a, c, g, or t
  modified_base (654)..(654): a, c, t, g, unknown or other
  misc_feature (654)..(654): n is a, c, g, or t
  modified_base (656)..(656): a, c, t, g, unknown or other
  misc_feature (656)..(656): n is a, c, g, or t
  modified_base (659)..(659): a, c, t, g, unknown or other
  misc_feature (659)..(659): n is a, c, g, or t
  modified_base (665)..(665): a, c, t, g, unknown or other
  misc_feature (665)..(665): n is a, c, g, or t
  modified_base (667)..(668): a, c, t, g, unknown or other
  misc_feature (667)..(668): n is a, c, g, or t
tcagtcgatcacgtcacgaccggtgctcgatttagtcacgcgagaaagggaaaggggctggagtgggtctcaggtattactggtagtggtaataccgcatactacgcagactccgtgacgggccggttcaccgtctccagagacaattccaagaatacggtctatctggaaatgaacagcctgagagccgaggacaccggccctctattactgtgcgagagatcagacggagtatagcagcagctctgactacgtcggggaccacggaaccctggtccaccgtctcctcgacnccctaccgaaccgaacggggaccccagtcccggttacccttccccccgttggggacccctaccccttcccgtacccgaaacggtacgaccctaaccccgtccgggttacgggggacccacgtaacggcccggggtacccgtcgggggtccttaccgggtcccgttacgggtaaccaaacggggttaccctttaccttacccggtacggttacgtaacgttcccgggtaacgttagggaccggggtacccggggcgttacgggggtaaccaaaccgggggcttaacccgtaagtacggcctagctcgcganacggtcncagcgtnanacncagngacacncgcnctcacgcgtagcancncncnacnacacgnanna

SEQ ID NO: 62629 - DNA, 581 bp, Homo sapiens
  misc_feature: GYAE6OF02JWELL.38.41.D08.1.454.CMB.1.raw
  modified_base (285)..(285): a, c, t, g, unknown or other
  misc_feature (285)..(285): n is a, c, g, or t
  modified_base (303)..(303): a, c, t, g, unknown or other
  misc_feature (303)..(303): n is a, c, g, or t
  modified_base (319)..(319): a, c, t, g, unknown or other
  misc_feature (319)..(319): n is a, c, g, or t
  modified_base (492)..(492): a, c, t, g, unknown or other
  misc_feature (492)..(492): n is a, c, g, or t
  modified_base (494)..(494): a, c, t, g, unknown or other
  misc_feature (494)..(494): n is a, c, g, or t
  modified_base (498)..(498): a, c, t, g, unknown or other
  misc_feature (498)..(498): n is a, c, g, or t
  modified_base (502)..(502): a, c, t, g, unknown or other
  misc_feature (502)..(502): n is a, c, g, or t
  modified_base (514)..(514): a, c, t, g, unknown or other
  misc_feature (514)..(514): n is a, c, g, or t
  modified_base (520)..(520): a, c, t, g, unknown or other
  misc_feature (520)..(520): n is a, c, g, or t
  modified_base (542)..(542): a, c, t, g, unknown or other
  misc_feature (542)..(542): n is a, c, g, or t
tcagtcgatcacgtcacgaccggtgctcgatttagtcacgcgagaaagggaaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcgagacggagtatagacaggcagctctgactacgcgggccacgaccgtgcgaccgtctcctcncgcctccacgtacggccngtcggtcctaccccgngccaccctcctaccgagacgtaccaccgtcggtacggggccaacgtacggccggtcccgtggggcctcgtcccgtcggtaccgaaacggtaccttaccgtccctacggtctacgttaccgcgtcggtacgggccggctacggggacctaacggggcttacagtacgggctacngngcgngcgngtcgcgacgcgngcgcgnacgcgacgcgcgtcgcgacgcnccgctcgagacgcgacgactcggtactacgcgtgtgtag

SEQ ID NO: 62630 - DNA, 152 bp, Homo sapiens
  misc_feature: GYAE6OF01C5XEX.10.86.H09.1.454.CMB.1.raw
  modified_base (147)..(152): a, c, t, g, unknown or other
  misc_feature (147)..(152): n is a, c, g, or t
tcagcatagtagtgcacgaccggtgctcgatttagtgctatagacttgggtttgggaccgtcctacgtcagcccaaggctgcccctcggtcactctgttcccgccctcctccactactatgctgagcgggctggcaaggcgcatagnnnnnn

SEQ ID NO: 62631 - DNA, 149 bp, Homo sapiens
  misc_feature: GYAE6OF01APVY2.10.86.H09.1.454.CMB.1.raw
  modified_base (149)..(149): a, c, t, g, unknown or other
  misc_feature (149)..(149): n is a, c, g, or t
tcagcatagtagtgcacgaccggtgctcgatttagtgctatagacttgggtttggggaccgtcctacgtcagcccaaggctgccccctcggtcactctgttcccaccctcctccactactatgctgagcgggctggcaaggcgcatagn

SEQ ID NO: 62632 - DNA, 346 bp, Homo sapiens
  misc_feature: GYAE6OF01EEENM.10.86.H09.1.454.CMB.1.raw
  modified_base (342)..(346): a, c, t, g, unknown or other
  misc_feature (342)..(346): n is a, c, g, or t
tcagcatagtagtgcacgaccggtgctcgatttagtgctatagacttgggtttgggggctgtccccaaactcctcatctatgaagattttacgcgaccctcagggattcctggccgattctctggctccaagtcaggcacctctgccaccctggacatcaccgggctccagaccggggacgaggccgattattactgcgcaacttgggactccaacctgactgttggggctttcggcggagggactaagttgaccgtcctacgtcagccaaggctgccccctggtcactctgttcccgccctcctccactactatgctgagcgggctggcaaggcgcatagnnnnn

SEQ ID NO: 62633 - DNA, 396 bp, Homo sapiens
  misc_feature: GYAE6OF01CNAHL.10.86.H09.1.454.CMB.1.raw
  modified_base (391)..(396): a, c, t, g, unknown or other
  misc_feature (391)..(396): n is a, c, g, or t
tcagcatagtagtgcacgaccggtgctcgatttagtgctatagacttgggtttggaagcgcctccaacattggcacgaattatgtatcctggtaccagcacttccccgggacagccccaaactcctcatctatgaagattttacgcgaccctcagggattcctggccgattctctggctccaagtcaggcacctctgccaccctggacatcaccgggctccagaccggggacgaggccgattattactgcgcaacttgggactccaacctgactgttggggctttcggcggaggactaagttgaccgtctacgtcagcccaaggctgcccctggtcactctgttcccacctcctccactactatgctgagcgggctggcaaggcgcatagnnnnnn

SEQ ID NO: 62634 - DNA, 554 bp, Homo sapiens
  misc_feature: GYAE6OF01EUGXT.10.86.H09.1.454.CMB.1.raw
  modified_base (527)..(527): a, c, t, g, unknown or other
  misc_feature (527)..(527): n is a, c, g, or t
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtaccagcacttccccgggacagcccccaaactcctcatctatgaagattttacgcgaccctcgagggtacttcctggccgattcctctggctccaagtcaggcacctctgccaccctggacatccaccgggctcccgagaccggggacgacggccgatttactactgccgcaacgttgggacctccaacctgacttggttcggggctttcgggcggagggtactaggtcgaccgtcctacgtcgacgccaaggctcgcccctggtcacctctcgtcccaccctccnccactactactcgctgacgcggctcgg

SEQ ID NO: 62635 - DNA, 399 bp, Homo sapiens
  misc_feature: GYAE6OF01CRAQF.10.86.H09.1.454.CMB.1.raw
  modified_base (392)..(399): a, c, t, g, unknown or other
  misc_feature (392)..(399): n is a, c, g, or t
tcagcatagtagtgcacgaccggtgctcgatttagtgctatagacttgggtttggaagcgcctccaacattggcacgaattatgtatcctggtaccagcacttccccgggacagcccccaaactcctcatctatgaagattttacgcgaccctcagggattcctggccgattctctggctccaagtcaggcacctctgccaccctggacatcaccgggctccagaccggggacaggccgattatactgcgcaacttgggactccaacctgactgttggggctttcggcggagggactaagttgaccgtcctacgtcagcccaaggctgcccctggtcactctgttcccacctcctccactactatgctgagcgggctggcaaggcgcatagnnnnnnnn

SEQ ID NO: 62636 - DNA, 401 bp, Homo sapiens
  misc_feature: GYAE6OF01BERTR.10.86.H09.1.454.CMB.1.raw
  modified_base (393)..(401): a, c, t, g, unknown or other
  misc_feature (393)..(401): n is a, c, g, or t
tcagcatagtagtgcacgaccggtgctcgatttagtgctatagacttgggtttggaagcgcctccaacattggcacgaattatgtatcctggtaccagcacttccccgggacagcccccaaactcctcatctatgaagattttacgcgaccctcagggattcctggccgattctctggctccaagtcaggcacctctgccaccctggacatcaccgggctccagaccggggacgaggccgattatactgcgcaacttgggactccaacctgactgttgggctttggcggagggactaagttgaccgtcctacgtcagcccaaggctgcccctcggtcactctgttcccaccctcctccactactatgctgagcgggctggcaaggcgcatagnnnnnnnnn

SEQ ID NO: 62637 - DNA, 348 bp, Homo sapiens
  misc_feature: GYAE6OF01AWSXW.10.86.H09.1.454.CMB.1.raw
  modified_base (344)..(348): a, c, t, g, unknown or other
  misc_feature (344)..(348): n is a, c, g, or t
tcagcatagtagtgcacgaccggtgctcgatttagtgctatagacttgggtttgggggctgtccccaaactcctcatctatgaagattttacgcgaccctcagggattcctggccgattctctggctccaagtcaggcacctctgccaccctggacatcaccgggctccagaccggggacgaggccgattattactgcgcaacttgggactccaacctgactgttggggctttcggcggagggactaagttgaccgtcctacgtcagcccaaggctgccccctcggtcactctgttcccaccctcctccactactatgctgagcgggctggcaaggcgcatagnnnnn

SEQ ID NO: 62638 - DNA, 542 bp, Homo sapiens
  misc_feature: GYAE6OF01A0TSS.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtaccagcacttccccgggacagcccccaaactcctcatctatgaagattttacgcgaccctcagggattcctggccgattctctggctccaagtcaggcacctctgccacctggacatcaccggctccgagaccggggacgaggccgattatactgcgcaacttgggactccaacctgactggttcgggctttcgggcggagggtactaaggttcgaccgtcctacgtcacgcccaaggctcgccccctggtccactctcgttcccaccctcctccactactactcgctgacgcggctcgg

SEQ ID NO: 62639 - DNA, 720 bp, Homo sapiens
  misc_feature: GYAE6OF01BGOE4.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtaccagcacttcccgggacagcccccaaactcctcatctatgaagattttacgcgaccctcggagtctcgcgactctctgcgtccacgtacacgcgacctacctcgccgaccctaccggtacgactcgtacccgggccggtcccgtaccggacccgggggaacccgggaacgggtacccgggtaaccgttaacgtttaaccgttacggtaccggccgtaaccgtttacggggtaccgtacccgtaacccgtacggtaccgttacggtttcggggttaccggtttccggtaccggggacggggtaacggtaacgtttacggtacccggtacccgttaccgtaccgtacgtacccgtaaccggtacgtccgtccccccgtcccgggtccgtacccttccgttccgttccccgtaccccctccccgttccctaccctaccgttcgtccgtcggtacggcgggtccgtcggtcggtaaccggg

SEQ ID NO: 62640 - DNA, 695 bp, Homo sapiens
  misc_feature: GYAE6OF01CLMAX.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtaccagcacttcccggacacgccccaaactcctcatctatgaagtattttacgcgaccctcgagggattccgtggccgattctctggctccaagtcacggcacctctcgcccaccctggacatccgaccgggctccgaggaccggggacgacggccgtaattacgttactgcgactaacgttcgggaacctaccgaaaccctggtaccgttgggtttacggggtccgttttcgggaccgggtaacgggtaacttaaacgggtttcggtaaccccgttacccgttaacggtaccgtacggtaccccgaaagggtcccgttccggcccccccgttcgggtccctaacccgttcccgttacccggtttcccccgtcccccgttccccttccccgtaacccgttaacccttaacgttccggtaccgttacgggaccggtccggggtccgttaccgggg

SEQ ID NO: 62641 - DNA, 713 bp, Homo sapiens
  misc_feature: GYAE6OF01BWB80.10.86.H09.1.454.CMB.1.raw
tcagcatagtagtgcacgaccggtgctcgatttagtgctatagacttgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaacgggccctcggtacttgagtggaaaggttaacagtgagtggcagccacgaccggaaggggacggactcccgtagtagttcgttttacgacgggtccagtcgtcggtggggctggacgccgtctaccctcgaacctacgtcctaccgacgtcccctaccgtaacgttccgtaggacgggtacgtacggtacgggtcttacgggaacctttaagtttaaccgtcgggttaccgaacgggttaccccggttagggggtacccttaacgggttcgggtttaacggtttcggggttttaccgggggtttttaccgggggaccgggggtaaaccgggggtaacccgtaaaacggggttcccgttaaccggggttaacccccggtttacccgggttaaaccggggtacccgtaaccgggtaccccccgtaaacggggtccccgttaccccccgggg

SEQ ID NO: 62642 - DNA, 573 bp, Homo sapiens
  misc_feature: GYAE6OF01BEJH0.10.86.H09.1.454.CMB.1.raw
  modified_base (528)..(528): a, c, t, g, unknown or other
  misc_feature (528)..(528): n is a, c, g, or t
  modified_base (568)..(568): a, c, t, g, unknown or other
  misc_feature (568)..(568): n is a, c, g, or t
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtaccagcacttccccgggacacgccccaaactcctcatctatgaagtattttacgcgaccctcagggtacttccgtggccgtattctctggctccaagtcaggcacctctcgccaccctggacatccgaccggctccgaggaccggggacgaggccgtaattacttactgccgacaacgttcgggacctccgaaacctcgacgtggttcggggcgtttcgggcgggtaacgggacttaaggttcgacccgttcctacgtcacgcccgaagcctcgccccgtggtccnctctcgttccccacctcctccactactatcgctgcgcggngtcgg

SEQ ID NO: 62643 - DNA, 532 bp, Homo sapiens
  misc_feature: GYAE6OF01BH2J0.10.86.H09.1.454.CMB.1.raw
  modified_base (528)..(528): a, c, t, g, unknown or other
  misc_feature (528)..(528): n is a, c, g, or t
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtaccagcacttccccgggacagcccccaaactcctcatctatgaagattttacgcgaccctcagggattcctggccgattctctggctccaagtcaggcacctctgccaccctggacatcaccgggctccgagaccggggacaggccgattattactgcgcaacttgggactccaacctgactgttgggctttcggcggaggactaagttgaccgtcctacgtcagccaaggctcgcccctcggtcactctcgttcccgccctcctccactactatcgctgcgcggntcgg

SEQ ID NO: 62644 - DNA, 540 bp, Homo sapiens
  misc_feature: GYAE6OF01A6EIW.10.86.H09.1.454.CMB.1.raw
  modified_base (470)..(470): a, c, t, g, unknown or other
  misc_feature (470)..(470): n is a, c, g, or t
  modified_base (527)..(527): a, c, t, g, unknown or other
  misc_feature (527)..(527): n is a, c, g, or t
  modified_base (529)..(529): a, c, t, g, unknown or other
  misc_feature (529)..(529): n is a, c, g, or t
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtaccagcacttccccgggacagccccaaactcctcatctatgaagattttacgcgaccctcagggattcctggccgattctctggctccaagtcaggcacctctgccaccctggacatcaccgggctccacggaccggggacgacggccgattacttactgcgcaacgttgggactccaacctgactgttgggctttcggcggagggactaagttgaccgtctacgtcncgcccaaggctcgccccgtcggtcactcctcgttcccgccctcctccactactatcngngcgggctggcg

SEQ ID NO: 62645 - DNA, 403 bp, Homo sapiens
  misc_feature: GYAE6OF01BH440.10.86.H09.1.454.CMB.1.raw
  modified_base (393)..(393): a, c, t, g, unknown or other
  misc_feature (393)..(393): n is a, c, g, or t
  modified_base (398)..(403): a, c, t, g, unknown or other
  misc_feature (398)..(403): n is a, c, g, or t
tcagcatagtagtgcacgaccggtgctcgatttagtgctatagacttgggtttggaagcgcctccaacattggcacgaattatgtatcctggtaccagcacttccccgggacagcccccaaactcctcatctatgaagattttacgcgaccctcagggattcctggccgattctctggctccaagtcaggcacctctgccaccctggacatcaccgggctccagaccggggacgaggccgattattactgcgcaacttgggactccaacctgactgttggggctttcggcggagggactaagttgaccgtcctacgtcagcccaaggctgccccctcggtcactctcgttcccaccctcctccactactatgctgagcgggctggcaaggcgnatagnnnnnn

SEQ ID NO: 62646 - DNA, 740 bp, Homo sapiens
  misc_feature: GYAE6OF01DYUYK.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggcccaggacagagggtcaccgtctcctgctctggaacgccgcctccaaacagttggcacgaattatgtatcctggtaccagcaccgttccccgggacacgacccccaaactcctcatctatagaagtacttttacgccgaccctcgacgggtacttccgtcggccgtattcctcgtcggcctaccaagtcacggcacctctcgccaccctggacacgtccgaccgggctaccgacgggaccggggacgacggtaccgtaatttacgttaccgtacgccgtacgtaaaccgttcgggaacctacccgaaccgttcgtaccgttcgggttacgggggtccgttttaccggggacgggtaacgggtaacgttaacggttcggtaaccccgttacccgtaacgtccgtaaccggtaccccgtaaacgggtcccgtacccggtccccccgttacgggtcccgtacccgttccgttacccggtttacccccctaccccgtttacccctaccccgttaacccttaaccgttaccgttccggtaccgttacgggaccgggtcccggggtcgtaccgggg

SEQ ID NO: 62647 - DNA, 544 bp, Homo sapiens
  misc_feature: GYAE6OF01ECRXG.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtaccagcacttccccgggacacgcccccaaactcctcatctatgaagattttacgcgaccctcagggattcctggccgattctctgctcaagtcagcacctctgccaccctggacatcaccgggctcccgaggaccggggacgacggccgattattactgcgcaacgttgggactccaacctgactggttgggctttcggcggaggactaagttgaccgtcctacgtcagcccaaggcctcgccccctggtccactctcgtccccaccctcctccactactagtcgctgacgtcgggctcggg

SEQ ID NO: 62648 - DNA, 554 bp, Homo sapiens
  misc_feature: GYAE6OF01DTGYY.10.86.H09.1.454.CMB.1.raw
  modified_base (410)..(410): a, c, t, g, unknown or other
  misc_feature (410)..(410): n is a, c, g, or t
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtaccagcacttccccgggacacgcccccaaactcctcatctatgaagtattttacgcgacccctcagggacttccgtggccgattctctggctccaagtcaggcacctctcgccaccctggacatccgaccgggctccgaggaccggggacgagggccgattacttacngcgcaacgttggactccaactgacgtggttcgggctttcggcggtaggactaagttcgaccgtctacgtcacgcccaaggcctcgcccctggtcacctctcgttcccgccctcctccactctactcgactgacggcggcgtcgg

SEQ ID NO: 62649 - DNA, 579 bp, Homo sapiens
  misc_feature: GYAE6OF01AFLJQ.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtaccagccaccttccccgggacacgcccccaaactcctcatctatgaagtattttacgcgaccctcgagggattcctggccgattctctggctccaagtcaggcacctctcgccaccctggacactcaccgggcctccgacggacccggggacgacgggcccgtattacgttacgtgccgacgtaacgttcgggacctcccaaccgtgacgttggttggggccgttttcgggcgggtagggtactaaggttcgaccgtcctacgtcacgcccaaggcctcgcccctcggtcactctcgttcccaccctcctcccactactatcgctggcgcggctcgg

SEQ ID NO: 62650 - DNA, 538 bp, Homo sapiens
  misc_feature: GYAE6OF01BK3GG.10.86.H09.1.454.CMB.1.raw
  modified_base (528)..(528): a, c, t, g, unknown or other
  misc_feature (528)..(528): n is a, c, g, or t
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtaccagcacttccccgggacagcccccaaactcctcatctatgaagattttacgcgaccctcagggattcctggccgattctctggctccaagtcaggcacctctgccacctggacatcaccgggctccaggaccggggacgacggccgattattactgcgcaacgttggactccaaaccgtgactggttgggctttcggcggagggactaagtcgaccgtcctacgtcagcccaaggctcgcccctggtccactctcgttcccgcctcctccactactatgctgancgggctcggg

SEQ ID NO: 62651 - DNA, 805 bp, Homo sapiens
  misc_feature: GYAE6OF01D4VXQ.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgtggccccaggacagagggtcaccgtctcctgctctggaagcgcctccaacattggcacgaattatgtatcctggtaccagcacttccccgggacacgcccccaaactcctcatctaatgaagtattttaccgccgaacccttcgaaggggtactttcccgtgggacccgtatttcctctggctaccaagtcaggccacctctcgcccacctggacatccgaccgggctccgacggacccggggacgacgggcccgtaatttacgttaaccgtcggaccgtacgtaaaccggtttcggggaaccttaccccgaaaccgttcggtaaccgtttcggggttttaccgggggtacccgtttttccgggggaccggggtaacgggggttaacccgtttaaacgggtttcggaaacccccgggtttcccgttaaacccgggttacccgtaaccgggtacccccgtaaaacggggtccccgttacccgggtacccccccccgtttcggggttaccctaacccgtttcccgtttacccggttttcccccccgtaaccccgtttccccgttacccctaaacccgtttaaccttaaccgttcgtacccggtttcgggaacccgggttccggggtccgttacccggggg

SEQ ID NO: 62652 - DNA, 590 bp, Homo sapiens
  misc_feature: GYAE6OF01DC6V5.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgtgacgcagccgccctcagtgtctgcggccccaggacagagggtcaccgtctcctgctctggaagcgcctccaacattggcacgaattatgtatcctggtaccagcacttcccggacacgcccccaaactcctcatctatgaagtattttacgcgaccctcagggacttcctggccgtattctctgctcaagtcaggcacctctcgcccacccgtggacactccgaaccgggtctccgaggaacccggggacgacggccgtaatttacttactcgcgacaaacgttcgggaactaccaaactgacgttggttcgggtccgtttcgggcgggaagggtacgttaaacggttcgaacccgttccgtacgtcacgacccgaaggcctcgcccccgtggtccacttcgtcgtccccaccctcctccaactctactcgacctgacgcggctcgg

SEQ ID NO: 62653 - DNA, 545 bp, Homo sapiens
  misc_feature: GYAE6OF01DVDC4.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtaccagccacttccccgggacagcccccaaaatcctcatctatgaagattttacgcgaccctcagggattcctggccgattctctggctccaagtcaggcacctctgccaccctggacatcaccggctccagaccgggacgaggccgattatactgcgcaacttggactcaactgactgttgggctttggcgaggactagtgaccgtcctacgtctacgcccgaaggcctacgccccgtcggtccaccgttctacggttccccgcccttccctccactacctagtcgctagacgtcggctcggg

SEQ ID NO: 62654 - DNA, 149 bp, Homo sapiens; identical to SEQ ID NO: 62631
  misc_feature: GYAE6OF01BVR34.10.86.H09.1.454.CMB.1.raw
  modified_base (149)..(149): a, c, t, g, unknown or other
  misc_feature (149)..(149): n is a, c, g, or t

SEQ ID NO: 62655 - DNA, 778 bp, Homo sapiens
  misc_feature: GYAE6OF01B58LV.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtaccagcaccgttccccgggacacgcccccaaactcctcatctatgaagtattttacgcgaccctcgaggattcctggccgattctctcggctccaagtcacggctacctctcgccctacccgtggaccagttccgaccgggtctcccgaacgggacccggggacggacgggccgtaatttacgttacgtcgtcgaccgtaacgtttacgggaaccttacccaaacccgttggaaccgttgggttcgggggtccgttttcggggaccgggtaacgggtaacgtttaaacgggttcggtaaccccggttacccgtacccggttaccgaaccggtaccccgtaaacgggtccccgttaccggtcccccccccggttacgggttaccccgtaacccgtttccccgtttacccggtttcccccccgtaaccccccgtttacccccgttacccccttaaacccgtttaacccgtttaaccgtttacccggtacccgtttacggggaacccgggtcccggggggtaccgttaaccccgggggg

SEQ ID NO: 62656 - DNA, 534 bp, Homo sapiens
  misc_feature: GYAE6OF01CCZ0W.10.86.H09.1.454.CMB.1.raw
  modified_base (231)..(231): a, c, t, g, unknown or other
  misc_feature (231)..(231): n is a, c, g, or t
tcagcatagtagtgcacgaccggtgctcgatttagtgctatagacttgggtttggggactcgggacaatcttcatcatgacctgctccctctcctcctctcccttctcattcactgcacagggtcctgggcccagtctttgttgacgcagccgccctcagtgtctgcggccccaggacagagggtcaccgtctcctgctctggaagcgcctccaacattggcacgaattangtatcctggtaccagcacttcccgggacagccccaaactcctcatctatgaagattttacgcgaccctcagggactcctggccgattctctggctccaagtcaggcacctctgccacctggacatcacggctccaggaccggggacgaggccgattatactgcgcaacgtgggactccaactgactgttgggctttcggcggaggactaagtgaccgtcctacgtcgagcccaaggctacgcccctggtcaccgtctcgttcccaccctcctcccactacctatcgctgacgtcgggctcggg

SEQ ID NO: 62657 - DNA, 192 bp, Homo sapiens
  misc_feature: GYAE6OF01BYL64.10.86.H09.1.454.CMB.1.raw
  modified_base (192)..(192): a, c, t, g, unknown or other
  misc_feature (192)..(192): n is a, c, g, or t
tcagcatagtagtgcacgaccggtgctcgatttagtgctatagacttgggtttgggactccaacctgactgttggggctttcgacggagggactaagttgaccgtcctacgtcagcccaaggctgccccctcggtcactctgttcccgccctcctccactactatgctgagcgggctggcaaggcgcatagn

SEQ ID NO: 62658 - DNA, 536 bp, Homo sapiens
  misc_feature: GYAE6OF01AVUTK.10.86.H09.1.454.CMB.1.raw
  modified_base (505)..(505): a, c, t, g, unknown or other
  misc_feature (505)..(505): n is a, c, g, or t
  modified_base (511)..(511): a, c, t, g, unknown or other
  misc_feature (511)..(511): n is a, c, g, or t
  modified_base (522)..(522): a, c, t, g, unknown or other
  misc_feature (522)..(522): n is a, c, g, or t
  modified_base (524)..(524): a, c, t, g, unknown or other
  misc_feature (524)..(524): n is a, c, g, or t
  modified_base (532)..(532): a, c, t, g, unknown or other
  misc_feature (532)..(532): n is a, c, g, or t
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtaccagcacttccccgggacacgcccccaaactcctcatctatgaagattttacgcgaccctcagggacttcctggccgattctctgctcaagtcaggcacctctcgccaccctggacatcaccgggctccgaggacccggggacgaggccgattactactgcgcaacttcgggactccaactgacgtggttgggtctttcggcggaggactaaggtgacccgtctacgtcagcccaagctcgcccctggtcactctcgtcccncctccncactactctcncngacgcggntcgg

SEQ ID NO: 62659 - DNA, 569 bp, Homo sapiens
  misc_feature: GYAE6OF01EKJWD.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtaccagcaccgttccccgggacacgcccccaaactcctcatctatgaagtattttacgcgaccctcgacgggtactttccgtggccgtattctctggctccaagtcaggcacctctcgcccaccctggacatccgaccggctacccgaggacccggggacgacggccgtattactacgtgcgactaacgttggacctccgaacctgacttggttcgggctttcgggcggtaggtactaagttcgaccgtcctacgtcacgcccagcctcgccccgtcggtcacctctcgtcccaccctcctccactacactcgctgacgcggcgtcgg

SEQ ID NO: 62660 - DNA, 698 bp, Homo sapiens
  misc_feature: GYAE6OF01DRUG9.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgccggccccaggacagaggtcaccgtctcctgctctggaacgcgcctccaacattggcacgaattatgtactcctggtaccagccaccgttccccgggacacgcccccaaactcctcatctatgaagtattttacgccgaccctcgacgggtacttccgtcggccgtatttcctcgtcggtcctacctaaaggtccaacggcctacccttcgtcgcccctaacccgtcggaacctactccgaaccggcctacccgaacgggacccggggacgacgggtccgtaatttacgttacgtcggccgactaacgttcgggaacctacctaaccgttagaccgttcggttcgggtcgtttcgggacggtaacgggtacgttaacggttcgacccgttaccgttaccgtcgtacggtacccgaaggtcccgtccggaccccccgttcggtaccctaccgttcccgttaccgttccccctacccttcccctaccctaccttaacctacgtcgtaccgtcggacggtccgggtcgtacggg

SEQ ID NO: 62661 - DNA, 554 bp, Homo sapiens
  misc_feature: GYAE6OF01CUYVP.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtaccagcacttcccgggacagccccaaactcctcatctatgaagattttacgcgaccctcagggattcctggccgattctctggctccaagtcaggcacctctgccaccctggacatcaccggctccgagaccgggacgaggccgattacgttactcgcgacaacgttcgggactccaaacctgactggttcgggctttcggcggagggtactaaggttgacccgtctaccgtcagtcccgaagcctcgccccctggtccacgtcctcgttcccacccttcctccctactactactcgctgacgcggtctcgg

SEQ ID NO: 62662 - DNA, 583 bp, Homo sapiens
  misc_feature: GYAE6OF01D6KAE.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtaccagcacttccccgggacacgccccaaactcctcatctatgaagattttacgcgaccctcagggattcctggccgattctctggctccaagtcaggcacctctcgccaccctggacatccgaccgggctccgaggacccggggacgacggaccgatttaacttaccgtggaccgctaaacgttcgggaactcccaaacctggacttgggtttcggggctttcgggcgggaacgggtacttaaggttcgaacccgttcctaacgtcacgcccaaggcctcgcccctcggtcacctctcgttccccacctccctccactactatcgctggacgcgggctcgg

SEQ ID NO: 62663 - DNA, 543 bp, Homo sapiens
  misc_feature: GYAE6OF01A3KSS.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtaccagcacttccccgggacacgcccccaaactcctcatctatgaagattttacgcgaccctcagggattcctggccgattctctggctccaagtcaggcacctctgccaccctggacatccaccggctaccgagaccggggacaggccgattacttactgcgcaacgttgggactccaacctgactgttgggctttcggcggagggactaagttgaccgtcctacgtcacgcccaaggctcgccccctcggtcacctctcgttcccaccctcctcccactacactcgctgcgcgggctcgg

SEQ ID NO: 62664 - DNA, 529 bp, Homo sapiens
  misc_feature: GYAE6OF01DZB4G.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtaccagcacttccccgggacagcccccaaatcctcatctatgaagattttacgcgaccctcagggattcctggccgattctctggctccaagtcaggcacctctgccaccctggacatcaccgggctccaggaccggggacaggccgattattactgcgcaacttgggactccaactgactgttgggctttcggcggaggactaagtgaccgtctacgtcagcccaaggctcgcccctggtcactctcgttcccaccctctccactactactcgctgacgcggctcgg

SEQ ID NO: 62665 - DNA, 400 bp, Homo sapiens
  misc_feature: GYAE6OF01CZMB1.10.86.H09.1.454.CMB.1.raw
  modified_base (396)..(400): a, c, t, g, unknown or other
  misc_feature (396)..(400): n is a, c, g, or t
tcagcatagtagtgcacgaccggtgctcgatttagtgctatagacttgggtttggaagcgcctccaacattggcacgaattatgtatcctggtaccagcacttccccgggacagcccccaaactcctcatctatgaagattttacgcgaccctcagggattcctggccgattctctggctccaagtcaggcacctctgccaccctggacatcaccgggctccagaccggggacgaggccgattatactgcgcaacttgggactcaacctgactgtgggctttcggcggagggactaagttgaccgtcctacgtcagcccaaggctcgccccctcggtcactctgttcccgccctcctccactacctatgctgacgcgggctggcaaggcgcatagnnnnn

SEQ ID NO: 62666 - DNA, 568 bp, Homo sapiens
  misc_feature: GYAE6OF01AZCU1.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtaccagcacttccccgggacacgccccaaactcctcatctatgaagattttacgcgaccctcagggtattcctggccgattctctgctccaagtcaggcacctctcgccacctggacactcaccgggctccaggacccggggacgacggccgattacttacgtgccgctaacgttgggacctccgaacctgactggttcgggctttcgggcggtagggactaagttcgaccgtcgtacgtcgacgcccaaggcctcgccccctcggtccacctccgtcgttccccacccttcctcccactacctactcgctaggacgcgggtctcgg

SEQ ID NO: 62667 - DNA, 586 bp, Homo sapiens
  misc_feature: GYAE6OF01AI4ZC.10.86.H09.1.454.CMB.1.raw
  modified_base (546)..(546): a, c, t, g, unknown or other
  misc_feature (546)..(546): n is a, c, g, or t
  modified_base (566)..(566): a, c, t, g, unknown or other
  misc_feature (566)..(566): n is a, c, g, or t
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtaccagcaccttccccgggacagcccccaaactcctcatctatgaagattttacgcgaccctcagggattcctggccgattctctggctccaagtcaggcacctctgcccaccctggacatccaccgggctcccgagggacccggggacgacgggcccgaatttacttacgtgccgccaacgtttcggggaaccttcccaacctgacgttggttcggggcttttcgggcgggagggtacttaaggttcgacccgtcctacgtcacgcccaaggcctcgccccctcggtccactcctcgttccccncccttccctccctactactntcgctggacgcgggctcggg

SEQ ID NO: 62668 - DNA, 529 bp, Homo sapiens
  misc_feature: GYAE6OF01B7H88.10.86.H09.1.454.CMB.1.raw
  modified_base (498)..(498): a, c, t, g, unknown or other
  misc_feature (498)..(498): n is a, c, g, or t
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaatttatgtatcctggtaccagcacttccccgggacagccccaaaactcctcatctatgaagtattttacgcgaccctcagggattcctggccgattctctggctccaagtcaggcacctctgccaccctggacatcaccggctccgagaccggggacgacggccgtattatactgcgcaacgttggactcaactgactgttgggctttcggcggaggactaagtgaccgtcctagtcagcccaaggctcgccccgtgtcactctcgtcccncctcctccactactactgctgcgcggctcgg

SEQ ID NO: 62669 - DNA, 526 bp, Homo sapiens
  misc_feature: GYAE6OF01DCM2B.10.86.H09.1.454.CMB.1.raw
  modified_base (310)..(310): a, c, t, g, unknown or other
  misc_feature (310)..(310): n is a, c, g, or t
  modified_base (392)..(392): a, c, t, g, unknown or other
  misc_feature (392)..(392): n is a, c, g, or t
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtaccagcacttcccgggacagccccaaactcctcatctatgaagattttacgcgacctcagggattccngccgattctctggctccaagtcaggcacctctgccaccctggacatcacggctcagaccgggacgaggccgattatactgcncaacttgggactccaacctgactgttgggctttcggcggaggactaagtgaccgtcctacgtcagcccaaggctcgccccctggtcactctcgttcccaccctcctccactactactgctgacgcgggctcggg

SEQ ID NO: 62670 - DNA, 590 bp, Homo sapiens
  misc_feature: GYAE6OF01DH8ZH.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagcccgccctcagtgtctgcggccccaggacagagggtcaccgtctcctgctctggaagcgcctccaacattggcacgaattatgtatcctggtaccagcacttccccgggacacgcccccaaactcctcatctatgaagtattttacgcgaccctcgagggtacttccgtggccgattctctggctccaagtcaggcacctctgccacctgacatccgaccggctccgaggacccggggacgacggaccgtatttaagttacgtgccgacaacgttgggacctccgtaaacctgacttggttcgggtctttcgggcggtagggacttaagttcggacccgttccgtacgtcacgacccgaaggcctccgccccgtcggtcctacctctccgttccccacccttccctcccacttactatcgctggacggcgggtctcggg

SEQ ID NO: 62671 - DNA, 877 bp, Homo sapiens
  misc_feature: GYAE6OF01CRHQ7.10.86.H09.1.454.CMB.1.raw
tcagcatagtagtgcacgaccggtgctcgatttagtgctatagacttgggtttggggactcgggacaatcttcatcatgacctgctccctctcctcctctcccttctcattcactgcacagggtcctgggcccagtctttgttgacgcagccgccctcagtgtctgccggccccaggacaggacgggtcaccgtctcctgctcgtggaacgccgacctccaaactagtttcgggacctaacggtaaatttatggttaacttcccgtagggtaacccaggcctaacccgttacccccggggaacaaccggacccccaaaaacttccctactaacttacctaagtagaaacgttacttttaacggccgtaacccctcgaacgggtacttccgtcggacccgtatttcctcgtcggtcctaccgaaacggtccgaacggtcctaccgtccgttacgacccctacccgtacgggaaccacgtaccccggaacccgggtcctacccggaacgggaacccggggggaactaccggggacccgttaaagtttaacgttaaccgtcggaccggtaaccgttaaaccgttacggggtaaccttacccccgtaaaccggttacgggttaaccggtttggggtttacgggggttacccgtttccgggggaccggggtaaacgggttaacgttaaaccgggtttccggtaaccccggttaccgttaaccggttaccggaaccggtaaccccgtaagggtcccgtcccggtaccccccggttcggttacccacccgtttccgttaccccggttcccccgtccccttacccctaccccgttaccttaaccgttcgttccgacgttacgggccgggtccgggcgtaaccggg

SEQ ID NO: 62672 - DNA, 599 bp, Homo sapiens
  misc_feature: GYAE6OF01EHNTL.10.86.H09.1.454.CMB.1.raw
  modified_base (564)..(564): a, c, t, g, unknown or other
  misc_feature (564)..(564): n is a, c, g, or t
  modified_base (593)..(593): a, c, t, g, unknown or other
  misc_feature (593)..(593): n is a, c, g, or t
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgccggccccaggacaggagggtcaccgtctcctgctcgtggaagccgcctaccaacattggacacgtaattatgtatcctggtaccagctaccgttcccgggacacgacccccaaactcctacatctatagaacgtattttaccgccgaccctcgacgggtacttccgtggcccgtattcctcgtcggcctccgaagtccacggccaccttctcgacccacccgtcggacacgtccgaccggcctacccgacggaccggggacgacggccgtattacttacgtgacacgtaacgttcggacctaccgaactgacgttggttcgggtcgtttcgggcggaggtactagtcgaccgtctacgtcacgacctaggcctcgcccgtgctactcttcgtcccnccctcctccactcactcgctgacggcggngtacgg

SEQ ID NO: 62673 - DNA, 615 bp, Homo sapiens
  misc_feature: GYAE6OF01DH6R7.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtaccagccacgttccccgggacacgcccccaaactcctcactctatgaagtacttttacgccgacccctcgagggtacttccgtggcccgtatttcctctggcctccaagtcacggcacctctcgccaccctggacacgtccgaccgggctcccgaaggacccggggacgacgggccgtaatttacttacgtgccgacaacgtttcgggaacctccgaaccgttgacgttggttcggggccttttcgggcgggtaggtacgttaagttcgacccgtccttacgcgtaacgcccgaaggtcctacgcccccgttcggtccaccgttctcgttccccacccttcctccacttactatcgctggacgcgggctacgg

SEQ ID NO: 62674 - DNA, 546 bp, Homo sapiens
  misc_feature: GYAE6OF01CPODW.10.86.H09.1.454.CMB.1.raw
  modified_base (326)..(326): a, c, t, g, unknown or other
  misc_feature (326)..(326): n is a, c, g, or t
  modified_base (512)..(512): a, c, t, g, unknown or other
  misc_feature (512)..(512): n is a, c, g, or t
  modified_base (541)..(541): a, c, t, g, unknown or other
  misc_feature (541)..(541): n is a, c, g, or t
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtaccagcacttccccgggacacgcccccaaactcctcatctatgaagtattttacgcgaccctcagggtattcctggccgattcnctgctccaagtcaggcacctctcgccaccctggacatcgaccggctccgaggaccggggacgaggccgtattacttactgcgctaacgttgggactccaaactgactggttcgggtctttcggcggagggactaagttgaccgtctacgtcacgccaagctcgcccctcggtcactctcgttcccnccctcctccactactactcgctgagcggngtcgg

SEQ ID NO: 62675 - DNA, 741 bp, Homo sapiens
  misc_feature: GYAE6OF01DOBL4.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctcgtggaagccgcctccaacattggcaacgtaattatgtatccgtggtaccagcctaccgttccccgggacacgacccccaaactcctcatctatgaatatttaccgcgaccctcgagggtacttccgtggcctattcgtctggctccaagtcaggcctacctctcgaccctacccgtggaccatccgaccgggctacccgaagggacccggggacgacggacccgtaattacttacgtcggaccgacgtaacgttcgggaacctacccaaccgttggaccgttgggtttcggggtccggttttcggggaccgggtaacgggttaacttaacgggttcggtaacccggttacctaccggtaccgaaccggaccccgtaagggtcccgtacccgtccccccgttacgggttcccctaccgtttcccgttacccggtttaccccccctaaccccccgttccccccgtaaccgtttaacccgttaacccgttcggtacccggttaccgggaccgggtccccgggggtaccttcggggaaccccgg

SEQ ID NO: 62676 - DNA, 401 bp, Homo sapiens
  misc_feature: GYAE6OF01CX88O.10.86.H09.1.454.CMB.1.raw
  modified_base (386)..(386): a, c, t, g, unknown or other
  misc_feature (386)..(386): n is a, c, g, or t
  modified_base (393)..(401): a, c, t, g, unknown or other
  misc_feature (393)..(401): n is a, c, g, or t
tcagcatagtagtgcacgaccggtgctcgatttagtgctatagacttgggtttggaagcgcctccaacattggcacgaattatgtatcctggtaccagcacttccccgggacagcccccaaactcctcatctatgaagattttacgcgaccctcagggattcctggccgattctctggctccaagtcaggcacctctgccaccctggacatcaccgggctccagaccggggacgaggccgattatactgcgcaacttgggactccaactgactgtgggctttcggcggaggactaagtcgacgtctacgtcagcccaaggctgcccctggtcactctcgtccccaccctcctccattacctatgctgacgcgggctgggcaaggcncagtagnnnnnnnnn

SEQ ID NO: 62677 - DNA, 542 bp, Homo sapiens
  misc_feature: GYAE6OF01AY1DM.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtaccagcacttccccgggacacgcccccaaactcctcatctatgaagattttacgcgaccctcagggattcctggccgattctctggctccaagtcaggcacctctgccaccctggacatcaccgggctccgaggaccggggacgacggccgattacttactgcgcaacgttgggactccaacctgacgtgttgggctttcggcggacgggactaagttgaccgtctacgtcagccaaggctcgcccctggcactctcgttccccaccctcctcccactactactcgctgcgcgggctcgg

SEQ ID NO: 62678 - DNA, 674 bp, Homo sapiens
  misc_feature: GYAE6OF01C0NYA.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagccgcctccaacattggcacgaattatgtatcctggtaccagcacttccccgggacacgcccccaaactcctcatctatagaagtattttacgcgacccctcgagggtacttccgtcggccgtattctctggctccaagtcaggcacctctcgcccaccctggacatccgaccgggctaccgacggacccggggacgacgggccgtattacttacgtcggaccgactaacgttcgggaccttaccgaaacccgttggaccgttgggtttcggggtccgtttcgggacgggtaacgggtaacttaacgggttcggaacccgttccgtaaccggtccgacgacccgaacgggtcctccggccccccgttcggtcctacccgttccgttcccggttcccccgtccccttccccttaccctaacccgttaccttacgtcggtacccgtggaccgggtccggggtcgtacggg

SEQ ID NO: 62679 - DNA, 549 bp, Homo sapiens
  misc_feature: GYAE6OF01BNRTY.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtaccagcacttccccgggacacgcccccaaactcctcatctatgaagattttacgcgaccctcagggattcctggccgattctctggctccaagtcaggcacctctcgccaccctggacatcaccgggctccgaggaccgggacgaggccgattatactgcgcaacgttgggactccaacctgacgtggttcggggctttcgggcggagggtactaaggttcgaccgtcctacgtcagcccaaggcctcgcccctcggtccactctcgttcccacccttcctccactactactcgctgcgcggctcgg

SEQ ID NO: 62680 - DNA, 402 bp, Homo sapiens
  misc_feature: GYAE6OF01C7XGG.10.86.H09.1.454.CMB.1.raw
  modified_base (249)..(249): a, c, t, g, unknown or other
  misc_feature (249)..(249): n is a, c, g, or t
  modified_base (395)..(402): a, c, t, g, unknown or other
  misc_feature (395)..(402): n is a, c, g, or t
tcagcatagtagtgcacgaccggtgctcgatttagtgctatagacttgggtttggaagcgcctccaacattggcacgaattatgtatcctggtaccagcacttccccgggacagcccccaaactcctcatctatgaagattttacgcgaccctcagggattcctggccgattctctggctccaagtcaggcacctctgccaccctggacatcaccgggctccagaccggggacgaggccgattattacngcgcaacttgggactccaacctgactgttgggctttcggcggagggactaagttgaccgtcctacgtcagcccaaggctgcccctggtcactctgtccccgccctcctccactactatcgctgagcgggctggcaaggcgcatagnnnnnnnn

SEQ ID NO: 62681 - DNA, 739 bp, Homo sapiens
  misc_feature: GYAE6OF01BPPKX.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtaccagccacttccccgggacacgcccccaaactcctcatctatgaagtattttacgcgacccctcgagggtacttccgtggccgatttctctggcctccaagtcaggcacctctgcccaccctggacatccgaccgggcctccgacggacccggggacgacgggccgtaatttacttaccgtggccgactaaaccgtttcgggaacctaccctaaacccgttcgtaaccgtttgggtttcgggggtcccgttttaccggggcggggtaacggggtaaccgttaaagggtttcggaacccggttacccgttaaccggtccgtaacgggtcccccgaaacggggtcccttaccgggtaccccccccgttccggggttaccctacccgttcccgttacccggtttcccccccgtaacccccgtttccccctacccccgtaaccttaacccgttacgttccggtacccttacgggaaccgggtccggggtccgtaccgggg

SEQ ID NO: 62682 - DNA, 868 bp, Homo sapiens
  misc_feature: GYAE6OF01CZRPP.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagaggtcaccgtctcctgctctggaacgcgcctccaaacattggcaacgtaattatgtactccgtaggtaccagccacttccccgggacacgccccaaatcctcatctatgaagtatttacgcgtaccctcgagggtacttccgtcggccgtatttctcgtcggaccttaccgaacgtccgacggcctaacctcgtcgccctacccgtggactaacgtcccgaccgggtcctaccgaacggacccggggaacgacggtacccgtaatttaacgttaccgtcggtaccgtaacgtaacggttcgggaacctacccgtaaaccgttcggtaacgtttcggggtttacggggttaccgttttaccggggaccggggtaaacgggttaacccgtttaaacgggtttccgggtaaaccccggtttacccggttaaccgggttacccgtaaaccgggtaacccccgtaaacggggttccccttaccccggggtaccccccccgtttacgggttacccccgtaaacccgttttcccggtttacccccggtttcccccccgggtaccccccttttacccccggtttaacccccgttaaaccgtttaaaccccgttaaccgggtttccccgggttacccggttaacccggggtttaaacccggggtccccggggggttccccgttaaaccccgggggg

SEQ ID NO: 62683 - DNA, 649 bp, Homo sapiens
  misc_feature: GYAE6OF01AMZL2.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtaccagcaccgttccccgggacacgcccccaaactcctcatctatgaagtacttttaccgcgacccctcgagggtacttccgtggccgtattcctcgtggcctccaagtcacggcacctctcgcccacccgtggaccagtccgaccgggcctcccgacgggtacccggggacgacggcccgtaagtttacgttacgtcggccgtaccgtaaacgtttcggggaaccttacccaaaccgttggtaaccgttgggtttcggggtccttttcggggacgggtaacgggtacttaacggttcgaacccgttccgtacggtcacggaccccaaggtcctcgcccccgtggtccaccgttcctccgttccccacccttcctcccacttactgtcgctaggacgccggtctcggg

SEQ ID NO: 62684 - DNA, 809 bp, Homo sapiens
  misc_feature: GYAE6OF01D11C4.10.86.H09.1.454.CMB.1.raw
tcagcatagtagtgcacgaccggtgctcgatttagtgctatagacttgggtttggggactcgggacaatcttcatcatgacctgcctcccctctcctcctctcccttctcattcactgcacagggtcctgggcccagtctttgttgacgcagccgccctcagtgtctgcggcccaggacagaggtcaccgtctcctgctctggaacgccgcctccaacagttcggactaacgtaaatttatgtactcctaggtaccagcctaccgttccccgggactacgcccccaaactcctctatctatagaagtacttttacgcgtaccctcgagggtacttccgtggccgtattcctcgtcggcctaccgaagtcaggcacctctcgcccaccgtgacactccgaccggctaccgaggaccggggacacgggaccgtaatttacgttacgtcgaccgacgtaaccgttacgggtaacctacccgtaaaccgttcggtaccggtttcgggtttaccgggggtccgttttaccggggaccggggtaacggggttaaccgttaaacgggtttaccggtaaccccgggtttacccgttaaccggtacccggtaacccgggtaacccccggtaaacgggtccccgttaccccgggtacccccccgtttacggggtaccccttaacccggttccccggtttccccggtttacccccccggttcccccgttacccccgttaccccgtaacccgtttaacccgtttacggttccggtacccggttacggggtacccgggtcccgggggtccggtacccggggg

SEQ ID NO: 62685 - DNA, 588 bp, Homo sapiens
  misc_feature: GYAE6OF01CSCVF.10.86.H09.1.454.CMB.1.raw
  modified_base (286)..(286): a, c, t, g, unknown or other
  misc_feature (286)..(286): n is a, c, g, or t
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgcctcagtgtctgcggcccaggacagagggtcaccgtctcctgctctggaagcgcctccaacattggcacgaattatgtatcctggtaccagcacttccccgggacagcccccaaactcctcatctatgaagnttttacgcgaccctcagggattcctggccgattctctggctccaagtcaggcacctctgccaccctggacatcgaccgggctccgagaccggggacgacgggccgtattacgttactgccgcaaacgttgggaccttccgaaacctcgacttggtttcggggcttttcgggcgggtaaggggtacttaaagggtttgacccggtccttacggtcacggccccaagggcctcggcccccttcgggtccaccttctcgttccccacccttccctcccaccttactatgctgacgcgggctcggg

SEQ ID NO: 62686 - DNA, 910 bp, Homo sapiens
  misc_feature: GYAE6OF01DQHKJ.10.86.H09.1.454.CMB.1.raw
  modified_base (886)..(886): a, c, t, g, unknown or other
  misc_feature (886)..(886): n is a, c, g, or t
tcagcatagtagtgcacgaccggtgctcgatttagtgctatagacttgggtttggggactcgggacaatcttcatcatgacctgctcccctctcctccctctcccttctctattcactgcacgacgggtcctcgggccctagttctttgttcgaccgcacgccccgccctacgtaggttcgtcgtcggccccgggacccccgaagggaccgaaggggtacggggttacccctaacccggtttcccttcccgtcggtaccttccggtaaggggaaaccgccccgtccccttaacccgaaaacttacggttccgggaaccaaaacggttaaatttacgttacggttacctcccggttacgggtaaacccacggtacccttaacccggttacccccgggaaccaacccggaacccccctaaaacttccctactacttactaagtaacgtaagttaacgttttaccgacccgtaaccccttacggaacgggttaccttccggtcggtacccttacgtttccgtcggtaccggtacccttaaccgtaacgtccggaacggtccctaacccgttcgtaccgtacccctaacccggtaggaacctacgtacccgggacccggtccgtacccgaacggggacccggggaacgaccgggacttagtttaacgtcgtcgaccgtactaaccggttcggaccctaccgtaaccgtcggtacggttgggttccgggttacgttcggggacgggtaaggtaccgttaaggttcccgaacccgtttccgtacggtaccgaccgaccgaacggtccgtccccggtccccgtacggtcctaccgttcccggttcccgttccccgtcccctccctacctaacccgttactccggtcgtaccgngggtacgggccgggtgtaaccggg

SEQ ID NO: 62687 - DNA, 549 bp, Homo sapiens
  misc_feature: GYAE6OF01BQRE7.10.86.H09.1.454.CMB.1.raw
  modified_base (505)..(505): a, c, t, g, unknown or other
  misc_feature (505)..(505): n is a, c, g, or t
  modified_base (517)..(517): a, c, t, g, unknown or other
  misc_feature (517)..(517): n is a, c, g, or t
  modified_base (532)..(532): a, c, t, g, unknown or other
  misc_feature (532)..(532): n is a, c, g, or t
  modified_base (535)..(535): a, c, t, g, unknown or other
  misc_feature (535)..(535): n is a, c, g, or t
  modified_base (544)..(544): a, c, t, g, unknown or other
  misc_feature (544)..(544): n is a, c, g, or t
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtaccagcacttccccgggacagcccccaaactcctcatctatgaagattttacgcgaccctcagggattcctggccgattctctggctccaagtcaggcacctctcgccacccgtggacacgtccgaccgggctcccgaggacccggggacgacggccgtattacttacgtgcgactaacgttgggacctccaacctgactggttgggctttcgggcggaggactagtcgaccgtcctacgtcagccaggctcgcccctggtcncttctcgtcccncctcctccactactntcnctgcgcggngtcgg

SEQ ID NO: 62688 - DNA, 755 bp, Homo sapiens
  misc_feature: GYAE6OF01BGA8V.10.86.H09.1.454.CMB.1.raw
  modified_base (363)..(363): a, c, t, g, unknown or other
  misc_feature (363)..(363): n is a, c, g, or t
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagccgcctccaacattggcacgaattatgtatcctggtaccagcaccgttcccgggacacgccccaaactcctcatctatagaagtattttaccgccgaccctcgacgggtacttccgtggccgtatttcctcgtggcctccaagtcaggccacctcncgccaccgtgacactccgaccggctccgacggacccggggacgacgggccgtatttacgttacgtcgccgtactaaaccgtttacggggaccttacccgaaacccgttggtaaccgttgggtttcgggggtccgttttccggggacgggtaacgggtaacgttaacgggttcggtaacccggttcccgttaaccggtccgtaaccggaccccgtaaacgggtcccttacccgggtcccccccgttcggggttacccctacccggttcccgtttaccccggtttcccccccgtccccccgtttacccccgtttacccccgtaacccgtttaaccctttaacgttccggtacccgttacgggaacccggggtcccggggtcccgtaaccggggg

SEQ ID NO: 62689 - DNA, 549 bp, Homo sapiens
  misc_feature: GYAE6OF01C83WL.10.86.H09.1.454.CMB.1.raw
  modified_base (515)..(515): a, c, t, g, unknown or other
  misc_feature (515)..(515): n is a, c, g, or t
  modified_base (545)..(545): a, c, t, g, unknown or other
  misc_feature (545)..(545): n is a, c, g, or t
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagccgcctccaacattggcacgaattatgtatcctggtaccagcacttccccgggacacgcccccaaactcctcatctatgaagtattttaccgcgacccctcagggacttccgtggccgattctctggctccaagtcacggcacctctgcccacctggacatcaccgggctccgaggaccggggacagggccgattacgttacctgccgcaacgttcgggacctccaactgactggttcgggctttcggcggaggactagttcgaccgtctacgtcagcccaggctcgcccctggcactctcgttcccncctcctccactactatcgctgacgcgggtntcgg

SEQ ID NO: 62690 - DNA, 724 bp, Homo sapiens
  misc_feature: GYAE6OF01ERNQZ.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagttctttgttgacgcacgccgccctcagtgtctgccggccccaggacaggagggtccaccgtctcctgctcgtggaacgccgcctaccaactagttcggacaacggtaaatttagtacgttactccgtaggtaccacgtcctacccgttccccgggaacaccgaccccaaactcctacactctatagaacgtactttaccgcgtacctgacgggtacttccgtggtccgtattcctcgtcggcctacgtaacgtcgacggtccacctcctcgacccacccgtaggactacgtccgacccggtcctaccgacgggacccggggacgacggacttattacgtcgtcgaccgtactaacgttcggacctaccgacgtcgtacgttcgggttcgggtccgttcgggacgggtacggtaacgttacggtacgtaccgtaccgtaccggtaccgaccgtacccggtaacggtcccgtaccggtcccccgttcggtcccttaccgtcccgttacccgttacccccgtacccccttaccctaccctaaccttaaccgtacgtccgtacgtacgggaccgggtccggtcggtaccggg

SEQ ID NO: 62691 - DNA, 586 bp, Homo sapiens
  misc_feature: GYAE6OF01EDH1Z.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagccgcctccaacattggcacgaattatgtatcctggtaccagccacttccccgggacacgcccccaaactcctcatctatgaagtattttacgcgaccctcagggtacttcctggccgtattctctggctccaagtcaggcacctctgccaccctggacatccgaccgggctccgaggaccggggacaggccgtaattacttacgcggcgacaaacgtttgggacctaccaactcgacgttggttcggggtcgtttcgggcggagggtaacctaagttcggaaccgtcctacgtccgaagcccaaggcctccgcccctggtccacctcttccgtccccacccttccctaccactacctagtcgactagcgtcggcgtcgg

SEQ ID NO: 62692 - DNA, 148 bp, Homo sapiens
  misc_feature: GYAE6OF01DJN5P.10.86.H09.1.454.CMB.1.raw
  modified_base (148)..(148): a, c, t, g, unknown or other
  misc_feature (148)..(148): n is a, c, g, or t
tcagcatagtagtgcacgaccggtgctcgatttagtgctatagacttgggtttggggaccgtcctacgtcagcccaaggctgccccctggtcactctgttcccaccctcctccactactatgctgagcgggctggcaaggcgcatagn

SEQ ID NO: 62693 - DNA, 412 bp, Homo sapiens
  misc_feature: GYAE6OF01B8Q11.10.86.H09.1.454.CMB.1.raw
  modified_base (397)..(412): a, c, t, g, unknown or other
  misc_feature (397)..(412): n is a, c, g, or t
tcagcatagtagtgcacgaccggtgctcgatttagtgctatagacttgggtttggaagcgcctccaacattggcacgaattatgtatcctggtaccagcacttccccgggacagcccccaaactcctcatctatgaagattttacgcgaccctcagggattcctggccgattctctggctccaagtcaggcacctctgccaccctggacatcaccgggctccagaccggggacgaggccgattattactgcgcaacttggactccaacctgactgttgggctttcggcggagggactaagttgaccgtcctacgtcagcccaaggcctgccccctcggtcactctgttccccgccctcctccactactatgctgacgcgggctggcaaggcgcatgnnnnnnnnnnnnnnnn

SEQ ID NO: 62694 - DNA, 662 bp, Homo sapiens
  misc_feature: GYAE6OF01CBEFK.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagccgcctccaacattggcacgaattatgtatcctggtaccagcacttccccgggacagcccccaaactcctcatctatgaagattttacgcgaccctcagggattcctggccgattctctggctccaagtcaggcacctctgccacctggacatccaccggctcccaggacccggggacgacgggccgagttaacttacgtgccgacaaaccgttgggacctcccgaaacccttggaaccgttcggtttcggggtcttttccggggcgggtaagggtaccgttaaaggtttcggacccgttcccgttaacccggtaccgaacggaccccaaagggtccctacccggccccccgttcgggtaccctaccgttccgttccgtttcccccgacccccttccccttacccacccgtttactaacgttcgaccctaggaaccggtccggggtctaccgggg

SEQ ID NO: 62695 - DNA, 677 bp, Homo sapiens
  misc_feature: GYAE6OF01B9CV5.10.86.H09.1.454.CMB.1.raw
  modified_base (354)..(354): a, c, t, g, unknown or other
  misc_feature (354)..(354): n is a, c, g, or t
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagccgcctccaacattggcacgaattatgtatcctggtaccagccaccttccccgggacacgcccccaaactcctcatctatgaagtattttacgcgaccctcgagggattcctggccgtattctcgtggctccaagtcaggcacctcncgcccaccctggacactccgaccgggcctccgacgggacccggggacgacgggccgtattacttacgtcgaccgactaacgttcgggacctacccaaccgtgacgttgggttcggggtccgttttcggggcgggtaacgggtaacgttaaaggttccggaacccggttacccgttacggtaccgtaacggaccccgtaaacggcccgtaccgccccccgttcggtaccctacccgtccgttacccgttcccccctacccctccccttcccctaaccttaaccttacgtcggtccgttaggacgggtcccgggtcgtaccgggg

SEQ ID NO: 62696 - DNA, 567 bp, Homo sapiens
  misc_feature: GYAE6OF01DXOJ6.10.86.H09.1.454.CMB.1.raw
  modified_base (521)..(521): a, c, t, g, unknown or other
  misc_feature (521)..(521): n is a, c, g, or t
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtaccagcacttccccgggacacgcccccaaactccctacatctaatgaaagtacttttacgccgaccctcgaagggacttccgtggccgattctctgctccaagtcaggcacctctcgcccaccctggacatccgaccgggctccgacggaccggggacgacggaccgtattattacgtgcgctaacgttggactaccaactgacttggttcggggtcgtttcgggcggtaggactaagttcgaccgtcctacgtcagcccgaagcctcgcccctcgtcnctctcgtcccaccctcctcactactactcgctgcggcggcgtacgg

SEQ ID NO: 62697 - DNA, 692 bp, Homo sapiens
  misc_feature: GYAE6OF01BXK2D.10.86.H09.1.454.CMB.1.raw
tcagcatagtagtgcacgaccggtgctcgatttagtgctatagactggttttggggactcgggacaatcttcatcatgacctgctcccctctcctcctctcccttctcattcactgcacagggtcctgggcccagtctttgttgacgcagccgccctcagtgtctgcggcccaggacaggagggtcaccgtctcctgctcgtggaagcgcctccaacattggcacgtaattatgtactcctggtaccagcctacgttcccgggacacgccccaaactcctcatctatgaagtacttttacgcgaccctcgagggtacttccgtgggccgtattcctacgtcggtctaccgaagttccacggtccaccttctcgccctaacccgtggaaccacttccgacccggggtcctacccggaacgggacccgggggaaccgacgggtcccgtaagtttacgttactcggaccgacctaacggtttcgggaacctacccgaacccttggtaccgttggtttcggggtccgtttcgggacgggtagggtacgttaaggttcggaacccggttcctaacggtcgtaacgcccgaaggtccgttaccgccccgttcggtcctaaccgtccgttacgttccccctacccttccctacccgtaccttaaccgtacgtcgaccttggaccggtcgggtctacggg

SEQ ID NO: 62698 - DNA, 410 bp, Homo sapiens
  misc_feature: GYAE6OF01APRHR.10.86.H09.1.454.CMB.1.raw
  modified_base (400)..(410): a, c, t, g, unknown or other
  misc_feature (400)..(410): n is a, c, g, or t
tcagcatagtagtgcacgaccggtgctcgatttagtgctatagacttgggtttggaagcgcctccaacattggcacgaattatgtatcctggtaccagcacttccccgggacagcccccaaactcctcatctatgaagattttacgcgaccctcagggattcctggccgattctctggctccaagtcaggcacctctgccaccctggacatccaccgggctccaggaccggggacgaggccgattattactgcgcaacttggactccaacctgactgttgggctttcggcggagggactaagttgaccgtctaggtcagcccaaggctcgcccctggtccactctcgttccccaccctcctccactactatcgctgagcgggctggcaaggcgacatagnnnnnnnnnnn

SEQ ID NO: 62699 - DNA, 653 bp, Homo sapiens
  misc_feature: GYAE6OF01AM4UO.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggcccaggacagaggtcaccgtctcctgctctggaagccgcctccaacattggcacgtaattatgtactccgtggtaccagcctaccgttcccgggacaccgacccccaaactcctcatctatagaagtacttttacgccgacccctcgacgggtacttccgtcggtccgtatttcctcgtcggtcctacccgtaagtccgaacggccctaccgttccgtccgaccctacccgtcggacctacgtccgaccggcctaccgacgggacccggggacgacggaccgtattacgttacgtcgcgactaacgttcggacctccaacctgacgttggttcgggtcgtttcgggacgggtacggtacttaacggtcgtacccgtccgtacgtcgacgtcccgaacggtccgtccgtccccgtcgtcctaccgttccgtcccgttccccgccctccctccctactactactcgtctggacggcggtcgtcgg

SEQ ID NO: 62700 - DNA, 697 bp, Homo sapiens
  misc_feature: GYAE6OF01BSIEE.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggcccaggacagaggtcaccgtctcctgctctggaacgcgcctccaacagttcggacacgtaattatgtatcctggtaccagcctaccgttccccgggacacgccccaaactcctcatctatgaagtacttttacgcgtaccctcgacgggacttcctggccgattctctggctacaagtcacggcacctctcgccaccctggacacgtccgaccggtctccgacggaccggggacgacggaccgtatttacgttacgtcgaccgactaacgttcgggacctccaaaccgttcgacgtcggttagggtccgttttacgggacggtagggtaccttaaggttcggaccgttaccgtacggttccgaacggtccccgaagggtcccgttccgaccccccgttcgggttccctaaccgttcccgttacccggtttcccccggtaccccctttaccccgttcccctaaacccgttaacccgttaccgttacggacccgttacgggaccgggtcccggggtcgttaacccgggg

SEQ ID NO: 62701 - DNA, 709 bp, Homo sapiens
  misc_feature: GYAE6OF01AFVHM.10.86.H09.1.454.CMB.1.raw
  modified_base (318)..(318): a, c, t, g, unknown or other
  misc_feature (318)..(318): n is a, c, g, or t
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagccgcctccaacattggcacgaattatgtatcctggtaccagccacttccccgggacacgcccccaaactcctcatctatgaagattttacgccgaccctcgagggattccnggccgattctctggctccaagtcaggcacctctcgcccaccctggacactccgaccgggctccgacggaccggggacgacgggtcccgtaagttacttacgtcggccgactaaccgttcgggaaccttcccgaaacccgttgaaccgttgggttcggggtccgttttcggggccgggtaacgggtacgttaacggttcgtaaccccggttcccgttaaccggtcgacggaccccgtaagggacccttccggcccccccgttccgggtccctaacccgtttcccgttacccggtttcccccctaacccccgttcccccgttcccctaaacccgtttaccttaaccgttcggtaccgttacgggaccgggtcccgggggtcccttaccggggg

SEQ ID NO: 62702 - DNA, 414 bp, Homo sapiens
  misc_feature: GYAE6OF01AZ6HA.10.86.H09.1.454.CMB.1.raw
  modified_base (392)..(392): a, c, t, g, unknown or other
  misc_feature (392)..(392): n is a, c, g, or t
  modified_base (398)..(414): a, c, t, g, unknown or other
  misc_feature (398)..(414): n is a, c, g, or t
tcagcatagtagtgcacgaccggtgctcgatttagtgctatagacttgggtttggaagcgcctccaacattggcacgaattatgtatcctggtaccagcacttccccggggacagccccccaaactcctcatctatgaagattttacgcgaccctcagggattcctggccgattctctggctccaagtcaggcacctctgccaccctggacatcaccgggctccagaccggggacgaggccgattattactgcgcaacttgggactccaacctgactgttgggctttcggcggagggactaagttgaccgtcctacgtcagcccaaggctgccccctggtcactctgttccccgccctcctccactactatgctgagcgggctggcaaggcncatagnnnnnnnnnnnnnnnnn

SEQ ID NO: 62703 - DNA, 742 bp, Homo sapiens
  misc_feature: GYAE6OF01C80FL.10.86.H09.1.454.CMB.1.raw
  modified_base (232)..(232): a, c, t, g, unknown or other
  misc_feature (232)..(232): n is a, c, g, or t
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattangtatcctggtaccagccacttccccgggacacgtcccccaaaatcctactatctatgaaagtacttttaccgcgtacccctcaagggacttccgtggccggtatttctctcggctccaagtcaggcacctctgccacctggacatcaccggtctccgaggaccggggacacgggaccgtattaacgttaccgtgaccgtactaaacgttcgggaacctaccgtaaaccgtcgaaccgttcgggtttacgggggtccgtttcgggacgggtaacggggtaccttaaacgggtttcgaacccgttacccgttaaccggttaccgaacgtaccccgtaaacgtaacccgttccggaccccccccgtttaggggttaccccaaccgtttcccgttacccggttttccccccgtaaacccccgtttcccccgttaccccgtaaaccccgtttaaccttaaaccttccggtacccgtttaccggaaaccgggtcccggggtcccgttaaccggggg

SEQ ID NO: 62704 - DNA, 1019 bp, Homo sapiens
  misc_feature: GYAE6OF01D4A5T.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagaggtcaccgtctcctgctcgtggaacgccgcctaccaactagtttcggaccaacgtaaatttatcggttaactcccgtagggtaacccacggtcctaacccgtttaccccccggggaaccaacccggaccccccctaaaaaccttccccttaccaacttacctaagttagtaaacgttacttttaaccggcccgtaaccccgtcgaaggggtactttcccgtcgggtacccgtaactttcccgtccgttcgggacccttacccgtaaaacggttcccgaacgggtaccctaaccccgttccgttaccggacccccgtaacccccgttacgggaaaccctaaccggttaccccggaaccccgggggtacccttaaccccgggaaaccggggtaacccccggggggtaaacccggaaaccggggtaccccgttaaacgttttaaccgtttaaccggttacggacccggtaaccgtaaacccgggtttacggggaaccccttaacccgtaaaacccggttcggttaacccggtttcggggtttaccgggggttcccgtttttaccgggggaccggggttaacggggttaaaccgtttaaacgggtttccggtaaccccggtttacccgttaaccggttacccgaaccggtacccccggtaaacgggtcccgttacccccgggtacccccccgtttaccgggtacccgtacccgtttaccccgtttaccccggttccccccctaaccccctttaccccgttaccccctaaacccgtttaaccgttaaccgtttcccggaccgttaccgggaacccgggtcccggggtaccgtaacccggggg

SEQ ID NO: 62705 - DNA, 562 bp, Homo sapiens
  misc_feature: GYAE6OF01BAVMD.10.86.H09.1.454.CMB.1.raw
  modified_base (555)..(555): a, c, t, g, unknown or other
  misc_feature (555)..(555): n is a, c, g, or t
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtaccagcaccttcccgggacacgcccccaaactcctcatctatgaagattttacgcgaccctcagggattcctggccgattctctggctccaagtcaggccacctctcgcccaccctggaccatccgaccgggctccaggacccgggacgacggccgtattacttactgcgactaacgttcgggaactccaacctgacgtggtgggctttcgggcggacggactaagttcgaccgtctacgtcgacgcccaaggcctcgcccctcggtccactctcgtcccaccctcctccactacctactcgctgacggcggngtacggg

SEQ ID NO: 62706 - DNA, 852 bp, Homo sapiens
  misc_feature: GYAE6OF01CT7IX.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgccggccccaggacagagggtcaccgtctccgtgctcgtggaagccgccctccaaactagtttcgggacctaacggtaaattttagtcggttaacttcccgttagggttaaccccaggtaccctaacccgtttacccccggggaacaaccggaccccccaaaacttccctacaacttacctaagtagaaacgttaacttttaaccggacccgtaaccccttacgaacggggttactttcccggtcggacccggttaacttttccgttcgttacgggtacccttacccgtaaaacggttccgaacgggtcctaaccccgtttccgtcggaaccccctacccggtacggaacctacgtccggacccgggtcctaccggaacgggacccggggacgacggaccgtaattacgtacgtcgcgtacgtaacgttcggaacctaccgaacgtcgtacgttaggttcggggtccgtttacgggacgggtacgggtaacgttaacggttccggtaaccgttaccgtaccggtaccgaacccggtacccggaaacggtcccgtacccggtcccccgtacgggtaccctaccgtttaccgtcccggtttacccccaccccgttaccctccccgttaaacccgttaccttaccgttccggtaccgtacgggtaccgggtcccgggccgttaccgggg

SEQ ID NO: 62707 - DNA, 683 bp, Homo sapiens
  misc_feature: GYAE6OF01EGT5S.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagccgcctccaacattggcacgaattatgtatcctggtaccagcacttcccggacacgccccaaactctcatctatgaagtattttacgcgacctcagggtattccgtggccgtattctctgctccaagtcaggcacctctcgccacctggacatcgaccggctaccgaggaccggggaacgacggcccgtaatttacttacgtgaccgactaaacgtttcgggaaccttaccaaaccgttacggtacgttggtttacgggggtccgttttaccggggacgggtaacggggtaaccttaagggttcgtaaccccggttacccttaacggttacccgaacggtaccccgtaaacgggcccttacccggcccccccgttcgggttacccaccgttccgttacccggttccccctaccccttcccctacccgtaaaccttaccgttactcggtacgtacggacgggccgggtcgtaccggg

SEQ ID NO: 62708 - DNA, 708 bp, Homo sapiens
  misc_feature: GYAE6OF01C46OX.10.86.H09.1.454.CMB.1.raw
  modified_base (159)..(159): a, c, t, g, unknown or other
  misc_feature (159)..(159): n is a, c, g, or t
  modified_base (234)..(234): a, c, t, g, unknown or other
  misc_feature (234)..(234): n is a, c, g, or t
  modified_base (702)..(702): a, c, t, g, unknown or other
  misc_feature (702)..(702): n is a, c, g, or t
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctnagtgtctgccggcccaggacgaggacgggtccacccggtctccgtgccttcgagggaacgccgccctaccaaacngtttcggaccaacgtaattagtcggtacttccgtggtaaccagcctaccgttccccgggacaccgaccccaaactccacactactatagtaacgttactttaccgccgtaacccgtgacggttacttccgcggaccgtattccgtcgtcggtcctaccaagtaccgaacggtccacctccgtcgacccgtaccgtacggtacacgtacccggacccggtacgtacccgacgggaacccgggggaccgacgggtaccgtaagttacgttacgtcggtaccgactaacggttacgggacctaacccgtaaccttggacgttcgggttcgggtccgttacgggacggaaggtacgtaagtcgtacctaccgtcgtacgacgaccacgaccgtcctacccggtagtcctaccgttcgttacccggtcccgtcccgtccctcccgacttctacgtcgtacgtcggcggtcggngtacgg

SEQ ID NO: 62709 - DNA, 872 bp, Homo sapiens
  misc_feature: GYAE6OF01CKFP8.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgtgacgcagccgccctcagtgtctgccggccccaggacagagggtcaccgtctcctgctcgtggaagccgcctccaaactattgggaccaacgtaaatttatgttaacttcccgtagggtaacccagcccgtaaccgtttcccccggggaaccaccggaccccccaaaaaccttccctacctaattaccttaagtagtaaacgttaacgtttttaccggaccgtaacccccgtcgaacggggttactttcccgtcgggcccgtaatttcctcgtacggtccttaccgaaagtcgaacggcctaccttccgtacgaccccgacccgttacggaacctacgtcccgaacccggtcctacccggaacgggaacccgggggtaacgacgggtacccgttaagtttacgttaccgaggaccgtaaccgttaaaccggttcgggtaaaccctcccgaaaacccggttcggtaacgttcgggtttacggggttccgtttacggggacgggtaaacgggttaaccgttaaacgggttcgtaaccccggttaacccgttaccggtaccgaaccggaccccgtaaagggtcccccgttacccgggccccccgttaccggtccctaaccccgtttccggttccccggtttccccccggaccccctttaccccgttaccctaacccgttaacccttaacggtccgtaccgttaccgggaacgggtcccggggtcggtaaccgg

SEQ ID NO: 62710 - DNA, 779 bp, Homo sapiens
  misc_feature: GYAE6OF01ENC34.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgccgccccaggacagaggtcaccgtctcctgctctggaagccgcctaccaactattggacacgtaattatgtactccgtggtaccacgcctaccgttccccgggacaccgaccccctaaactcctcatctatagtaagtactttaccgccgaccccgtagacgggtacttccgtggccgtatttcctcgtggccttaccgaaagtcgacggcctacctctcgcccacccgtagacacgtccgaccggcctaccgacgggacccggggacgacggtccgtaattacgttaccgtcgaccgtacgtaacggttacgggaacctacccgtaaccgtacgtaccgttcgggtttacggggtccgttttaccgggacggggtaacgggtaaccgttaaacgggtttaccggtaaccccgtttacccgttaaccggtccggtaaccggtaccccggtaaaccgggtcccgttaccccggtacccccccggttcggtaccctaacccgtttcccggttcccggtttcccccccgtacccccgttacccccttaccccgttaaccctttacccgttacgtccggtaccggttacgggaccggtccggggtcccgtacgggg

SEQ ID NO: 62711 - DNA, 615 bp, Homo sapiens
  misc_feature: GYAE6OF01CF7I8.10.86.H09.1.454.CMB.1.raw
  modified_base (339)..(339): a, c, t, g, unknown or other
  misc_feature (339)..(339): n is a, c, g, or t
tcagcatagtagtgcacgaccggtgctcgatttagtgctatagacttgggtttggggactcgggacaatcttcatcatgacctgctcccctctcctcctctcccttctcattcactgcacagggtcctgggcccagtctgccctgactcagcctccctccgcgtccggtctcctggacagtcagtcaccatctcctgcactggaaccagcagtgactttgtgcttataactatgtctctgtaccagcaccaccaggcaaacgccccaaatccttgttttgagtcagtaagcggcctcaggacgtccctgattcggttctctcgcctcaagtctgcaacncggcctcctgaccgtctctcggctccgagctgagagtgagctgacttactactgctagcgtacattacgttcgaccggaccccaaggtacgggttgtttacgggcgggtacgggtaacgtaacgggtcgtacccggtcggttacgggtccgacggaccccgaagggtccctcccgggtaccccccgttcggtaccctaccgttcccgttcccgtttacccccgaacccccgtttccctaccccgtaccttaaccgttacttcggtccgttaccggg

SEQ ID NO: 62712 - DNA, 843 bp, Homo sapiens
  misc_feature: GYAE6OF01A8NKU.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggcccaggacagagggtcaccgtctcctgctctggaagcgcctccaacattggcacgtaattatgtactcctggtaccagctaccgttccccgggacacgaccccaaactcctcactctatagaagtacttttacgccgtaccctcgagggtacttccgtggtccgtattcctcgtcggcctaccgaagtcgacggcctacctctcgacccacccgtacggacctacgtaccgacccggggtcctacccggaacgggacccgggggaaccggacgggtacccgttaagtttacgttaaccgtacggaccggtaccttaaaccgggtttacgggaacccttaccccgtaaaccgtttcggtaaccggtttggggtttaccgggggttaccgttttaccgggggacgggtaacggggttaacctttaaacggggtttccggtaaccccgtttcccgttaaccgggttacccgtaacccgggtacccccgtaaacgggtccccgtacccggtaccccccggtttcccgggtacccgttaacccggttttccccggttaccccggttttcccccccggtacccccgtttaccccgttacccccttaaacccgttacccgttaacgttcccggtacccgttacgggaaccggggttcccgggggtaccggttaaccgggg

SEQ ID NO: 62713 - DNA, 709 bp, Homo sapiens
  misc_feature: GYAE6OF01A5B1U.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtaccagcacttccccgggacacgccccaaactcctcatctatagaagtattttaccgcgaccctcgagggtacttcctcggccgtattctctggctaccaagtcaggccacctctcgacccacccgtggacactccgacccgggtctacccgaacggacccgggggacgacgggcccgtaatttacttaccgtgaccgcgtaaacgttcgggacctacccgaaacctcggacgttgggtttcggggtccgttttccgggacgggtaacgggtaaccgttaaggtttcggaaccccggttccgttaaccggtaccgtacggaccccgaaacgggtccctaccggtccccccgttccgggtccctacccgttcccgttccggtttccccccgaccccctttcccctcccctaaccgttacccttaagttccggtaccgttagggaccgggtcccgggggtccgtacgggg

SEQ ID NO: 62714 - DNA, 409 bp, Homo sapiens
  misc_feature: GYAE6OF01B3ZS7.10.86.H09.1.454.CMB.1.raw
  modified_base (382)..(382): a, c, t, g, unknown or other
  misc_feature (382)..(382): n is a, c, g, or t
  modified_base (402)..(409): a, c, t, g, unknown or other
  misc_feature (402)..(409): n is a, c, g, or t
tcagcatagtagtgcacgaccggtgctcgatttagtgctatagacttgggtttggaagcgcctccaacattggcacgaattatgtatcctggtaccagcacttccccgggacagcccccaaactcctcatctatgaagattttacgcgaccctcagggattcctggccgattctctggctccaagtcaggcacctctcgccaccctggacatcaccgggctccgaggaccggggacgaggccgattatactgcgcaacttggactccaacctgactgttgggctttcgggcggagggactaagttgaccgtcctacgtcagcccaaggcctcgccccctcggtccacttctcgttccccaccctcctccactactatgctgngcggctggcaggcgcatagnnnnnnnn

SEQ ID NO: 62715 - DNA, 763 bp, Homo sapiens
  misc_feature: GYAE6OF01ATYVC.10.86.H09.1.454.CMB.1.raw
  modified_base (678)..(678): a, c, t, g, unknown or other
  misc_feature (678)..(678): n is a, c, g, or t
tcagcatagtagtgcacgaccggtgctcgatttagtgctatagacttgggtttggggacgtcgggacgaatcttcatcatgacctgctcccctctcctcctctcccttctcattcactgcacagggtcctgggcccagtctttgttgacgcagccgccctcagtgtctgcggccccaggacagagggtcacgtctcctgctcgtggaagccgcctccaacattcggcaacgaattagtgtacttcctggtaccagcctaccgttcccgggacctaccgaccccctaaaacctccctactacttctactagtaagtacttttaccgaccgtaccccgtaccgtaagggtaccttccgttcgggtaccgtactttccgtcttggcccttaccaacggtaccgaggacccgtaccttcctacgtacccctacccgtaggtacccacgttcccggaacccgggtcctaccccggtaaaccgggaccggggtaccggacggcccgtaagtttacgttacgtacggccgtacctaaacggttcggaacctacccgtaacgtcgtacgttcgggttacgggtccgtttcgggtaccgggtagggtaacgttaacgggttcgacccgtttacccggtacggtcccgtaaccgcccgaacggtccgtaccgtccccgtacggttccnccgttacccgttccgtcccccgtacccctcccttcccaacccgttactccgtacgtccgtacggaccgtccggggtccgtacggg

SEQ ID NO: 62716 - DNA, 799 bp, Homo sapiens
  misc_feature: GYAE6OF01D0UUM.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtactcctggtaccagccacgttccccggacacgacccccaaactcctcatctatgaagtacttttacgccgacctcgagggtacttccgtggaccgtacttcgtctcggcctaccgaacgtcgacggtccaacccttcgtacgaccctaaccccgtcgggaacctacgtaccgaaccccggggtcctacccggaaccggggacccgggggaaccggtacgggtacccgttaacgtttaacgtttaaccgtcggaccggtacgtaaaacccggtttcggggaacccttaaccccgtaaacccgttcggtaaccggtttcggggttttaccgggggttacccgttttaccgggggaccggggttaacggggtaaccgtttaaaccgggtttcggaaccccggttacccgttaaccggtaccgtaccggtaccccgtaaacgggtcccgttacccggtccccccggttcgggtaccctaccgttcccgttacccgttcccccctaccccgttccctacccgtaaccttaccttacgtcggtacgtacggacggtccgggtcgtaccggg

SEQ ID NO: 62717 - DNA, 772 bp, Homo sapiens
  misc_feature: GYAE6OF01BEC7Y.10.86.H09.1.454.CMB.1.raw
  modified_base (221)..(221): a, c, t, g, unknown or other
  misc_feature (221)..(221): n is a, c, g, or t
tcagcatagtagtgcacgaccggtgctcgatttagtgctatagacttgggtttggggactcgggacaatcttcatcatgacctgcctcccctctcctcctctcccttctcattcactgcacagggtcctgggcccagtctttgttgacgcagcccgccctcagtgtctgccggccccaggacagagggtcaccgtctcctgctctggaagccgcctccaanattggcacgaattatgtatcctggtaccagcctaccgttcccggacacgaccccaactcctcatctatagaagtacttttaccgccgtaccctcgacgggtacttcccgtggccgtattcctcgtcggtcctacccgaagtccacggtccctaccgttccgtcgtacccaccccgtaggaccactccgaccgggcctaccgacgggacccggggacggacggaccgtaattacttaccgtcggaccgtacgtaaccggtttcgggaaccctcccgtaaacccgtcggtaccgtttgggttcgggggttccgtttaccgggaccggggtaacgggttaaccgttaacgggttcggtaaccccgttacccgttaccggtcccgtaaccggtaccccgaaacgggtccccgttacccggtcccccccggttacgggtacccctacccgttcccggttacccgttccccccggtccccttcccccgtcccgttaacccgttcccttaacggtccggtaccgttgggtacccggtcccggggttcggtacccgggg

SEQ ID NO: 62718 - DNA, 725 bp, Homo sapiens
  misc_feature: GYAE6OF01DBCT3.10.86.H09.1.454.CMB.1.raw
  modified_base (325)..(325): a, c, t, g, unknown or other
  misc_feature (325)..(325): n is a, c, g, or t
tcagcatagtagtgcacgaccggtgctcgatttagtgctatagacttgggtttggggactcgggacaatcttcatcatgacctgctcccctctcctcctctcccttctcattcactgcacagggtcctgggcccagttctttgttgacgcagcccgccctcagtgtctggccggccccaggacaggacgggtccaccgttctcctgctcgtggaacgccgccctaccaaacgtagttgggaccaacgtaatttatcgtaactccgtaggtacccagcctaccgttccccgggacaccgcccccaaactcctcatctatagaagtntttacgccgaccctcgagggacttccgcggtccgtattcgtctggcctaccgagtccgacggctacctctcgcccacccgtaggacctatcccgccgggtcctaccgacgggaccggggacgacggccgtattacgttactgccgacgtaacgtggacctacccgtaactcggtacttcgggttcgggtccgttcgggacgggtaggtaacgttacggttaccgtaccgttaccgtacggtaccgaccggacccgtacggcccgtacccggtcccccgttaccggtccctaacccgttcccggtcccgtttccccccggccccctttacccctacccgttaaccttacccgttacgtccggttacccgtagggtacccgggcccgggtcgtaacccgggg

SEQ ID NO: 62719 - DNA, 739 bp, Homo sapiens
  misc_feature: GYAE6OF01CCCCV.10.86.H09.1.454.CMB.1.raw
  modified_base (291)..(291): a, c, t, g, unknown or other
  misc_feature (291)..(291): n is a, c, g, or t
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagaggtcaccgtctcctgctctggaagccgcctccaaacattggcaacgtaattatgtactcctaggtaccagccgtaccgttccccgggacaccgacccccaaactccctnatctatagtaatactttaccgcgtaccctcgagggtacttccgcggccgtattctcgtcggcctactaacggtcacggcctacctcgtcgaccctacccgtagacctacgtcccgaccggcctaccgacgggaaccggggacgacggtaccgtaattacgttacgtcgaccgtaccgtaacgttacggaccttacccgaaacgttcgtaaccgttcgggtttcggggtacctttcggggaccgggtaagggtaaccgttaacggttcgtaacccgtccgtaccgtacgaccgtacccgtaaggtcccgtacccgtcccccggttccggtaccctacccgttcccgttcccgtttaccccccgtacccccttaccccgttaccccgtaccctttaaacgttcccgtaccgtaccggtacggtaccggggtcccgggtccggtacccggg

SEQ ID NO: 62720 - DNA, 593 bp, Homo sapiens
  misc_feature: GYAE6OF01EG2R6.10.86.H09.1.454.CMB.1.raw
  modified_base (210)..(210): a, c, t, g, unknown or other
  misc_feature (210)..(210): n is a, c, g, or t
tcagcatagtagtgcacgaccggtgctcgatttagtgctatagacttgggtttggggactcgggacaatcttcatcatgacctgctcccctctcctcctctcccttctcatttcactgcacagggtcctgggcccagtctttgttgacgcagcccgccctcagtgtctgcggccccaggacagagggtcaccgtctcctgctcgtggaancgcctcaacattggacacgaattatgtatcctggtaccagcacttcccgggacacgccccaaactcctcatctaatgaagtattttacgcgaccctcgagggtacttcctggccgattctcgtggctccaagtcaggcacctctcgccacccgtggaaccatcgaccggctccgacggaccggggacacggccgtattactactgcgactacgttggacctcgaacctgacgtggttcgggcgtttcggcgggacgggtactaaggttcgaccgttaccgtacgtcgacgaccgaaggccttcgccccctcggtcctaccttcgtccgttcccccacgttccctcccgaccttactactcggcctaggcggtccggcgtcggg

SEQ ID NO: 62721 - DNA, 834 bp, Homo sapiens
  misc_feature: GYAE6OF01B5294.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggcccaggacagagggtcaccgtctcctgctctggaagccgcctccaaacagttggcacgtaattatgtactcctggaccagctaccttccccgggacacgccccaaactcctcactctatagaagtacttttacgccgtaccctacgagggtacttcctggccgtacttctcgtcggtctaccagtcgacggctaccgtctcggaccctacccgtcggaactacgtaccgaacccggggcctaccggaacgggtaacccgggggaaccgacgggtacccgttaagttttacgttaaccgttcggaccgtaacggttaaacccggttacggggtaaccctaccgtaaacccgtggtaaccgttgggtttaccgggggtccgttttacgggggaccgggtaacgggtaaccgtttaaacgggtttaccggtaaccccggtttaccggtaacccggtacccggtaacccggtaccccggtaaacgggttcccgttaccccgggtacccccccgttaccgggttacccgtaaccgttttccccggttaccccggtttccccccggttacccccctttaccccggttaccccgttaacccgttaacccgttaaccgttccggtaccggtttaccggggaaccgggttcccggggtacccgtaaccggggg

SEQ ID NO: 62722 - DNA, 788 bp, Homo sapiens
  misc_feature: GYAE6OF01CSAVF.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctcgtggaagccgcctccaacattggcaacgaattatgtactccgtggtaccagcctaccgttccccgggacaccgcccccaaactccctcactctatagtaaacgtacttttaccggccgtaccctcgaagggtactttcccgtaggcccgtatttcctcgtcgggtaccctaccgtaaagtccgaacggcctaacccttcgtccgaccctacccgtggaccacgtccgaaccggtcctacccgacgggtacccggggactacgggacccgttaattaacgttaccgtggtaccgacgtaaaccgttcgggaacccttaccgaaacccgtggtaaccgttgggttccgggtccgtttcgggacgggtaacgggtaacgtttaacggttcggtaacccgttccgttaccggtaccgaccggtacccgaacggtcccgtacccggtcccccgttacgggtccctacccgttcccgttcccgggtttccccccgtaccccttaccccttaccccgtaacccgtttaacccgttaccgttcccggtacccgttacggggtaacccgggtccggggttacccggtaaccggggg

SEQ ID NO: 62723 - DNA, 731 bp, Homo sapiens
  misc_feature: GYAE6OF01BOCYQ.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagacgggtcaccgtctcctgctcgtggaacgccgccctccaaactagttcggacaacgtaattatgtactccgtggtaccacgcctaccgttcccgggacacgacccccaaactccctcactctatagaacgtagtttaccgcgaccctcgaggtacttccgtggccgtacttctctgcctacgaagtcgacggcctacctctcgacccacccgtggacacgtccgaccggcctaccgacggaccggggacgacggccgtattacgtacgtcgcgactaacgtcggacctaccgtaaccgtgtacgttgggttcgggtccgtttcgggacgggtacggtaaccgttaacggttccggacccgtttaccgtacggtaccgtaaccggtacccggtaaacggtcccgtacccggtcccccgttacggttacccgtaccgttacccggttccccgtttacccccgtacccctttaccccgtacccctaaacccgttaaccgttaccgttccggttaccgttaccgggtaccgggtccggggtcccgtaaccgggg

SEQ ID NO: 62724 - DNA, 718 bp, Homo sapiens
  misc_feature: GYAE6OF01DV57F.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtaccagcacttccccgggacacgcccccaaaatcctcatctatgaagattttacgcgaccctcagggattcctggccgattctctggctccaagtcaggcacctctgccaccctggacatccaccgggctcccgaggacccggggacgacgggcccgtaatttacttaaccgtggaccgtactaaaccgtttcggggaaccttacccgaaaacccgttcggtaaccgttggtttacgggtcgtccgtttttaccggggccgggtaaggggtaaccttaaaggtttcggtaacccggttcccgttaacggttccaacggtccccgaaagggtccttccggcccccccgttcggggttaccctaaacgtttccccgttaccgggtttacccccccaacccccgtttcccccgttacccctaacccgtttaacccttaacgtttcggacccgtttcgggaacgggtcccgggggtacccg

SEQ ID NO: 62725 - DNA, 771 bp, Homo sapiens
  misc_feature: GYAE6OF01A69II.10.86.H09.1.454.CMB.1.raw
  modified_base (357)..(357): a, c, t, g, unknown or other
  misc_feature (357)..(357): n is a, c, g, or t
tcagcatagtagtgcacgaccggtgctcgatttagtgctatagacttgggtttggggactcgggacaatcttcatcatgacctgctcccctctcctcctctcccttctcattcactgcacagggtcctgggcccagtcttgttgacgcagccgccctcagtgtctgcggcccaggacagagggtcaccgtctcctgctctggacgcgcctccaactattggcacgtaattatgtatccgtggtaccagcaccgttccccgggacacgccccaaactcctcatctatgaacgtattttacgcgaccctcgaggacttccgtggccgtattcctctcggctcaacgtcaggccacctcncgccacccgtggacacgtcacccggctaccgacgggacccggggtacgacgggccgtaactttacgttaacctcggaccgactaaaccgtttcgggaacctaccccgtaaacccgttcggtaaccgttcgggtttacggggtcccggttttacggggaccggggtaacggggtaaccgttaaacgggtttacggtaccccggtttacccgttaccggttaccgaaccggtaccccgtaaagggtcccgttaccgcccccccggtttacggtacccgtaacccgtttcccggttacccgtttaccccccctaaccccccggtttccccttaccccccgtaaacccgtttaacccttaaccgttccgggacccgtttacggggaaccggggtcccggggttccggtaacccggggg

SEQ ID NO: 62726 - DNA, 632 bp, Homo sapiens
  misc_feature: GYAE6OF01ENEBW.10.86.H09.1.454.CMB.1.raw
  modified_base (605)..(605): a, c, t, g, unknown or other
  misc_feature (605)..(605): n is a, c, g, or t
  modified_base (627)..(627): a, c, t, g, unknown or other
  misc_feature (627)..(627): n is a, c, g, or t
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagccgcctccaacattggcacgaaatttatgtactccgtggtaccagcctaccgttccccgggacacgaccccaaactccctcatctatagaagtacttttaccgccgtaccctcgagggtacttccgtcggccgtactttcctcgtcggcctaccaagtcacggccaccgtctcgcctacccctggactacgtccgaccggctccgacgggaccggggacgacgggaccgtattaacgttacgtcggccgacttaacggttcggacctaccctaaccgtcgtaacgttgggttcgggtcgtttcgggacggaacgggtacttaaggttcgacccgttcctacgtcgacgccgaacgtcgtccgccccgtcggtctacctccttccgtcccctccctccnccactctagtcgctgcggcggngtcgg

SEQ ID NO: 62727 - DNA, 717 bp, Homo sapiens
  misc_feature: GYAE6OF01DKHNZ.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgtgacgcagccgccctcagtgtctgccggcccaggacagagggtcaccgtctcctgctcgtggaacgccgccctaccaacagttggccaacgtaatttatgtactccgtaggtaccagccaccgttccccgggacacgacccccaaactcctacatctatgaagtacttttacgccgtaccctcgacgggtacttccgtcggaccgtactttcgtcgtggcctaccgaacgtcgacggcctacctcctcgaccctacccgtcgactacgtccgaccggtcctaccgacggaccggggacgacggacgtattacttacgtcgcgacgtaacgttcggacctaccgaacgtgtaccgtggttcggggtcgtttccggggacggtacgggtacttaacggttacggtacccgttccgtaccgtcgaccggtaccccgaacggtcccgtcccggtcccccgttcggtacctacccgttcccgttacccgtttacccccctacccccttacccgttacccgttaaaccttaccgttaacgtccgtaccgttacgggaccggtccgggtcggtaacccgggg

SEQ ID NO: 62728 - DNA, 760 bp, Homo sapiens
  misc_feature: GYAE6OF01DPIV4.10.86.H09.1.454.CMB.1.raw
tcagcatagtagtgcacgaccggtgctcgatttagtgctatagacttgggtttggggactcgggacaatcttcatcatgaccctgctcccctctcctcctctcccttctcattcactgcacagggtcctgggcccagtctttgtgacgcagccgccctcagtgtctgcggccccaggacagagggtccaccgtctcctgctcgtggaagccgcctaccaacattcggcaacgtaattatgtactccgtggtaccagccaccgttccccgggacacgccccccaaactcctcatctatgaacgtatttaccgcgtacccctcgaagggtacttccgtcggtcctattccgtctcggcctaccgaagtccgacggccctaacctcgtcgccccgtaacccgtggtaacctacgtacccgacccggggtacctacccggaacgggtaaccccgggggacggtaaccgggtaccgttaagtttaacttaaccgtcggaccgtaccgtaaacgttcgggtaccctacccgtaaacctcggtaccgtttgggttaccgggggtccgttttaccggggacggggttaacgggtaacccttaagggtttccggaacccggtttcccgtaaccggttccaccggtccccgaaacgggtccgtacccggtccccgtccggtaccaccgttcccgttccgttcccccgtccccttcccgttacccgtacgttacctaagtccgtacgtcggtacggccgggtcgtaccggg

SEQ ID NO: 62729 - DNA, 816 bp, Homo sapiens
  misc_feature: GYAE6OF01D6OZU.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagttctttgttgacgcagccgcctcagtgtctgcggcccaggacagagggtcaccgtctcctgctcgtggaacgccgcctaccaaacagttcgggactaacgtaaatttatcggttaactccgtaggtaaccaggcctaccgttccccgggaacacgacccccaaaactcctacatctatagaagtacttttacgccgacctcgagggtacttccgtggaccgtattcctctcggtctaccaaagtccgaggccaccgtctcgaccacccgtggaacacgtaccgaccgggtctaccgacgggaaccggggacgacggtaccgtaatttaacttacgtcgaccggtactaaacggtttcgggaacctacccaaaccgttcgaacgttgggttaccggggtacgtttacggggacgggtaacgggtaacgtttaaagggttccgtaaccccggttaccgttaacccggttaccgaaccgggtaccccggtaaacgggtccccgttaccccggtacccccccggttacgggttacccgttaaacccgtttcccgtttacccccgggtttacccccctaaccccccgtttaccccgttaaccccgttaaaccccgtttaaaccgtaaccgttccgggttacccgttaaccggggtacgggttccccggggtcggtaaacccgggg

SEQ ID NO: 62730 - DNA, 839 bp, Homo sapiens
  misc_feature: GYAE6OF01E03RC.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctgggaagccgcctccaacattggcaacgaattatgtatcctggtaccagccaccgttccccgggacacgacccccaaactcctcatctatgaacgtattttaccgccgacccctcgacggtacttccgtcggcccgtactttcctcgtcggtacctaccgaaagtccgaacgggccctaacccttcgtaccgaccccgaccccgttcgggaaccctacgttacccggaaccccggggtcccttacccggaaccgggaaccccggggggaaccggacgggtacccggtaattttaacgttacccgtcggaccggtaccgtaaaccggtttcggggaaccccttacccgtaaacccgttcggtaaccgtttcggggtttaccggggggttccgtttttaccgggggaaccggggtaacggggtttaacccttaaacgggtttccgggtaaccccggtttacccgttaacccggtaccgtaaccggacccccggtaaagggtcccctaccccgggtcccccccgttacgggtccctaacccgttcccgttcccggttccccccgtccccctttaccccgtacccgtaacccttaccgttaactccggtacgttagggcccggtccggggtccgtaccgggg

SEQ ID NO: 62731 - DNA, 973 bp, Homo sapiens
  misc_feature: GYAE6OF01A0QYT.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctggccagtctttgtgacgcagccgccctcagtgtctgccggcccaggacaggaggtccaccggtctccgtgcctcgtacggaacgccgaccttccaaactagttcgggactaaccgtaaagtttactcgttaactcccgttacggtaaccacggtcctaaccgtttacccccggggaactaccggacccccctaaaacttccctaccgtaactccgttaacgtacgtaaacggttaactttttaaccggaccccgtaaccccgtttacggaacggggttaacctttccccgttacgggacccgtttaacgtttcccgttaccggttaccgggtaccctttaacccggtaaaacggttccgaaaccgggtacccttaacccgttaccgttacccggtaccccccgtaacccgttaacgggtaaccctaccggtttacccggaaccccgggtccgttaaccccgggaacgggaacccgggggtaaccgacgggtacccggttaattttaccggtaccgttccggtaaccgtaccgtaaaccggtttcgggaaaccttacccgtaaaaccgtttcgtaaccgttcgggtttacggggtacccgttttaacggggccggttaaacgggttaccgttaaacgggttttaccgacccgtttaacccgttacgggtacctaccgggtaaccccgttaaccgggttcctaaccccgggtccccccgtttaacgggtcccttaaaccccggttcccgtttaacccccggttccccctaaacccccgtttccctaaccttacccgtaacgtttaccgcggttaccgtacggaaccgggtccgggtcgttacccggg

SEQ ID NO: 62732 - DNA, 889 bp, Homo sapiens
  misc_feature: GYAE6OF01CBIFU.10.86.H09.1.454.CMB.1.raw
  modified_base (161)..(161): a, c, t, g, unknown or other
  misc_feature (161)..(161): n is a, c, g, or t
tcagcatagtagtgcacgaccggtgctcgatttagtgctatagacttgggtttggggactcgggacaatcttcatcatgacctgcctcccctctcctcctctcccttctcattcactgcacgagggtcctgggcccagtctttgtgacgcacgccgccctnagtgtctgccggcccaggacaggacgggtccacccgtctccgtgcctcgtaggaacgccgccctaccaaacgtgttcgggacctaacgtaatttacgtcggttaacttcccgtcgggtaaccaggcccgtaacccgttaccccgggaacacccgaccccctaaacttccctactacttacctaataggtaacgttacgttttaccgacccgtacccctagacgggtacttccgcggtaccgtactttccgtcgtcggtcctaccgtaagtccgacggcctaccctcgtccgacccgtacccgtaggaacctcgtacccggaccggtcctaccgggaacgggacccggggtacgaccggtaccgttaacgtttacgttaccgcggtaccgtaacgtaaccggttaccggaacctacccgtaaaccgtggtaccggttcggggttaccgggttccggttaccggggacgggtaacgggttaaccgttaacgggttcccggtaacccggtttaccgtaacccggttaccggaacccggtacccggtaaccgggttccccgtaccccgggtacccccgtttcgggtacccctaccccgtttacccgttacccccggtttacccccctacccccgtttacccccgttaccccgtaaaccccgtttaccgttaaccgggttcccgtaacgggttacccgggtacccggggtccggggttcccggtaaaccgggg

SEQ ID NO: 62733 - DNA, 679 bp, Homo sapiens
  misc_feature: GYAE6OF01ESUVK.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacaggagggtcaccgtctcctgctctggaacgcgccctccaaacattcggaccacgtaaatttatgtactcccgtggtaaccagcctaccgttcccgggacaccgaccccaaactcctcatctatagaagtactttaccgccgaccctcgacgggtactttccgtcggaccgtattcctcgtcggcctaccgaagtccacggccacctctcgacccacccgtggacactccgaccgggctaccggacgggaccggggacgacggtaccgtaatttacttacgtcggaccgacgtaaccgttcgggaacctaccgaaccgttggtacgttggtttcggggtcgtttcggggacgggtacgggtaacgtaggttcggtacccgtcgtacgtctacgacccgtaggtccgtccgtcccccgtcggtcctaccgttccgttaccgttaccccctacccttccctccctacctctacgtcgacgtaggacggtccgggtcgtacggg

SEQ ID NO: 62734 - DNA, 562 bp, Homo sapiens
  misc_feature: GYAE6OF01CGS3U.10.86.H09.1.454.CMB.1.raw
tcagcatagtagtgcacgaccggtgctcgatttagtgctatagacttgggtttgggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggagcgcctccaacattggcacgaattatgtatcctggtaccagcacttccccgggacacgcccccaaactcctcatctatgaagattttacgcgaccctcagggattcctggccgatttctctggctccaagtcaggcacctctcgccacccgtgacatcgaccggctccgaggaccggggacaggcccgtattacttacgtgcgactaacgttgggacctccaacctgactggttcgggctttcgggcggtaggacttaaggttcgacccgtcctacgtcacgacccaaggctcgccccctcggtcctactcctcgttccccgccctcctccactactatcgctggcgcggcgtcgg

SEQ ID NO: 62735 - DNA, 839 bp, Homo sapiens
  misc_feature: GYAE6OF01D2LPN.10.86.H09.1.454.CMB.1.raw
  modified_base (405)..(405): a, c, t, g, unknown or other
  misc_feature (405)..(405): n is a, c, g, or t
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagcccgccctcagtgtctgccggccccaggacagagggtcaccgtctcctgctctggaacgccgccctccaaacattggcaacgtaatttatgtaactccgtggtaccagcctaccgttacccccgggacaaccgacccccctaaaactcctacctatcctaatgaaagtacttttacccgccgacccctcgaggggtactttccgtggcccgtatttccgtcgtggcctaccgaagtccgacggcctaccgtccncgaccccacccgtacggaactcgtacccggacccgggtcctacccgaacggggacccggggaaccgagggacccgttaatttacgttaaccgtcggaccgtacgttaaaccgggtttcgggaacccttacccgtaaccgttcggtacccggtttaggggttttccgggggtcccggtttttacccgggggaccggggtaaacggggttaaccgtttaaacgggtttccggaacccccggtttacccgttaaccgggttacccggaacccggtaccccggtaaaccgggttccctcccccggtaccccccgttccgggttaccctacccgtttcccgttacccccggttttacccccccacccccgttccccttaccccgtacccgttacctaacgttccggtaccgtgggaaccgggtccgggtccgtacgggg

SEQ ID NO: 62736 - DNA, 732 bp, Homo sapiens
  misc_feature: GYAE6OF01DLKSM.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagttctttgttgacgcagcccgccctcagttgtctgccggccccaggacagagggtccaccgtctcctgctcgtggaacgccgcctaccaacagtttcgggaccaacgtaaatttatcgttaactccgttacggtaccagccaaccgtttcccccggggacaaccgaccccccaaaacttccctactacttcctaatacgtaaagtactttttacccggccgtaaccccgtcgaagggtactttccgtcggcccgtatttcttcgtcggcctaccaagtcgacggctacctctcgaccctacccgtcggaacacgtaccgaccggtcctacccggaagggaaccccggggacgaacgggtaccgtaactttaacgttaccgtcggccgtacgtaaacgttcgggacctacccaaccgttcgtaccgttgggttcggggttccgtttccggggacgggtaagggtaccgttaacggttcgtacccgttcctacggtcgaccgacccgaacgtccgtccgccccgtcggtccaccgttccgtcccgtcccctaccctccctccaaccttcgtacgtcgactaggacgcgggtcgtacggg

SEQ ID NO: 62737 - DNA, 691 bp, Homo sapiens
  misc_feature: GYAE6OF01CBC9K.10.86.H09.1.454.CMB.1.raw
  modified_base (202)..(202): a, c, t, g, unknown or other
  misc_feature (202)..(202): n is a, c, g, or t
  modified_base (207)..(207): a, c, t, g, unknown or other
  misc_feature (207)..(207): n is a, c, g, or t
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccttagtgtctgcggccccaggacaggagggtcaccgtctcctgctcnggaancgcctcaacattggcacgaattatgtatcctggtaccagctaccgttccccggacacgaccccaaactcctcatctatgaagtattttacgccgaccctcgagggtacttccgtggccgtattctctggctccaagtcacggccacctctcgccacctggacactcgaccgggctccgacgggaccggggacggacggccgtaattacgttaactcggccgaccgtaacgttcggggacctacccgtaaccgtcgtaacgttcgggtttacgggggtccgttttcggggaccgggtaacgggtaacgttaaggttcggaacccggttcccgttaaccggtaccaccggtacccgaaacgggtccctaccggccccccgttcgggtcctaaccgttccttcggtttccctcccgtacccccttcccgtccctaaacccttaccttacgttcgtaccgtggtaccgggtccggggtcgtaccgggg

SEQ ID NO: 62738 - DNA, 818 bp, Homo sapiens
  misc_feature: GYAE6OF01DXAFW.10.86.H09.1.454.CMB.1.raw
  modified_base (164)..(164): a, c, t, g, unknown or other
  misc_feature (164)..(164): n is a, c, g, or t
  modified_base (172)..(172): a, c, t, g, unknown or other
  misc_feature (172)..(172): n is a, c, g, or t
tcagcatagtagtgcacgaccggtgctcgatttagtgctatagacttggggtttggggactcgggacaatcttcatcatgacctgcctcccctctcctcctctcccttctcattcactgcacgagggtcctgggcctagttctttgtgacgcacgcccgccctnagtcgtcncggcccggacccaaggacagggtacggtcaccgtcctcgtgctcggtaggacgcctcctacaacgtgttcggacaagtaaatttcgtacgtactaccgtacggtaaccacgtacccgtacccggttaccccggaaccaacccggaaccccctaaacttcctactactacttaagtacgtaaacgttacgtttaccgaacccgtaccgtacggtaacggtcttccgtcggtacctcgttccgttcgcgtactaccgtaacgtacgaccggtacctacccggtctaccgacccgtaccggtacgtaccgtcgtaacccggtacccgggtacctaacccggggaaccggggtaacccggggacgggaaaccgttaacccgtttaagttacgttacccggaggaccgtaacgtaaccgggtacgaacctccgtaaccggtgtaccggttgggttccgggtaccggtggaaccggtaaggtacgttaacgtccggttaccgtacccgtacgtacgtaccgtaaccggtacgtcccgaaccctcccggttacgaaccctcccggtccctttaccccggtccccgtacccctccgttaccaacccgtttacgccgtgggtcccgaacggggtccggttggcccggttaacggg

SEQ ID NO: 62739 - DNA, 776 bp, Homo sapiens
  misc_feature: GYAE6OF01BIKPI.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgccggccccaggacaggagggtcaccgtctcctgctctggaagccgcctccaacattggcacgaattatgtactccgtggtaccagccaccgttccccgggacacgacccccaaactcctcatctatagaagtacttttaccgccgtaccctcgagggtacttcccgtcggccgtatttcctcgtcggcctccaagtccacggccacctctcgacccacccgtggactacgtccgacccgggcctaccgaacgggaccggggacgacggaccgtaatttacgtacgtcggaccgtacgtaaccgttcgggaacctacccgtaaccgttcggaaccgttcgggtttacggggtccgttttccggggaccgggtaacgggtaaccgttaacggtttccggtaaccccggttaccccgttaaccggtcccgtaaccggtaccccgtaacgggtcccgttcccggccccccccggtttcgggtacccttacccgttccccgtttccccggtttccccccggtcccccctttacccccgttccccgtaacccgtttaacccgttacgttccggtacccgttagggacccgggtcccggggtccgtaacccggggg

SEQ ID NO: 62740 - DNA, 440 bp, Homo sapiens
  misc_feature: GYAE6OF01CM0II.10.86.H09.1.454.CMB.1.raw
  modified_base (430)..(440): a, c, t, g, unknown or other
  misc_feature (430)..(440): n is a, c, g, or t
tcagcatagtagtgcacgaccggtgctcgatttagtgctatagacttgggtttggaagcgcctccaacattggcacgaattatgtatcctggtaccagcacttccccgggacagcccccaaactcctcatctatgaagattttacgcgaccctcagggattcctggccgattctctggctccaagtcaggcacctctgccaccctggacatccgaccgggctccgaggaccgggggacgacggccgtattacttactggccgacaacgttggggacctccaacctgactggttggggtctttcgggcggagggactaaggttcgaccgtctacgtcacgcccaggctcgcccctggtcactctcgtccccgccctcctccactactatcgctggacggcgggctcgggacgaaggtccgacgtaagtcgnnnnnnnnnnn

SEQ ID NO: 62741 - DNA, 535 bp, Homo sapiens
  misc_feature: GYAE6OF01BT23C.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtaccagcacttcccgggacagccccaaactcctcatctatgaagattttacgcgaccctcagggattcctggccgattcctctggctccaagtcaggcacctctgccaccctggacatcaccgggctccagaccggggacgaggccgattattactgcgcaacttgggactccaactgactgttgggcttcggcgagggactaagttcgaccgtcctacgtcagcccaaggcctcgcccctcggtcactcctgtcccctacctccctccactctatcgctgacggcggctcggg

SEQ ID NO: 62742 - DNA, 654 bp, Homo sapiens
  misc_feature: GYAE6OF01D021P.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagccgcctccaacattggcacgaattatgtactcctggtaccagccaccgttccccgggacaccgacccccaaactcctcatctatagaagtattttaccgccgtaccctcgacgggtacttccgtcggtccgtatttccgtccgtcggcctaccgtaagtccgaacggcctacccttctacgacccacccgtacggaccacgtcccgaccgggcctacccggaacgggaccgggggacgacggccgtaatttacttaccgtgaccgtactaacggttcggacctaccgaaccgtcgtacgtggttcgggtcgtttcgggacggaggtacttaacggttcgaccgtccgtacgtccgacgtcccgaagccgtccgtccccctcggtcctccgtccttccgtccccacccttcctcccaaccttcgtactcgtcgagcggcggcgtcggg

SEQ ID NO: 62743 - DNA, 738 bp, Homo sapiens
  misc_feature: GYAE6OF01DTR5G.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagttctttgttgacgcagccgcctcagtgtctgcggcccaggacagaggtcaccgtctcctgctcgtggagcgcctccaacattggcacgaattatgtatcctggtaccagcctaccgttccccgggacacgacccccaaactcctacatctatgaagtacttttacgccgtaccctcgacgggtacttccgtcggccgtatttcctcgtcggcctaccgtaaagtccacggctacctcctcgacccctacccgtacggacctacgtaccgacccgggtctacccgaaccgggaaccggggaccgacggtaccgtaacgtttaacgttaaccgtcggaccgtaccgtaaccggttacgggtaacccgtacccgtaaccgttacggtacgttcggggtttcggggttcggtttaccgggtacgggtaacgggtaacgttaacggttacggtacccgtacccgttaccggtaccgtaccgacccgtaacggtcccgtcccgtacccccgttccgtacccgaccgttttttttcccgcccggttccccgtaccccttcccttaccctaccgtacttacgtcgtccgtaggacggtccggcgtacggg

SEQ ID NO: 62744 - DNA, 667 bp, Homo sapiens
  misc_feature: GYAE6OF01BH9JD.10.86.H09.1.454.CMB.1.raw
  modified_base (218)..(218): a, c, t, g, unknown or other
  misc_feature (218)..(218): n is a, c, g, or t
tcagcatagtagtgcacgaccggtgctcgatttagtgctatagacttgggtttgggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctcaacnttggcacgaattatgtatcctggtaccagcaccttcccgggacacgcccccaaactcctcatctaatgaagtacttttacgccgaccctcgaggtacttccgtggccgtattctctggctccaagtcaggcacctctcgcccaccctggacactccgaccggctcccgacggaccggggacgacgggcctaagtttacgtacgtcggaccgacgtaaacgtttcgggaccttacccgaaacccgttgtaaccgttgggttcgggggttccgttttacggggccgggtaagggtaaccgttaaggtttcgacccggttacccgttaccggtccgtaaccggaccccgtaaggtccctccggcccccgtcggtacctaccgtccttcccgttcccctaccccttccctccctaaccttactactcgacttggacggtccgggtcgtacggg

SEQ ID NO: 62745 - DNA, 633 bp, Homo sapiens
  misc_feature: GYAE6OF01DT5MX.10.86.H09.1.454.CMB.1.raw
  modified_base (423)..(423): a, c, t, g, unknown or other
  misc_feature (423)..(423): n is a, c, g, or t
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgccggcccaggacagagggtcaccgtctcctgctctggaagccgcctccaacagttggcacgtaattatgtatcctggtaccagccacttcccgggacacgccccaaactcctcatctatgaagtacttttacgcgaccctcaggggactttccgtggccgattctctgctccaagtcaggcacctctcgcccaccctggacactccgaccggcctccgaacggacccggggacgacggaccgtagtttacttaacngccgacaaacgtttgggacctaccgtaaacctggtaccgttggtttcggggtcgtttcgggacgggtagggtaacttaaggttcggacccgttaccgtacgttcgacgcccgtaaggccgtccgtcccccgtcggtcctaccgttcctaccggttcccctacccttcctccctaactctaactcgtctaggtacggccgggtcgtacggg

SEQ ID NO: 62746 - DNA, 818 bp, Homo sapiens
  misc_feature: GYAE6OF01CZXRT.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggccagtctttgtgacgcagccgcctcagtgtctgccgcccaggacagacggtcaccgtctcctgctcgtggaacgccgacctccaaactgttcggacaacgtaattagtgtactccgtcggtaccagtccgtaccgttaccccgggacaaccgaccccctaaactccctactactactaagtagtaaacgtactttaccggacctacccgtgaacggtacttccgtacggaccgtacttcgtcctggtcctaccgtacgtccgaacggtccaacccgttcgtaccgacccctaccggtacggacctaacgtcccgtacccgggactacccggaacggggaacccggggaacgtaccggtaccgttaatttacgttaaccggtcgtaaccgtaaccgtaacggttacccgggtaacctaacccgtaaccggttacggtacggttcgggtttccggggtacgtttaccggggaacgggtaacgggtaacgtttaacggtcggtaacccgttacgtaaccggtccgaacggtaccccgtaacggttccccgtaccccggtccccgtccgggttaccctaccggttccccgttacccggttaccccctacccccgtttaactacccccgttaacgttaacccttaaccgttcggtaacccttagggaccgggtcccgggtcggtaaccgggg

SEQ ID NO: 62747 - DNA, 705 bp, Homo sapiens
  misc_feature: GYAE6OF01A0TBD.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggcccaggacagagggtcaccgtctcctgcctctggaagccgcctaccaacattcggctaacgaattatgtactcctaggtaccagccaccgttccccgggacacgacccccaaactcctcatactatagtaagtactttaccgccgtacccctcgacgggtacttccgtcggcctattccgtcgtcggtcctaccgaacgtcacggacctacctcctcgacccaacccgtggaacctacgtccgaccggcctaccgacgggaccggggacgacggtaccgtaattacgttacgtcggaccgtacctaacggttcggaaccctaccaaaccgttcgtaccgtttcgggttcggggtccgttttaccggggacgggtaacgggtaacgttaacggttcggtaacccgttcgttacggtcgaccgtaccgaacggtcctccgtcccccgtcggtacctaccgttccgtaccggttcccccacccgttccctccctaaccttacgtacgtcgtaccgtaggacggtcggtcggtaccggg

SEQ ID NO: 62748 - DNA, 710 bp, Homo sapiens
  misc_feature: GYAE6OF01A7BX1.10.86.H09.1.454.CMB.1.raw
  modified_base (465)..(465): a, c, t, g, unknown or other
  misc_feature (465)..(465): n is a, c, g, or t
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggcccaggacaggagggtcaccgtctcctgctcgtggacgccgcctcaacagttcggcaacgtaattatgtactccgtaggtaccagcctaccgttccccgggacacgacccccaaactcctacactctatgaacgtacttttaccgccgaccctcgacggtacttccgtggccgtattcctcgtcgtcctaccgaacgttcgacggcctaccgtctccgacccacccgtcggactacgtaccgaccggcctaccgaacgggacccggggacgacggtaccgtaagttacttaccgngaccgacgtaacggttacggaacctaccaaccgttgaccgttgggttcgggtcgtttcgggacgggtaggtaccgttaacggtcggtacccgttaccgtaccggtacgaccgtacccgaacggtcccgtccgcccccggttcgtaccgtacccgtccgttcccgttacccccgtaccccttccctaccctaaccgttaaccgttacgttaccggtaccgtacgggacggtccgggtctaccgggg

SEQ ID NO: 62749 - DNA, 734 bp, Homo sapiens
  misc_feature: GYAE6OF01DGG5H.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagccgcctccaacattggcacgaattatgtatcctggtaccagcacttccccgggacacgcccccaaactcctcactctatgaagtattttaccgcgacccctcgagggtactttccgtggcccgtatttcctctggctccaagtcaggcacctctcgccaccctggacactccgaccggctccgaggacccggggacgacggccgatttacttaccgtgaccgtacaaacggtttcgggacctacccgtaaaccgtggtaaccgttgggtttccgggggtccttttccggggaccgggtaacggggtacctttaaagggtttcggaaccccggtttccggttaaccggttaccgtaaccggtaccccgaaagggtcccttcccggtacccccccggtttcgggttacccacccgtttcccggttacccggtttcccccccggtcccctttccccgttaccccttaacccgtttaaccttaccggttcggacccggttgggaaccgggcccggggtcccgtaccggggg

SEQ ID NO: 62750 - DNA, 863 bp, Homo sapiens
  misc_feature: GYAE6OF01DSGHJ.10.86.H09.1.454.CMB.1.raw
  modified_base (162)..(162): a, c, t, g, unknown or other
  misc_feature (162)..(162): n is a, c, g, or t
tcagcatagtagtgcacgaccggtgctcgatttagtgctatagacttgggtttggggactcgggacaatcttcatcatgacctgcctcccctctcctcctctcccttctcattcactgcacagggtccctgggcccagttctttgtgacgcacgccgccctnagtgtctgccggacccaggacaggacggtcaccgtctcctgctcgaggacgcctcctacaacattggacaacgtaattatcgtaacttccgtagtaccagcctaccgttccccggacaccgaccccctaaactcctacacttactaagtacgtaaacgtaacgttttaaccggacccgtaacccgttacgacggggttaccttaccgtacggtacccgtatttccgtccgtaggtaccctaccgtaaacgtccgaaggtccctaccgttacgccgacccgtaaccccgtaggaaccctacgtaccggtaacccgggtacctacccggaaacggggaaccccggggacggtaaccgggtaacccgttaatttaacgttacctacgggacccgtaacgttaaaccggtttaccgggaaccttaacccgaaaccgttcggtaacggtttggggtttaaccgggttccggtttacgggggtaacccggggtaaagggttaaccgttaaacggtttaacccggtaccccgtttaaccgtaaccggtaccgtaaacccggaccccggttaaagggccccgtttacccggaccccccggtttaccggtacccttacccgttaccgttacccgttaccccctacccccgttaccctaccctaaccgttacctacgtacgccgtagggtaacggcccgtacggtacccgg

SEQ ID NO: 62751 - DNA, 417 bp, Homo sapiens
  misc_feature: GYAE6OF01DTZGC.10.86.H09.1.454.CMB.1.raw
  modified_base (407)..(417): a, c, t, g, unknown or other
  misc_feature (407)..(417): n is a, c, g, or t
tcagcatagtagtgcacgaccggtgctcgatttagtgctatagacttgggtttggaagcgcctccaacattggcacgaattatgtatcctggtaccagcacttccccgggacagcccccaaactcctcatctatgaagatttttacgcgaccctcagggattcctggccgattctctggctccaagtcaggcacctctgccaccctggacatcaccgggctccagaccggggacgaggccgattattactgcgcaacttggactccaacctgactggttggggctttcggcggagggactaagttgaccgtcctacgtcacgcccaaggctcgccccctcggtcactctcgttccccacctcctccactactatcgctgagcggggtctgggacaaggcgcagtagnnnnnnnnnnn

SEQ ID NO: 62752 - DNA, 764 bp, Homo sapiens
  misc_feature: GYAE6OF01CT61U.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagttctttgtgacgcagcccgccctcagtgtctgccggcccaggacaggagggtcaccgtctcctgctcgtgggaacgccgccctaccaaactagttcggacaacgtaattatgtactccgtggtacccagtcctaccgttccccggggacaccgaccccccaaacttccctacattcctaatagaaagtactttttaccggaccgtacccctcgaagggtactttcccgtacggcccgtactttcctcgtcggtcctaccgaagtccgaaggcctacctctcgcccaccgtggacactccgaccgggtcctaccgacgggacccggggacgaacgggtcccgtaatttacgtacgtcggaccgtacgtaacgttacgggacctacccgtaaccgtcggtacgttcgggttcgggtccgtttccggggcgggtaacgggtacgttaaggttaccgggtaccccgttaccgtaccgtaccggaccgtacccgtaacggtcccgttcccggaccccccggttccggttacccacccgttcccttcccggttccccctacccccttcccttaccccgtaaccttaaccgttacgtccggtaccgttagggaccgggtccgggtcggtacgggg

SEQ ID NO: 62753 - DNA, 756 bp, Homo sapiens
  misc_feature: GYAE6OF01BLH2O.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgcctcagtgtctgcggcccaggacagaggtcaccgtctcctgctctggaacgccgcctccaacattggacacgaattatgtactcctggtaccagccaccgttccccgggacaccgaccccaaactcctcatctatagaacgtattttaccgcgaccctacgtagggtacttccgtcggccgtagtttcctcgtcggccttaccgaacgttcgacggtccctaccctctcgcccaccctagggaacctacgtccgacccgggcctacccggaacgggacccggggacgacggtacccgtaatttacgttaccgtggaccgtaccgtaaacgttccgggaacctccgaaaccgtcggtacgttggggttcgggtccgttttccggggacggtacggggtaacttacgggttaccggtacccgttacgtaaccggtcgaaccggtcccgaacggtccgtacccggcccccgtttacgggtacccttaccgttccccggtttacccgttaccccccgtacccccgtttaccccttaccccgtaaccgtttaccctacgttaccgtaccggttaggtaacccgggtcccggggttcggtaaccgggg

SEQ ID NO: 62754 - DNA, 432 bp, Homo sapiens
  misc_feature: GYAE6OF01B23ET.10.86.H09.1.454.CMB.1.raw
  modified_base (422)..(432): a, c, t, g, unknown or other
  misc_feature (422)..(432): n is a, c, g, or t
tcagcatagtagtgcacgaccggtgctcgatttagtgctatagacttgggtttggaagcgcctccaacattggcacgaattatgtatcctggtaccagcacttccccgggacagcccccaaactcctcatctatgaagtattttacgcgaccctcgagggattcctggccgattctctggctccaagtcaggcacctctgccaccctggacatccgaccgggctccaggaccggggacgacggccgattattactgcgcaacgttgggacctaccaacctgactggttggggtctttcgggcggagggactaagttgaccgtctacgtcagcccaaggcctcgccccctcggtcactctcgttcccaccctcctccactactactcgctcggacgtcggcgtggaccaaggccgacagtagnnnnnnnnnnn

SEQ ID NO: 62755 - DNA, 1061 bp, Homo sapiens
  misc_feature: GYAE6OF01CNU25.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagttctttgttgacgcagccgccctcagtgtctgccggcccaggacaggacgggtcaccgtctcctgctcgtggaagccgcctacccaaactagttcgggacctaacgtaaatttacgtgttaaccttccgtacgggtaacccacgtacccgtaacccgttcccccggggaaccaaccggtaccccccctaaaaaccttccccttaccaacgttaccttaagtaacggtaaacggttaactttttaacccggacccgtaacccccgttccgtaaacggggttaccttttccccggtacgggtaccccgttaacgttttcccgttccggttaccgggtacccttaaccccgtaaacgttccgaaccgggtcctaaccccgtccgttacccggtacccctaaccccggttacggaaaccctaccgttacccggaaccccgggttaccccgttacccggaaaccgggggaaccccgggggtaccggtaaaccggggtacccggtttaaacgtttaacgtttaaccgggtccggtacccggtaaaccgttaaccgggtttaccgggtaaccctaaccccgttaaaccggttaccggttacggtttacggggtttaccgggggttacccggttttacgggggaccggggttaaacgggttaaaccgtttaacgggtttaaccggtacccggttaccggttaaccggttacccgtacccgggtaaccccggtaacggttaccccgttaccccgggtcccccccggtttacggtaccccgttaaaccccggtttcccggttttacccccgggttacccccccgttacccctttaccccccggtaaccccgttttaaaccccgtttaaccgttacccgttacccgtaccgggttaacggtaccccggggtccggggtacccggttaacccggggg

SEQ ID NO: 62756 - DNA, 650 bp, Homo sapiens
  misc_feature: GYAE6OF01B06X4.10.86.H09.1.454.CMB.1.raw
  modified_base (219)..(219): a, c, t, g, unknown or other
  misc_feature (219)..(219): n is a, c, g, or t
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgccggcccaggacagagggtcaccgtctcctgctctggaagccgcctccaacnttggcacgaattatgtactcctggtaccagccaccgttccccgggacaccgacccccaaactcctacattctatagaagtattttaccgccgtaccctcgagggtacttccgtggccgtattctcgtcggctaccgaagtcgacggccacctcgtcgcccacccgtggacactccgaccgggctaccgacggaccggggacgacggaccgtattactacgtcgcgtacgtaacgttcgggacctaccgaaccgtcgtacgttgggttcgggtccgtttcgggacggtagggtacgtaagttcggaccgttccgtacgtcgtacgccgtaacggtcctaccgccccgtcggtccaccgttccgtcccgttacccctacccttccctccctaccttactacgtcgtacgtcggacggtccgggtcggtacggg

SEQ ID NO: 62757 - DNA, 871 bp, Homo sapiens
  misc_feature: GYAE6OF01AXNXH.10.86.H09.1.454.CMB.1.raw
  modified_base (274)..(274): a, c, t, g, unknown or other
  misc_feature (274)..(274): n is a, c, g, or t
tcagcatagtagtgcacgaccggtgctcgatttagtgctatagacttgggtttggggactcgggacaatcttcatcatgacctgctcccctctcctcctctcccttctcattcactgcacgagggtcctgggcccagttctttgttgacgcacgcccgccctcagttgtctcgccggccccaggacaggacgggtccaccgttctcctgctcgtggaacgccgtccctaccaactagttcggactaacgtaattagtcgtactccgtggtaccncgcctaccgttcccggaccaccgaccccctaacctcctactactactagtagtaacgttacttttacccggccgtaaccccgtcggaacgggttacctttccggtaccgggtaccgttacgtttccgtaccgtcggtacccttaccgtaacggtccgacggtaccctaccctccgtaccgacccctacccggtacggacctaccgtacccggacccgggtaccctaccgggaacccggggacccgggggaaccggtaccgggtaccgttaacgtttacgttaccgtacgaccgtaccgttaaccgggttaccggaacctaacccgtaaccgtacggttaccggttcggggtttcggggtccggtttaccggggaccgggtaacgggttaaccgttacgggttaccggttaaccccgttaccggttaccggtacccggaacccggtacccggtaacccggtcccgttacccccggtcccggttccggtacccttcccgttcccggttcccgttcccccggtaccccttacccgttcccctaacgttccccgttacggtccgtaccggaccgggtacggtcccgggtcggtaaccgggg

SEQ ID NO: 62758 - DNA, 673 bp, Homo sapiens
  misc_feature: GYAE6OF01D29LE.10.86.H09.1.454.CMB.1.raw
  modified_base (179)..(179): a, c, t, g, unknown or other
  misc_feature (179)..(179): n is a, c, g, or t
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgtgacgcagccgcctcagtgtctgccggacccaggacngaggtccaccgtctcctgctcgtggaacgccgcctaccaaactgttggactaacgtaatttagtgttactccgtaggtaccagacctaccgttcccgggacaccgaccccctaaactcctacatactaagtagtaagttactttacgaccgtaccgtcgacgggtacttccgtcggtacctattcgtacgtcggtacctaccaacgtcgacgtccaccgtcgtccgtacccgaccgtacgactacgtccggaaccgggtcctaccggaacggaaccggggacgacggtaccgtattacgtacgcgacgacgtaacgttcgacctaccacgtagtacgttggtcggtcgttcggacggtacggtaactacgtcgtaccgtaccgtacgcgtacgacccgagtccgtcccgacccgtcggtcctaccgttccgttcccgtcccctaaccttcctaccctaccgttacgtcgtccgcgtaggcgcgggttccgcggg

SEQ ID NO: 62759 - DNA, 676 bp, Homo sapiens
  misc_feature: GYAE6OF01AE85G.10.86.H09.1.454.CMB.1.raw
tcagcatagtagtgcacgaccggtgctcgatttagtgctatagacttgggtttgggactcgggacaatcttcatcatgacctgctcccctctcctcctctcccttctcattcactgcacagggtcctgggcccagtctttgttgacgcagcccgccctcagtgtctgccggccccaggacaggagggtcatcgtctcctgctcgtggaagccgccctaccaactagttgggaccacgaatttatgtactcctaggtaccagccaccgttccccgggacaccgacccccaaactccctacatctatagaagtacttttaccgaccgtaccctacgaggtacttccgtcggaccgtatttcctacgtggacctacctaagtcgacggcctacctcgtcgaccctacccgtcggaccacgtccgaccgggcctaccgacggtaccggggacgacggtaccgtacgttactacgtgaccgaccgtaaacgttacgggacctaccgtaacctcgtacgttacgggtcgggtcgttcgggacgggtagggtaccgttaacgttcgacccggttcctacgtcaaccggccaacggtcctaccgccccgtccggtctaccgtccgtcccgttcccgtccctcccctacctaccttacgtacgcgtacctcggcggtcggtccgg

SEQ ID NO: 62760 - DNA, 825 bp, Homo sapiens
  misc_feature: GYAE6OF01CAXJX.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagttctttgttgacgcacgccgccctcagtgtctgccggcccaggacaggaggtcaccgtctcctgctcgtaggacgccgcctaccaaactagttcggcaacgtaattagtcgtacttccgtcggtaccacgaccgtaccgttaccccggaacaccgaccccctaaactccctacactctattagaaacgttacgttttaccgaccgtaccctacggtaacggtacttccgtcggtaccgtactttcgtcgtcggtaccctacgtaaacgttcgaccggtcctaacccttcgtccgacccctaacccggttgaaaccgtacgttacccggaacccggtacctccggaaacggggaccccggggaacggtaccgggtaccgttaactttaacgttaccggttacgacccggtaccgtaaaccggttacgggtaacccttaacccgtaaaccgttcggtacggttcgggtttcggggttccgttaccggggacgggtaacggtaaccgttaacgggttccggtaacccgttaccgttaaccgaccgtaccgtaacccgtaacgggtccgtcccgtacccccggttcgttccgtacccgttccgttaccccgttccccgtccccttacccgttacccgtaaccttacgttaaccgttcggtaccgtaccggtacggtccgggtcgtaaccgggg

SEQ ID NO: 62761 - DNA, 677 bp, Homo sapiens
  misc_feature: GYAE6OF01D4MNS.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagttctttgttgacgcagccgccctcagtgtctgcggccccaggacagagggtcaccgtctcctgctctggaagccgcctccaacattcggcacgaattatgtactcctggtaccagcaccttccccgggacacgccccaaactcctcatctatgaagtactttacgcgtaccctgagggtactttccgtggacccgtatttccgtctcggtcctaccgaagttccgacggcctaccttctcgccctacccgtcggacactccgacccgggtcctaccgacgggacccggggaacgacgggtaccgtatttacttacgtcggacgtactaacgttcgggaacctaccgtaacctggtacgttgggtttacggggtccgtttcggggacgggtaacgggtaacttaacggttcgaacccggttacctacggtacaccgtcccggaacggcctcccgccccgttccggtaccctacttcccgttccgttaccccctacccttcccctccaccttactacgtcgtacgtggacgcgggtctacggg

SEQ ID NO: 62762 - DNA, 670 bp, Homo sapiens
  misc_feature: GYAE6OF01EXLN7.10.86.H09.1.454.CMB.1.raw
  modified_base (373)..(373): a, c, t, g, unknown or other
  misc_feature (373)..(373): n is a, c, g, or t
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgccggccccaggacagagggtcaccgtctcctgctctggagccgcctccaacattggcacgaattatgtactcctggtaccagctaccgttccccgggacacgacccccaaactcctacatctatgtaagtattttaccgacgaccctcgacggtacttccgtggtccgtatttcctcgtcggcctaccgaacgtcaggccacctcncgcccacccgtggacacgtccgaccggtcctacccgacggaccggggacgacggccgtaattacttacgtacgccgtacgtaaccgttcgggaaccctacccaaccgttcggtacgttgggttcggggtccgtttacgggcgggtaacgggtaaccgttaaggttcggtacccgttaccgtaccgtaccgtaccgaccccgtaaggtccctccggtcccccgtgtcctacccgtcgttacccgttcccctaccctccctaccctaccgttatacgcgtcgtagcggccggtgtacgg

SEQ ID NO: 62763 - DNA, 635 bp, Homo sapiens
  misc_feature: GYAE6OF01BG0WB.10.86.H09.1.454.CMB.1.raw
  modified_base (166)..(166): a, c, t, g, unknown or other
  misc_feature (166)..(166): n is a, c, g, or t
  modified_base (197)..(197): a, c, t, g, unknown or other
  misc_feature (197)..(197): n is a, c, g, or t
tcagcatagtagtgcacgaccggtgctcgatttagtgctatagacttgggtttggggactcgggacaatcttcatcatgacctgctcccctctcctcctctcccttctcattcactgcacagggtcctgggcccagtctttcgttgacgcagccgcctcagtgtcngcgcccaggcagaggtcacgtctcctgctcnggaacgcgctcaacattggcacgaattatgtactcctggtaccagctaccgttcccgggacacgccccaaactcctcatctaatgaagtcttttacgcgacctacgagggtacttccgtcggtccgaatttctcgttggtacctccgtaaggttccagggtccaaccttcgtacgcccaaccgttcggacaacgttccgaccgggtcctaccgaacggaccggggtacgacggaccgtattacgttacgtcgcgtactacgtacggacctaccgaaactcggtactggtttacgggtcgtttcgggcggtaacggtacgttaacggttcggaccgttacctcggtacgacgaccgaagccgtacgtccccgtgtcaccttctccgtcccgtccctccgtcctactacgttacgtcgtacagcggtccggtgtaaccgg

SEQ ID NO: 62764 - DNA, 827 bp, Homo sapiens
  misc_feature: GYAE6OF01A2P03.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgccggccccaggacagagggtcaccgtctcctgctctggaacgccgcctccaacattggcaacgtaattactgttaactccgtggtaccaggcctaccgttccccggggacaccgaccccccaaactccctcaatcctatagaacgtattttaccgccgtacccctcgagggtcttccgtggccgtatttctctggtcctaccgtaagtccaggccacctctcgcccacccgtggaccacgtccgaccgggcctccgacgggtacccggggacgacgggacccgtattaacgttaccgtggaccgtacctaaaccggtttcggggaacccttacccgtaaacccgttgggtaaccgttcgggtttcgggggtacccgttttaccggggaccggggtaacgggtaaccgtttaacgggtttaccggtaaccccggttaccggttaacccggtaccgtaacccggtaccccggtaaacgggttccccgttccccggtaccccccggttcgggttacccctacccggtttcccgtttacccccggtttccccccccggccccctttaccccggtcccccctttaaaccggtttaaccccgttaacgttcccgggtacccgttaccggggaacccgggttccccggggtaccggtaccccggggg

SEQ ID NO: 62765 - DNA, 1012 bp, Homo sapiens
  misc_feature: GYAE6OF01BF514.10.86.H09.1.454.CMB.1.raw
tcagcatagtagtgcacgaccggtgctcgatttagtgctatagacttgggtttggggactcgggacaatcttcatcatgacctgctccctctcctcctctcccttctcattcactgcacagggtcctgggcccagtctttgttgacgcagccgccctcagtgtctgccggcccaggacaggacggtcaccgtctcctgctctaggaacgccgtccctaccaaacgtatttgggacctaacgtaaatttagtcggttaacttcccgttacgggtaacccaaggtacctaacccgtttacccccggggaaccaaccggtaacccccccaaaaacttccccttacaacttaccgttaagtaacggtaaagtaactttttaaccggaccgtaaccccgtttaccgaacggggttacttacccgttgggtacccgttaaagttttccttccgttcgggtaccttacccggtaaaacgtaccggtaacgggtccctaacccgttccgttaccggacccctaaccccgttggggaaaccctacgtaccggaacccgggtaccgttacccgaaacggggtaaccccgggggaaccggtacgggacccggttaagttttaaccgttaaccgttacggtaccggtaacgttaaaccggtttacgggacccttaacccgtaaaccgttacgggaaccgttttcggggttaccgggggttaccgttttaccgggggacggggtaaacgggttaaccggtttaaaaggtttacccgggttacccggttaaccccggtttaaccgggaacccgtaacccggtaaccccgggttaaacgggtaccccgttacccgggtaccccccccgtttacgggtacccgttaccccggttacccgttaaccccgggttttcccccggtccccccgtttacccggtaacccccgttaacccgttaacccgtttaaccgggtaccgttacccggttaacggggaaccgggttcccgggggtccggttaaacccggg

SEQ ID NO: 62766 - DNA, 752 bp, Homo sapiens
  misc_feature: GYAE6OF01D5DUD.10.86.H09.1.454.CMB.1.raw
tcagcatagtagtgcacgaccggtgctcgatttagtgctatagacttgggtttggggactcgggacaatcttcatcatgacctgcctcccctctcctcctctcccttctcattcactgcacgagggtcctgggccctagttcttttgtgacgcacgcccgcctcagtgtcgtcgccggcccaggacaggacggtccaccgttcctccgtgcctcgtaggaacgccgcctaccaaactgttcggactaacgtaattagtcgtactccgtacggtaccacgccgtacccgttaccccgggaccaaccgaccccctaaacctcctactaactcgtaatagtaaacgttaacgttttacccgaccgtacccctacggacgggttacttccgtcggtccgtacttcctcgttcggcctaccgtaacgtcgacggtacctaccgttccgtaccgacccgtaaccgtacggtacctaccgtaccggaccccgggtccgtacccggaacggggaacccgggggaacgacgggtaccgttaactttacgtaccgtcgtaccgtacgtaacggttacgggtacctaacccgtacgtacgtacgttggggttcggtcggttcggacgggtacgtacgtacgtcgtaccgtcgtaccgtacgtacgaccgtacgtccgtcccgtcccgtcgtcctccgtccgttcccgtccccgtccccttacctccacttccgtacgtcgtcgtacggcggtcggcggtacgg

SEQ ID NO: 62767 - DNA, 764 bp, Homo sapiens
  misc_feature: GYAE6OF01CKBJK.10.86.H09.1.454.CMB.1.raw
  modified_base (412)..(412): a, c, t, g, unknown or other
  misc_feature (412)..(412): n is a, c, g, or t
  modified_base (429)..(429): a, c, t, g, unknown or other
  misc_feature (429)..(429): n is a, c, g, or t
tcagcatagtagtgcacgaccggtgctcgatttagtgctatagacttgggtttggggactcgggacaatcttcatcatgacctgctcccctctcctcctctcccttctcattcactgcacagggtcctgggccctagtctttgttgacgcagcccgccctcagtgtctgccgccccaggacagagggtcaccgttctcctgctcgtggaacgccgccctaccaactagttggaccaacgtaatttagtcgtactccgtaggtaaccagaccgtaccgttccccgggacaaccgaccccctaaactcctactactactagtagtaacgttactttacgaccgtacctacgtacggtactttccgtcggtacccgtacttcctcgtcgactaccgaagtcgacggctaccgtcnccgaccgaccgtcgacncgtccgaccggtcctacccgacgggaaccggggaccgacgggtacctaagttacgtaccgtcgaccgtacgtaaccgtcggtaacccttaccgtaaaccgtcggacgtttgggttccgggttaccggttaccgggacgggtaacggtaaccgttaacggtaccgtacccgtaccggtaccgtccgaaccggtacccggaagttcccgccgtacccccggtcgttaccccgtaccgttcccgtacccgttccccccgtaccccgttccctacccccgtaaccttacgttacgttacggtaccggttgggtacccgggccgggttccgtaacccggg

SEQ ID NO: 62768 - DNA, 431 bp, Homo sapiens
  misc_feature: GYAE6OF01A0OAT.10.86.H09.1.454.CMB.1.raw
  modified_base (421)..(431): a, c, t, g, unknown or other
  misc_feature (421)..(431): n is a, c, g, or t
tcagcatagtagtgcacgaccggtgctcgatttagtgctatagacttgggtttggaagcgcctccaacattggcacgaattatgtatcctggtaccagcacttccccgggacagcccccaaactcctcatctatgaagattttacgcgaccctcagggattcctggccgattctctggctccaagtcaggcacctctgcccaccctggacatcgaccgggctccaggacccggggacgacggccgtattattactgcgcaacgttgggacctccaacctgactggttgggcttcgggcggagggactaaggtcgaccgtcctacgcacgcccgaaggcctcgccccgtcggtcactctcgtccccgccctcctccactactagtcgctggacggcgggctcggacgaacgggccacgatgnnnnnnnnnnn

SEQ ID NO: 62769 - DNA, 736 bp, Homo sapiens
  misc_feature: GYAE6OF01BEDKH.10.86.H09.1.454.CMB.1.raw
  modified_base (214)..(214): a, c, t, g, unknown or other
  misc_feature (214)..(214): n is a, c, g, or t
tcagcatagtagtgcacgaccggtgctcgatttagtgctatagacttgggtttggggactcgggacaatcttcatcatgacctgctcccctctcctcctctcccttctcattcactgcacagggtcctgggcccagttctttgttgacgcagcccgccctcagtgtctgccggccccaggacagaggtccaccgtctcctgctctggaacgccnccctccaaactagttcggaccaacgtaaatttatcgttaatcccgttaggtacccagcctacccgttcccccgggacaaccgacccccaaactccctactatctatagaaagtacttttaccgccgaccctcgacgggtacttccgtggcccgtatttccgtcgtcggcctaccaagtccacggccacctctcgccaccctcgacacgtccgacccggctcccgaaggacccgggacgacggccgtattacttacgtgccgtacgtaaaccgttcgggaaccctaccaaccgttaggtaccgttcgggtttcggggtacccgttttccggggaccgggtaagggtaaccttaaggttccggaacccgttacccgtaccggtaccgtacggaccccgtaaggtccctccggtcccccgtacggtctcccgttaccgttcccgtttcccccgtaccccttccccgtacccgtaacccttaccgtacgttccgacccgttaggacccgggtccggtcgtaccggg

SEQ ID NO: 62770 - DNA, 728 bp, Homo sapiens
  misc_feature: GYAE6OF01DI0WB.10.86.H09.1.454.CMB.1.raw
  modified_base (566)..(566): a, c, t, g, unknown or other
  misc_feature (566)..(566): n is a, c, g, or t
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgtgacgcagcccgccctcagtgtctgccggcccaggacaggacggtcaccgtctcctgctcgtggaagccgcctaccaaactagttcggaccaacgtaattagtgttactccgtaggtaaccagcctaaccgttcccccgggaacaaccgacccccaaaactccctacactactatagtaaagtactttaccgccgtaccctcgacggtacttccgtcggtaccgtactttctcgtacggtcctaccgaacgtcgaacggcctaccttccgtaccgtaccctaaccccgtacggacctacgtcccggacccggtccgtaccgaacgggaccggggaacgacggtaccgtaatttacgtacgcgtacgacgtaacggttcggacctacccgtaacgtcgtacgtgggttcgggtcgtttaccgggngggtaacggtacgttagttcgaccgtaccgtaccggtcgaccgacccgaggtcccgtcccgtccccgttcgtacctacccgttcgttcccgttcccccgtacccttcccctaccctaccgttacctacgtccgtacgtacggaccgggtcggcgtaaccggg

SEQ ID NO: 62771 - DNA, 821 bp, Homo sapiens
  misc_feature: GYAE6OF01DJOP3.10.86.H09.1.454.CMB.1.raw
  modified_base (194)..(194): a, c, t, g, unknown or other
  misc_feature (194)..(194): n is a, c, g, or t
tcagcatagtagtgcacgaccggtgctcgatttagtgctatagacttgggtttggggactcgggacaatcttcatcatgacctgcctcccctctcctcctctcccttctcattcactgcacgagggtcctgggccctagttctttgttgacgcacgcccgtccctcgagtcgtcgtcggccgggaccccggganaggacgggtccaccgttctccgtcgcctcgtacggaacgccgtacctaccaactacgttcggaactaacggtaattagttacgtacttccgtacggtaaccacgtaccgtacccggttaccccggaacaacccggtaaccccctaaactcctactaacttaccgttagtacggtaaacgtttaccgtttaacccggcccgtaacccgtacggtacggttacctttccggtaccggtaccttacgtttccgtacgtcgtacctaaccgtacgttcgaaccgtcctaccgttcgaccgtacccgtaaccgtcgaaccgtcgtacccggccgggtacctaaccggacgggacccgggacggtacgtaccgttagtttactcggtaccgacgtaccgtaacggtccggtaaccctaccgtaacgtacgttcggttacgggttcgggttaccgttacgggacgggtaaccggtacgtttaacggtccggtacccgttcgtaccggtaccgaccggtaccggtacgtcccgtacccgtcccgtacgaccttacgtcccttaccgtaccccctccgttcctaaccgtacgttacctacggtcgtaccgtacggacggccggtcgcggtaaccgg

SEQ ID NO: 62772 - DNA, 801 bp, Homo sapiens
  misc_feature: GYAE6OF01AG3WI.10.86.H09.1.454.CMB.1.raw
  modified_base (159)..(159): a, c, t, g, unknown or other
  misc_feature (159)..(159): n is a, c, g, or t
  modified_base (211)..(211): a, c, t, g, unknown or other
  misc_feature (211)..(211): n is a, c, g, or t
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgtgacgcagcccgccctnagtgtctgccggcccaggacaggagggtccaccgtctctgctcgtgggaacnccgcctaccaaactgttcggacaacgtaatttagtgtactccgtaggtaccagtcctacccgttaccccgggacaccgaccccctaaactcctacacttactagtacgtaagttacgtttaaccgccgtacccctcggacggtacttccgtcggtccgtattccgtcgtcggtcctacgaagtcgacggccctaccgtcctccgacccgtaccgtaggacctaccgtcccggacccggtccgtacccggaacgggtaacccgggggaccggtaccgggtaccgttaactttacgttaccggtacggtaccgtaccgttaaccggttaccgggaacccttacccgtaaccggttacgtaccgggtttcggggttacgggttcccgttacggggacggggtaacggtacgttaacgggttccggtacccgttacccgttacggtaccgaccggtacccggaaccggtcccgtacccggtcccccgttacggttcccgtacccttacccggttccccgttccccctacccctttcccgtaccctaacttccgtacgttacgacggtacggaccgggttccgggacgtaccggg

SEQ ID NO: 62773 - DNA, 636 bp, Homo sapiens
  misc_feature: GYAE6OF01E2HNZ.10.86.H09.1.454.CMB.1.raw
  modified_base (220)..(220): a, c, t, g, unknown or other
  misc_feature (220)..(220): n is a, c, g, or t
tcagcatagtagtgcacgaccggtgctcgatttagtgctatagacttgggtttggggactcgggacaatcttcatcatgacctgctcccctctcctcctctcccttctcattcactgcacagggtcctgggcccagttctttgttgacgcagccgccctcagtgtctgccggcccaggacagaggtcaccgtctcctgctctggaacgcgcctaccaatnttggacacgtaattatgtactccgtaggtaccagcctaccgttcccggacacgaccccaaactcctcatctatagaagtactttacgcgtacctcgaggtacttccgtcggtccgtacttctcgtggtcctaccgtaacgtcgacggcctacctcgtcgcccacccgtacggacctacgtccgacccggtcctaccgacggaccggggacgacggtaccgtacttatacgtcgaccgtactaacgttcggacctaccgaacgtcgtacgttggttcggggtctttccgggagggtacggtacgtacggttcgtacccgtacctacgtacacgacccgtaacgcctccgccccgtcgtcctaccttctccgtcccctacctccctccactactactcgactgacggtcgtcgtacgg

SEQ ID NO: 62774 - DNA, 888 bp, Homo sapiens
  misc_feature: GYAE6OF01CF71N.10.86.H09.1.454.CMB.1.raw
  modified_base (254)..(254): a, c, t, g, unknown or other
  misc_feature (254)..(254): n is a, c, g, or t
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgccggccccaggacaggagggtcaccgtctcctgcctcgtggaagccgcctccaacattggcaacgaattatgtactccgtggtaccngcctaccgttccccgggacaccgacccccaaactcctactactctaatagaacgtacttttaccggccgtaccctcgacgggtactttccgtcggacccgtatttccgtcgtcggtacctacccgtaaacgtccgaacgggtccctaacccgttccgtaccgtacccccgtaccccggttacggaacctaacccgtcccggaaccccgggtccctacccgggaaccggggaaccccgggggacgtaaccggggtacccgttaacgtttaacgttacccggtacggtacccgtaacgttaaaccgggttaccgggtaacccttacccgtaaacccggttcggtaccggtttacggggtttcgggggttcccggttttaccgggggaaccggggttaacggggttaaccgtttaaacgggtttccggtaaccccggtttaacccgtaccgggttaccgtaacccgggaccccggtaacgggtccccgttccccgggtcccccgttaccgggttaccctacccgtttacccgtttcccccggtttacccccctaccccgtttacccccgtaccctaacccgtttaccgttacgtccggttaccggtacgggtaaccgggtccgggacgtacccgggg

SEQ ID NO: 62775 - DNA, 778 bp, Homo sapiens
  misc_feature: GYAE6OF01CI82Y.10.86.H09.1.454.CMB.1.raw
  modified_base (722)..(722): a, c, t, g, unknown or other
  misc_feature (722)..(722): n is a, c, g, or t
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgtgacgcagccgccctcagtgtctgccggccccaggacaggacggtccaccgtctcctgctcgtggaacgccgcctaccaaactacgttcgggaccaacggtaatttatcggttaacttcccgtaggtacccagtccgtaacccgtttcccccgggaacacccggtacccccctaaaacttccctactaactcttaagtcgtaaacggttacttttaccggcccgtaaccccgtacgtaacggggtacctttcccggtgggtacccttaacttttccgacgttacgggtaccctaacccgtaaaggttccgtaacggcctaacccgttcgtcccgaccctaacccggtgaacctacgtccggaaccgggtcctaccgaacgggaccgggacgacggtccgttaattacgttacgcgaccgtacgtaacgttcggacctaccgaacgtggtcgttcgggttcgggtacgtttccgggacgggtaacggtacttaacgggttcgacccgttaccgtacgtaccgaccgacccgtaacggtccgtcccgtaccccgttcgtcctaccgtccgtcccgttccccncccgttccctaccgtaacttaccgtacgtcgtactaggacgtcgggtccgtacggg

SEQ ID NO: 62776 - DNA, 1129 bp, Homo sapiens
  misc_feature: GYAE6OF01CPO84.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgtgacgcagccgccctcagtgtctgccggcccaggacaggacgggtcaccgtctcctgctcgtggaacgccgaccctaccaaacgtagttcggacctaacgtaatttatacggttacttcccgtacgggtaacccacggtcccgtaaccgttaccccccgggggaacctaaccggaccccccccctaaaaaccttccccttacctaaaccgttaccttaacgttacggtaaaacggttaacgtttttaaaccccggccccggtaaccccccgttaccggtaacggggtaccgttttaccccgttacggggtaccccgttaacgttttcccgttccggtttaccggggtaccccttaaccccggtaaacggttcccggtaaaccgggtccccttaaaccccgttcccgtttaccccggaacccccgttaaccccccgggttacgggtaaacccgtaaccggttaccccgggtaaacccccgggggttcccccttaacccccggggtaaaaccggggggaacccccggggggggtaaacccgggtaaaccgggggtaccccggtttaaagttttaacccggtttaacccgtaaccggggtaccccggtaacccgttaaacccggggttttacccgggggtaaaccccttaacccccgtaaaaccccggtttcgggtaaacccgggtttcggggttttaaccggggggttcccggttttacccgggggaaccgggggttaacggggttaaacccgtttaaccggggtttaccgggtaaccccggttaccccggtttaaccggtacccgtaccgggaccccgttaaacgggtccccgttcccggtaccccccggttccggttaaccccttacccggttccccgtttaccccggtttacccccctaccccgtttacccccgtaccccgtaacccgttaacccgttaccgtccggttaacggtcgggtacccgggtccgggtacgtacccgggg

SEQ ID NO: 62777 - DNA, 472 bp, Homo sapiens
  misc_feature: GYAE6OF01EV32J.10.86.H09.1.454.CMB.1.raw
  modified_base (275)..(275): a, c, t, g, unknown or other
  misc_feature (275)..(275): n is a, c, g, or t
  modified_base (339)..(339): a, c, t, g, unknown or other
  misc_feature (339)..(339): n is a, c, g, or t
  modified_base (458)..(472): a, c, t, g, unknown or other
  misc_feature (458)..(472): n is a, c, g, or t
tcagcatagtagtgcacgaccggtgctcgatttagtgctatagacttgggtttggaagcgcctccaacattggcacgaattatgtatcctggtaccagcacttccccgggacacgccccccaaactcctcatctatgaagattttacgcgaccctcagggattcctggccgattctctggctccaagtcaggcacctctgccaccctggacatcaccgggctccaggaccggggacgaggccgattattactgcgcaacttgggacctccaaccngactggttggggtcgttcgggcggagggacgtaagttcgaccgtcctacgacacggacccgaangggccccttagggccccccctacgggttccaccgttccctcgtttcccccgcccctccctaccctaccttaccgtactggactgggacgtcggggctaggggccaagggcgacgatagnnnnnnnnnnnnnnn

SEQ ID NO: 62778 - DNA, 866 bp, Homo sapiens
  misc_feature: GYAE6OF01C9KKB.10.86.H09.1.454.CMB.1.raw
  modified_base (223)..(223): a, c, t, g, unknown or other
  misc_feature (223)..(223): n is a, c, g, or t
  modified_base (236)..(236): a, c, t, g, unknown or other
  misc_feature (236)..(236): n is a, c, g, or t
  modified_base (392)..(392): a, c, t, g, unknown or other
  misc_feature (392)..(392): n is a, c, g, or t
  modified_base (490)..(490): a, c, t, g, unknown or other
  misc_feature (490)..(490): n is a, c, g, or t
tcagcatagtagtgcacgaccggtgctcgatttagtgctatagacgttgggtttgggactcgggacaatcttcatcatgacctgctcccctctcctcctctcccttctcattcactgcacgagggtcctgggccctagtctttgtcgacgcacgccgccctgagtcgtctcgccggcccaggacagggtacggtccacccgtctccgtgccgttacgaggacnccgtaccacaacngttacggactaagtaattgtgtaccgtaccgtgaacccacgtcccgtaacccgtacccgggacacccgtaacccctaactccctatacttaccgtaatacggtaaactttacgtttaccgacccgtacccgtaggtacggttacctttaccccggnggtaccctagtttccgtccgtagggttacccaccggaaacgtccggaaccggtaccctaccgttacccgtccggaccccaacccggttaggaaacccnccggtttaccccgggacccggtaacccttaaccggggaccggggtaaacccgggaggtaaccggtaccctttaagttacgttacccgtacggcccgtaaacggttaccgggtacggtacccctaaacgttcccgtaggtaacccgggtttgggttacggttacccgggtttcgggaacggttaacgggttacgttaccgggttacccgtaccccggttaaccgttacccggtcggaacccgtacccgtacggttaaccccgtcccgggttacccctcggtaacccttcgtttccctaaccccggtttcccctaacctccccgtacccgtaaccttactaccgtcggtacaccgggcggtccgggtcgtaaaccggg

SEQ ID NO: 62779 - DNA, 409 bp, Homo sapiens
  misc_feature: GYAE6OF01AMQMB.10.86.H09.1.454.CMB.1.raw
  modified_base (234)..(234): a, c, t, g, unknown or other
  misc_feature (234)..(234): n is a, c, g, or t
  modified_base (397)..(409): a, c, t, g, unknown or other
  misc_feature (397)..(409): n is a, c, g, or t
tcagcatagtagtgcacgaccggtgctcgatttagtgctatagacttgggtttggaagcgcctccaacattggcacgaattatgtatcctggtaccagcacttccccgggacagcccccaaactcctcatctatgaagattttacgcgaccctcagggattcctggccgattctctggctccaagtcaggcacctctgccaccctggacatcaccgggctccagacccgggganaggccgattattactgcgcaacttgggactccaacctgactgttggggcttttcggcggagggactaagttgaccgtcctacgtcagcccaaggctgcccctcggtcactctgttcccgccctcctccactactatgctgagcgggctggcaggcgcatagcnnnnnnnnnnnnn

SEQ ID NO: 62780 - DNA, 755 bp, Homo sapiens
  misc_feature: GYAE6OF01BTQVE.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcacgccgccctcagtgtctgccggccccgaggacaggagggtccaccgtctcctgctcgtaggaacgccgcctaccaactacgttcggcaacgtaattatcgtactccgtcggtaccacgccgtaccgttccccggaccacccgacccccaaactcctctactctatgtaacgttactttaccgaccgtacccgtacggacgggttactttccggtacggtccgtactttccgtcgtcggtcctaccgtaagtccggacggccctaccgtcctccgaccctacccgtcggaacaccgtccgaccggcctaccggacggggaacccgggaccggacggtaccgttaagtttacgttacgtaccgtaccggtaccgtaaccggtttacgggaaccctacccgtaaaccgtgggttacccggtttagggttccgggggttaccgtttaccgggggaacgggtacgggtaaccgttacgggtacccgtaccggttaccgtaccgtacgacccgtaccgacggtcccgtcccgacccgtcgtctccttccgtcccttccccgacccttccctactacctacttcgtcgtcgtaggccggtccggtggtcggg

SEQ ID NO: 62781 - DNA, 742 bp, Homo sapiens
  misc_feature: GYAE6OF01BRK3C.10.86.H09.1.454.CMB.1.raw
  modified_base (312)..(312): a, c, t, g, unknown or other
  misc_feature (312)..(312): n is a, c, g, or t
tcagcatagtagtgcacgaccggtgctcgatttagtgctatagacgttgggtttggggactcgggacaatcttcatcatgacctgcctccctctcctcctctcccttctcattcactgcacgacgggtcctgggaccctagttctttgttcgacgccacgcccgcctcaggtcgtctcggcccggacccaggacacggacgggtccacccgtctccgtgcgtcgtaggaacgccgcctaccgaatagttcggacctaagtaactttgtagttacctccgtacggtaaccacgtacctaccggtccccggaanacccgtacccctaacgtcctacgatacgtaagtaggtaacttcgttaacgcctaccgtaggacggtactccggtcgaccttacttcgcgtcgtaccacgtaacgtccgacgtcctaccgtcgtaccgacccgtaaccggtacggtaacctacccgggacccggtaccggcccgtaaaccggaccggggaacggggtaccgaacgtccgttaagttcgtaccgtcggtaccgtaccgtaacggttcgaactccgtaacgtcgtacgttcggggttcgtacggtcggacggtaggtacgtacggtaccgtaccgtacctacgaccgaccgaccggtacgacccgtcccgtcccgtcgtacctcgttccgttcccgtcccgtacccgttccgtactcccgtaacttcgacgtcgtaccgcggtcgcgtaccgg

SEQ ID NO: 62782 - DNA, 523 bp, Homo sapiens
  misc_feature: GYAE6OF01DSWC9.10.86.H09.1.454.CMB.1.raw
  modified_base (476)..(476): a, c, t, g, unknown or other
  misc_feature (476)..(476): n is a, c, g, or t
  modified_base (482)..(523): a, c, t, g, unknown or other
  misc_feature (482)..(523): n is a, c, g, or t
tcagcatagtagtgcacgaccggtgctcgatttagtgctatagacttgggtttggaagcgcctccaacattggcacgaattatgtatcctggtaccagcaccttccccgggacagcccacaaactcctcatctatgaagtatttttaccgccgaccctcgagggacttcctggcccgtattcctctggcctaccaagtcaggccacctctcgcccacccgtggacatccgaccgggctccgacggaccggggacgaggcccgtattattactgcgactaacgttcgggacctacccaacgtgacgttgggttcggggtccgtttcgggcgggaaggtacttaaggttcgacccgtttccgtacgtcacgcccgaggtcctccgtccccgtcggtctacgttcctccgttccccacccctcctaccacttactctcgctggacggtccgggcgtcggacgaacgggccactagtagntcagcnnnnnnnnnnnnnnnnnnnnnnnnnnnnnnnnnnnnnnnnnn

SEQ ID NO: 62783 - DNA, 853 bp, Homo sapiens
  misc_feature: GYAE6OF01END73.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcgccccaggacagagggtcaccgtctcctgctcgtggaagccgcctaccaacattcggcaacgtaatttatcgtactccgtggtaaccagcctaccgttccccgggacaccgacccccctaaactccctacacttctaatagtaacgtacttttaccggccgacccctacgacggggtactttacccgtcgggtacccgtatttccgtcgttacgggtccttacccgaaaggttccgaacgggtccctaacccgttccgtaccggaccccgtaacccccgtacgggaacctaccggttacccggaaccccggggtccttaccccggaaccggggtaacccgggggaccggaaccgggtacccgtaatttacgttaccgtacggaccgtacgtaaaccgttcgggaacctacccgtaaacgttcggtaacggttcgggtttcggggtccgttttaccggggacgggtaacgggttaaccttaacgggtttacccggaacccggtttacccgttaacggtaccgtaaccggtaccccgtaaacgggtcccgtccccggtccccccgttcgggtaccctacccgtttacccgtttcccggttaccccccttacccccgttacccttacccctaaccttacccgttacgtaccggtaccgtacgggaccggtcccgggtcgtaaccgggg

SEQ ID NO: 62784 - DNA, 781 bp, Homo sapiens
  misc_feature: GYAE6OF01AKTZX.10.86.H09.1.454.CMB.1.raw
  modified_base (751)..(751): a, c, t, g, unknown or other
  misc_feature (751)..(751): n is a, c, g, or t
  modified_base (758)..(758): a, c, t, g, unknown or other
  misc_feature (758)..(758): n is a, c, g, or t
  modified_base (774)..(774): a, c, t, g, unknown or other
  misc_feature (774)..(774): n is a, c, g, or t
tcagcatagtagtgcacgaccggtgctcgatttagtgctatagacttgggtttggggtacgttcgggacgaatcttcatcatgacctgctcccctctcctcctctcccttctcattcactgcacagggtcctgggcccagtcttgttgacgcacgtccgccctcacgtgtctcgccgcccaggacagagggtcaccgtctcctgctcgtcggaacgccggaccctccaaacgtacgttggacctaacggtaaacttagtcgtaacttcccgtggtaacccgacgtcccgtaccgtttccccgggaaccaccggaaccccctaacctcctacacttcctaacgtagtaaacgttaccgttttaccgaccgtaaccccgtacggacggttaccgttacccgtcggacctacttacgtccgtaggtccctacgtaacgtccgtacgaccgtaccctcggtccacccgtaaccgcggaaccttagacccggtccggtacacccggtacgggaaccccggggtacgaccgggtacccttaagtttacctcggtacgtaccggtacgtaacgttcgggaaacccttcccgaaacgtttccgaacggttcggttacgggtacggtttccgggaacggttaacgggtacgtaacggttttaccgacccgtaaccgttccggactaaccggcctaaccgccgttacccggtcccctagtccgtacctcgttaccgtcccccacgtcccttccgaccttancgtaccncgtaacgcgcccgggntaccggg

SEQ ID NO: 62785 - DNA, 796 bp, Homo sapiens
  misc_feature: GYAE6OF01DNCRK.10.86.H09.1.454.CMB.1.raw
  modified_base (374)..(374): a, c, t, g, unknown or other
  misc_feature (374)..(374): n is a, c, g, or t
  modified_base (419)..(419): a, c, t, g, unknown or other
  misc_feature (419)..(419): n is a, c, g, or t
  modified_base (505)..(505): a, c, t, g, unknown or other
  misc_feature (505)..(505): n is a, c, g, or t
tcagcatagtagtgcacgaccggtgctcgatttagtgctatagacgttggggtttggggactcgggacaatcttcatcatgacctgcctcccctctcctcctctcccttctctattcactgcacgacgggtccgtcgggccctagttcgtttggttcgacgcacgtcccgtccctcgagtcgtcgtcggcccggcccaaggacaggacggtcctaccgtctccgtcgctacggtacgggaacgccgtaccctaccgaaactggttcggaactaaacgttaaatttacgtcggttaaccttccggttacgggaacccacgtacccgtaccccggttaccccggggaaccaacccccgaacccctaaactccttanaacttacctaagtacgtaacgttaccgttaccgcccgttaaccgnggtaacggttcctcgacggtccgttattccgtcggtcaccgttacgaacgtcgaccgtacctcctcggtaccacccgtaccggtanaaccgtacgtcccggaaccgggtacctaaccggggaacggggaccggggtaagtcgtacccgttattacgtcgccgacgtacgtaaccggtacgacctaacccggtagtacggtcggttcgggtcggtaccggtcgggaacggtacgttaacgtcggtaccgtccgtacctacgaccgtacccgacggtcgtcccgccggttccccgaacgttcctacccgttccgtcccgttccccgtacctcccctaccgtacctagtccgtactcgggtaacgcgggtcgccgtacgg

SEQ ID NO: 62786 - DNA, 826 bp, Homo sapiens
  misc_feature: GYAE6OF01EB5JB.10.86.H09.1.454.CMB.1.raw
  modified_base (206)..(206): a, c, t, g, unknown or other
  misc_feature (206)..(206): n is a, c, g, or t
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgccggcccaggacagaggtcaccgtctcctgctctggaanccgcctccaacattcggcaacgtaattatcgtactccgtggtaccagcctaccgttccccgggacaccgaccccctaaactcctacactctatacgtaagttacttttaccgaccgtaccctcggacgggtactttccgtcgggtacccgtatttccgtcgttcgggaccttaccgaaagtccgacggccctaccttccgtccgaccctacccgtacggaacctacgtcccgacccggtctacccgaacgggtacccggggacgacggccgttaactttacgttacgtcggaccgtacgtaacggttcgggtaccctacccgtaaccgttcgtaaccgtttcggggtttacgggtcccgttttacggggaccgggttaacgggtaaccgtttaaacgggttaccggtaaccccggtttacccgttaccggtacccgtaaccggaccccggtaaacgggtccccgttccccggtccccccgttaccgggttaccctaccccgtttcccgtttaccccgggttccccccgtcccccgtttaccccttaccccgtaaacccgtttaccgttaaccgttccggtacccgttacgggtaccgggtcccgggtcggtaacccgggg

SEQ ID NO: 62787 - DNA, 608 bp, Homo sapiens
  misc_feature: GYAE6OF01B2NIJ.10.86.H09.1.454.CMB.1.raw
  modified_base (575)..(608): a, c, t, g, unknown or other
  misc_feature (575)..(608): n is a, c, g, or t
tcagcatagtagtgcacgaccggtgctcgatttagtgctatagacttgggtttggaagcgcctccaacattggcacgaattatgtatcctggtaccagcaccttccccgggacacgcccccaaactcctcatctatggaagtattttaccgccgaccctcgagggtacttccgtggcccgtattcctcgtcgggcccttaccgaaggtccgaagggcccacccgttcctcgaccccacccgtgggacctacgtcccgacccgggtcctacccgacggggaccgggggacgacggaccgttaatttaacgttacgtccgccgaccgtaacggttcgggaccctaccaaccgttgtaccgttgggttcggggtcgtttcggggacgggtacgggtacgtaacggttccgaaccccggttcctaccggtccgaccggtaccccgtaacgggtccctccccggtcccccgttcggtacctaccttcgttcgttccccgtcccgtcccctccctcctaccttaccgtagtcggcgtacggccggtccgggtcgtacggaccggtagccgactaagtgcannnnnnnnnnnnnnnnnnnnnnnnnnnnnnnnnn

SEQ ID NO: 62788 - DNA, 442 bp, Homo sapiens
  misc_feature: GYAE6OF01BEW11.10.86.H09.1.454.CMB.1.raw
  modified_base (421)..(421): a, c, t, g, unknown or other
  misc_feature (421)..(421): n is a, c, g, or t
  modified_base (429)..(442): a, c, t, g, unknown or other
  misc_feature (429)..(442): n is a, c, g, or t
tcagcatagtagtgcacgaccggtgctcgatttagtgctatagacttgggtttggaagcgcctccaacattggcacgaattatgtatcctggtaccagcacttccccgggacagccccccaaactcctcatctatgaagattttacgcgaccctcagggattcctggccgattctctggctccaagtcaggcacctctgccaccctggacatccgaccgggctccgacggaccggggacgaggccgtattattactgccgacaacgttggggacctaccaacctgacttggttggggtcttttcggggcggaggggacttaagttgaccgtcctacgtcgacgcccaaggctcgcccctcggtcactcgtcgttccccgccctcctccactactatcgctggagcgggtctcggacaggcncagtagcnnnnnnnnnnnnnn

SEQ ID NO: 62789 - DNA, 769 bp, Homo sapiens
  misc_feature: GYAE6OF01CIIEN.10.86.H09.1.454.CMB.1.raw
  modified_base (158)..(158): a, c, t, g, unknown or other
  misc_feature (158)..(158): n is a, c, g, or t
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgtgacgcagccgccctnagtgtctgccggccccaggacagaggtcaccgtctcctgctctggagcgcctccaacattggcaacgtaattatgtatcctggtacccagcctaccgttccccgggacacgcccccaaactcctcactctatagaagtacttttacgccgaccctcgagggtacttccgtcggcccgtatttcctcgtcggcctacccgaagtcgaacggcctacccgtctccgccctaacccgtggacccagtcccgaacccgggtcctacccggaacggacccgggggaacgacgggtacccgtaatttacttacgtcggtaccgaccgtaaccgttcgggaaccttacccgaaaccgttcgtaccgttagggtttcgggggtaccgttttccggggacgggtaacgggttaaccgttaaggttccggtaccccgttacccgttaccggtaccgtacggaccccgaacggtcccgtacccgtccccccgttcggtacccaccgttccccgtttcccggttacccccccggtcccccttaccccgttacccctaacccgttaacccgttacgttacccgtaccggttacgggaaccgggtcccggggtcccgttacgggg

SEQ ID NO: 62790 - DNA, 675 bp, Homo sapiens
  misc_feature: GYAE6OF01A9MAF.10.86.H09.1.454.CMB.1.raw
  modified_base (615)..(615): a, c, t, g, unknown or other
  misc_feature (615)..(615): n is a, c, g, or t
  modified_base (644)..(644): a, c, t, g, unknown or other
  misc_feature (644)..(644): n is a, c, g, or t
  modified_base (650)..(650): a, c, t, g, unknown or other
  misc_feature (650)..(650): n is a, c, g, or t
tcagcatagtagtgcacgaccggtgctcgatttagtgctatagacttgggtttggggactcgggacaatcttcatcatgacctgctcccctctcctcctctcccttctcattcactgcacagggtcctgggcccagttctttgttgacgcagcccgccctcagtgtctgccggccccaggacaggagggtccaccgtctcctgctcgtaggaacgcccgccctaccaaactagttcggacctaacgtaaatttagtgttaacctcccgtggttaacccagtcccgtacccgttaccccgggacaacccgacccccaaaacctccctacactacctatacgaagttacttttaccgccgtaccctcgacgggtacttccgtcggcctacgttcctcgtcgcctaccgaagtcgacggcctacctcgtccgccctaccgtggacctacgtccgacccggtctacccggacgggtaacccggggacgacggtaccgtaactttacgtacgtcgacctactacggttacggacctacccaacgtcgacgttggtcggtcgttcggcggaggtactagtcgccgtcgtacgcacggacctaggcctccgtcccgtgtccnccgtacgtccgtcccctcctaccgtaccncgtacngtcgctaggcggtccggcgtacggg

SEQ ID NO: 62791 - DNA, 864 bp, Homo sapiens
  misc_feature: GYAE6OF01ACSZN.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctggcccagtctttgtgacgcacgccgccctcagtgtctgccggcccaggacagacgggtcaccgtctcctgctcgtggaacgccgccctaccaaactagtttcgggacctaacgtaatttagtcgttacttcccgtagggtaacccaggccgtaacccgtttcccccgggaacaccggacccccctaaaacctccctactacttccttaagtacgtaagttactttttaccggacccgtaccccgttcggaacgggtactttcccgtcgggtcccgtaactttcctaccgttcgggtcccttaccgtaacgtccgacgggtaccctaccgttccgtccgaccccgtacccgtaggaacctacgtcccgaccgggtcctacccggaacgggacccggggacgacgggtaccgtatttacgttaccgtcggaccgtacgtaaccggttcgggaaccttaccccgaaccgttcggtaccgtttcgggttacggggtccgttttaccggggaccggggtaacgggtaacgtttaacgggttaccggtaccccgttaccgttaaccggtaccgtaaccggtacccgtaacgggtccctaccccggtcccccgttccgggtacctacccgttcccgttcccggttaccccccgtccccctttacccgtacccccgtaaccgtttacccgttaccgtccggttaccgtaccgggacccgggttccggggtccgttaacccgggg

SEQ ID NO: 62792 - DNA, 921 bp, Homo sapiens
  misc_feature: GYAE6OF01EHK6J.10.86.H09.1.454.CMB.1.raw
  modified_base (269)..(269): a, c, t, g, unknown or other
  misc_feature (269)..(269): n is a, c, g, or t
  modified_base (289)..(289): a, c, t, g, unknown or other
  misc_feature (289)..(289): n is a, c, g, or t
tcagcatagtagtgcacgaccggtgctcgatttagtgctatagacttggggtttggggactcgggacaatcttcatcatgacctgcctcccctctcctcctctcccttctcattcactgcacgagggtcctgggccctagttctttgtgacgcacgcccgccctgagtcgtcgtcggcccggacccgaaggacgaggtacgggtcctaccgttcctccgtgctacgtaggacgccgaccctaccaacgtagttcggacaacgttaattntcgtactccgtacggtaccncgacctacccggttacccggaaccacccgtacccctaactccctactagttactagtagtaacgttacgtttacccgacccgtacccgtggtacgggttaccgttcccggtacgggtaccttcgtttaccgtcggtccgacttaccgaacggtcgaccgtaccctaccgtccgttaccgaccccgtaaccgtcggaacctacggttacccccgggaaccggtccccgtaccccggggaaaccggggaacccgggggtaaccggtacccgggttaccgtttaacgtttaccggtacccgggttaccggtacccggtaaccggttaacccgggtttacccgggaacccttaacccgtaaaccgggtcggttaccggggttttcgggttcccggggtttacggttcccggggaacgggttacgttaaacggtttaccgggtccccggtaaccgttaccggtacgacccgtacggacccgtaacggtccccgtaccccggttcccgttaccggtacccttacccggttacccgtttcccccgttaacccccgttccccgttacccgttaacccctccgttttaaccgaccggtttccgaccgggttacggaccgggtttcccgggcgtaccggggg

SEQ ID NO: 62793 - DNA, 739 bp, Homo sapiens
  misc_feature: GYAE6OF01BDPYF.10.86.H09.1.454.CMB.1.raw
  modified_base (257)..(257): a, c, t, g, unknown or other
  misc_feature (257)..(257): n is a, c, g, or t
  modified_base (437)..(437): a, c, t, g, unknown or other
  misc_feature (437)..(437): n is a, c, g, or t
tcagcatagtagtgcacgaccggtgctcgatttagtgctatagacttgggtttggggactcgggacaatcttcatcatgacctgctcccctctcctcctctcccttctcattcactgcacgagggtcctgggccctagttctttgttgacgcacgcccgccctcagtgtctcggccggcccaggacaggacgggtccaccgtctcctgcctcgtaggaacgccgtcctaccaacgtagttcgggacaacggtaattntacggtactccgtacggtaccacggtacctacccggttccccggaacacccgtaccccctaaacgtcctactactactagtacgtaacgttacgtttaccgccgtacctcggaacggtcttccgtacgtacctagttcgtccgtcgtacctaccgtagtccgacggacctacctcgaccncccgtaccgtcgaacctaccgtccggtaccggtccctaccggaccggggtaaccggggaccgtaccggtacgttaactttacgttaccgacgtaccgtaacgtacggttacgacctacccgtaaccgtgtacgttcgggttcgggttccgttacgggacggtaggtacgttacgtcggacccgttactacgccgaccgtaccgacgtccgtcccgtacccgtcggtaccttaccgtcccttacccgtcccctcccctctacccacgtactacgtcgtacggtagaccgggtcgtcgggtacg

SEQ ID NO: 62794 - DNA, 911 bp, Homo sapiens
  misc_feature: GYAE6OF01BRTRE.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagttctttgtgacgcagcccgcctcagtgtctgccggccccaggacaggacgggtccaccgtcctcctgctcgtaggaacgccgcctaccaaactgtttcggacctaacgtaaatttacgtcgttaacttccgtacgggtaacccacggccctaacccgttccccgggaaccaccgaaccccctaaactccctactacttactaagtagtaagtacgtttaccgccgtaccgtacgacggtaccttccgtcgggtacctattccgtcgtcgtaccttaccgtaacgtcgtaacggtcctaccctccgtacgtacccgacccgtacgactaccgtccggacccggggtacccgtacccgggaaaccggggtacccggggaaccgggtacgggtacccgttaacttttaccgttaaccgtcggtacccggtaccgttaaccgggttacccggtaaacccttacccgtaaccgttacgggttaccggttttcgggggtttacccgggggttcccggtttaccggggggtaaccgggtaacggggttaacccgtttaaacggggtttccggtaaccccggttaaccgttaaccggttacccggtacccgggtaccccggtaacggttcccgtcccccgggtaccccccttccgggttaacccttacccggtttccccgttaccccgttacccccgtttccccccgtttaccctacccctttaacccgttacgttaccgtaccggtaccggtccgggaacgggtcccgggtacggtaccggg

SEQ ID NO: 62795 - DNA, 823 bp, Homo sapiens
  misc_feature: GYAE6OF01DG3I3.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacgagggtcctgggcccagttctttgttgacgcacgcccgcctcagtgtctgccggcccaggacaggaggtccaccgttctcctgctcgtaggaacgccgtaccctaccaaactagttcggaccaacgtaattagtgttaacttccgtaggtaaccagccctaccgttaccccgggaacaaccgaacccccaaactccctactaacttctaagtaacgtaagtacttttacccggaccgtaaccctacggtacgggttaccttccgtcggtacccgttactttccgtcgtacggtccctaccgtaacggtccgacgtcctaccgttcgacccgtacccgtaacccgtacggaactaccgtacccggaccggggtaccctacccgggaacggggtaacccgggggaacgtaccgggtaccgttattaacgttaccgtcggtaccgtaaccgtaacggttaccgggtacctacccgtaaaccgtcggtacgttcgggttacgggtccgttacgggacgggtacggtaacgttacggtaccgtacccgttaccgtaccggtacgtacgtaccgtacggccgtcccggtaccccgtacggtacctacccgttaccgttccccgttaacccccgtaccccgttccctacccgttaaccttacgttaacgttaccggtacggtacggtaccgggtccggtccggtaaccgg

SEQ ID NO: 62796 - DNA, 961 bp, Homo sapiens
  misc_feature: GYAE6OF01BD8W9.10.86.H09.1.454.CMB.1.raw
  modified_base (168)..(168): a, c, t, g, unknown or other
  misc_feature (168)..(168): n is a, c, g, or t
  modified_base (228)..(228): a, c, t, g, unknown or other
  misc_feature (228)..(228): n is a, c, g, or t
tcagcatagtagtgcacgaccggtgctcgatttagtgctatagacgttgggtttggggactcgggacaatcttcatcatgaccctgctcccctctcctcctctacccttctcattcactgacacaggtcctgggcccagttctttgtcgacgcgacgcccgtaccctnagtgtctcgccggcccaggaccaggacgggtcctaccgttctccgtgccttacgtggacnccgtaccactaaactgttcggactaacgtattactcgtactccgtaggtaccagacctaccggttccccggacacccggtaacccctaaactccctacacgttccttaagtagtaacgttacttttaccgaccgtaccccgtagaacgggttcttccggtacggtactactttccgtcgtacggaccttaccgaacggtcacggcctaccgttcgccgtacccgtaccctaggtaactacccggttaccgaccccggtacctacccgggaaccgggggtacccgggtaacggtacccggtaccgtttaacgtttaacgttacccgttaccggacccggttaccgttaaacggggtttacccgtaaacccgttaacccgtaaacccggtttgggttaacccggttttcggggtttaaaccggggtttcccgttttaacgggggaccgggtttaaaacgggttaaccgtttaccgggtttaacccggtacccccggttttaaccggtaacccggtcccggtaaacccggtacccccgggtaaacggtttcccccggtacccccggttccccggttaacgggttcccccttacccggttttaacccccggtttccccggttaccccccggttaccccttacccccggttaaccttaaacccccgtttaccgtaaaccgggtttccctacgggtttacccgggaacccggggttacccgggtccggtaaaccccggg

SEQ ID NO: 62797 - DNA, 772 bp, Homo sapiens
  misc_feature: GYAE6OF01BICWP.10.86.H09.1.454.CMB.1.raw
  modified_base (729)..(729): a, c, t, g, unknown or other
  misc_feature (729)..(729): n is a, c, g, or t
  modified_base (736)..(736): a, c, t, g, unknown or other
  misc_feature (736)..(736): n is a, c, g, or t
tcagcatagtagtgcacgaccggtgctcgatttagtgctatagacttggggtttggggactcgggacaatcttcatcatgacctgcctccctctcctcctctcccttctcattcactgcacgagggtcctgggccagttctttgtgacgcacgccgccctcgagtcgtctcggcccggacccaagggaccaggtacgggtccacccggttctcctcgtccttcggacgggaacgcccgtaccctaccgaaatacggttcggacctaaacgttaatttcgttacggttaacctccggttacgggtaccaaggtccgtaacccgttccccgggaaacaacccgaccccaaacgtcctctaacttctaagtacgtaacgttacgtttaccggaccgtaaccctggtaacgggtacctttccggtacggccttacgtttccgtcgtccgtacctaccggtaaacgtcggaacgcctaccgtcgtccgtacccgaccgtaggaccctacgtaccgccggtaccgtaccggaacgggggtaccggggaaccgtacgggtcctaagtttaccgttaacgtcggtaccgacgttacggtacggtacctaaccgtaaccgtggtaccggttcgggttaccgggtcgttacgggcgggtaacggtacgttacggtcgtacccgtacgtacgtccgacgtaccgacgtccgaccgtcccgtacgctccgtctcccgtccnccttccncctacgtcttacgtcgtcgtaggcgtcgtcgtacgg

SEQ ID NO: 62798 - DNA, 426 bp, Homo sapiens
  misc_feature: GYAE6OF01E3GFF.10.86.H09.1.454.CMB.1.raw
  modified_base (364)..(364): a, c, t, g, unknown or other
  misc_feature (364)..(364): n is a, c, g, or t
  modified_base (375)..(375): a, c, t, g, unknown or other
  misc_feature (375)..(375): n is a, c, g, or t
  modified_base (400)..(402): a, c, t, g, unknown or other
  misc_feature (400)..(402): n is a, c, g, or t
  modified_base (404)..(405): a, c, t, g, unknown or other
  misc_feature (404)..(405): n is a, c, g, or t
  modified_base (407)..(426): a, c, t, g, unknown or other
  misc_feature (407)..(426): n is a, c, g, or t
tcagcatagtagtgcacgaccggtgctcgatttagtgctatagacttgggtttggaagcgcctccaacattggcacgaattatgtatcctggtaccagcacttccccgggacagcccccaaactcctcatctatgaagattttacgcgaccctcagggattcctggccgattctctggctccaagtcaggcacctctgccaccctggacatcgaccgggctccagaccggggacgaggccgattattactgcgacaacgttcggggactccaacctgactgttggggctttcggcggaggactaagttgaccgtcctacgtcagcccaaggctgccccctggtcactctcgttcccgccctccnccactactatnctgagcgggctggcaggcgcatagnnngnnannnnnnnnnnnnnnnnnnnn

SEQ ID NO: 62799 - DNA, 777 bp, Homo sapiens
  misc_feature: GYAE6OF01AHAS5.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctggcccagtctttgttgacgcagccgccctcagtgtctgcggccccaggacagagggtcaccgtctcctgctctggaagcgcctccaacattggcacgtaattatgtatcctggtaccagctaccgttccccgggacacgacccccaaactcctacactctatagaagtacttttaccgaccgtacccctcgacgggtacttccgtcggccgtactttccgtcgtcggtacctaccgtaaagtccgaacggtcctacccttcgtccgtacccctaccccgttacggacctacgtaccgacccgggtacctacccgaacgggaccccgggggacgacgggtaccgtaacgtttacgttaccgtcggtaccggtaccgtaaccggtttcggggtaaaccctacccgtaaacccgttacggtaccgttggggtttcggggtaccgttttaccggggacgggtaacggggtaaccgtttaacggttccggtaacccggttacccgtacggtaccgaccggtacccggtaacggtcccgttcccgtccccccgttcggtacctacccgtttcccgttacccggttcccccgccccttccctaccccgtaccgttaaccttacgtccgacgttaggaccggtcgggtccgtacggg

SEQ ID NO: 62800 - DNA, 999 bp, Homo sapiens
  misc_feature: GYAE6OF01A8NTI.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagttctttgttgacgcacgcccgccctcagtcgtctcggccggaccccagggaccagggacgggtcctaccggttcctcccgtgtccgtcgtcgggaaccgccgtcccttaacccgaaacgtacggtttcggggaacctaaacgggttaaacttttaacgtcggttaaccgttcccgttacggggttaaccctacggtacccgttaaccccggtttaccccccggggaaccgtaacccggaaccccccctaaaaaccgttccccgtaacctaacttacctttaacgtaaggttaaaaccggtttaacgttttttaaaccccggacccgttaccccgttacggtacggggttaacctttacccggtaccgggtacccgtttaacgttttccgttaccggtacggtacccgttaccggtaaacgtaccggtaaccggtcccctaaccgttaccgtccgggtaccccctaacccgggtccgtaaaccgtaccgttacccgggtaacccgggtcccgttaaacccgggaaccggggtaaaccccgggggaccgggtaaccgggtaccgtaaacgttttaccgtaccgtacggtaccgtaacccggttacgggttacccgtaacccgttacccgtaacctcgggttaccgttgggtttaccggggttcgtttaccgggacggggttaggtaaccttaacgggttccgtacccggttaccgtaaccggtcaaccgggtacccgtaacggccgttaccccggcccgttacccgggtcctacccgttacccgtccccgttccccgtcccgttacccgtaccttaccgttacttaccggtcggtacggacggtccgggccgttacggtaccggg

SEQ ID NO: 62801 - DNA, 793 bp, Homo sapiens
  misc_feature: GYAE6OF01B88AS.10.86.H09.1.454.CMB.1.raw
  modified_base (162)..(162): a, c, t, g, unknown or other
  misc_feature (162)..(162): n is a, c, g, or t
  modified_base (173)..(173): a, c, t, g, unknown or other
  misc_feature (173)..(173): n is a, c, g, or t
  modified_base (302)..(302): a, c, t, g, unknown or other
  misc_feature (302)..(302): n is a, c, g, or t
tcagcatagtagtgcacgaccggtgctcgatttagtgctatagacgttgggtttggggactcgggacaatcttcatcatgacctgcctcccctctccctcctctcccttctcattcactgcgacgacgggtccgcgggccctagttcgtttgtcggaccgcncgcccgccctngtcgtcgtcggcccgacccgaggacgaggtaccgggtcctaccgttcctccgtcgtcgtcggtacggaccgtccaccctaacgaactggtacgaacctaagttaattgtcgtaaccgtcgtacggaccncgtacccgtaacccggtcccggaaccaaccccgtaccctaaactccgacttactacgtaagtaacggttaacttaacccgttacggaccccgtaccgttacgggaacgttccttaccgtccggtaccttaacgtttcccgtacgtccgaccgttaaccgtagaaccgtacccggaccctaccgtcggtaccccgaccgtacccggtaacgaacccgtcccggtaaccggacccggtccgaacccgggaaccggggtacccggacgaacccggtattacttacgtacgtacggacgtaccgtacggtacgaccgtaccgtacgtgtcggtcggtcggtaccgggttcggacggtacgtacggttaccgtacggtccgtaccgtaccgccgaccgaccgtcggtaccgccgtcccgtcgtccctacctcccgtcccgtacccgtacctcccgtacctaccgtactcgacgtcggaccgcggcggtcgtaccgg

SEQ ID NO: 62802 - DNA, 666 bp, Homo sapiens
  misc_feature: GYAE6OF01EDOFO.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctcaacattggcacgaattatgtactctggtaccagcaccgttcccggacacgcccccaaaactccctacactctaactgtaagtacttttacgccgaccctcgacgggtacttccgtggaccgtatttcctcttcggcctaccgaaagtccaaggcctacctctcgacccacccgttaggaacctacttccacccggggtacctacccgaacgggacccgggggaacgacgggccgtaatttacttacgtacgcgctaacgttcgggacctacctaacctggaccgtggttcgggtaccgtttcgggcgggtaaggtaacttacggttacgaccgttcctacggtaccacggcccgaacggcctccggccccctcgggtacctaccgttcgttccgttcccccgaccccttcctacccgaccttactacgtacgcttaggcggaccggcgtacgg

SEQ ID NO: 62803 - DNA, 961 bp, Homo sapiens
  misc_feature: GYAE6OF01BSIIB.10.86.H09.1.454.CMB.1.raw
  modified_base (93)..(93): a, c, t, g, unknown or other
  misc_feature (93)..(93): n is a, c, g, or t
tcagcatagtagtgcacgaccggtgctcgatttagtgctatagacttggggtttggggactcgggacaatcttcatcatgacctgctcccctntcctcctctcccttctcattcactgcacagggtcctgggcccagttctttgtgacgcagcccgccctcagtcgtctcggccggcccaggacaggacgggtcacccggttctccgtgcctcgtaggaacgcccgtacctaccaaacgtaggttcggaaccaacggttaaatttacgtacgtttaaccgttccgttaacgggtaacccacggacccgttaaccccggtttacccccgggaaccgtaacccccgtaacccccctaaaaaccctttccccgtactaaccgttaccgttagttaacggtaaacgtttaacgtttttacccggacccgttaaccccgtacgggtaacgggttaaccttttcccggtacggacccgttaacgtttcctacggtccggtacctaacccgtaacgtaccgtacgggccctaccttccgtaccgtaaccctacccgtacggaactaccgtaccggtaacccggccttaccgggaaccgggacccggggtaacgaccgggtaccgtttaacttaccgttaccgtacgaccgtaacccgttaacggttacccgggtaacccttaacccgtaaaccggttacggttaccggttttacggggtttccggggttacccggtttaccggggaaccggggtaaccgggttaaccgttaacgggtttacccggaaccggtttacccgtaacgggtacccaaccgggtaccggtaaccgttcccggtacccggtccccgttccgggttacctacccgttccggtttaccccggtccccgttaccccttccccgtaaccgttactaaacccggttgttaccgtacggtaccggtaccgggaccgggtccgtaaccggg

SEQ ID NO: 62804 - DNA, 953 bp, Homo sapiens
  misc_feature: GYAE6OF01B1W4N.10.86.H09.1.454.CMB.1.raw
  modified_base (229)..(229): a, c, t, g, unknown or other
  misc_feature (229)..(229): n is a, c, g, or t
tcagcatagtagtgcacgaccggtgctcgatttagtgctatagacttgggtttggggactcgggacaatcttcatcatgacctgctcccctctcctcctctcccttctcattcactgcacagggtcctggcccagttctttgttgacgcagcccgccctcagtgtctgccggccccaggacagacgggtcaccgtctcctgctcgtaggaacgccgacctacccaaacngtttcggacctaacgtaaatttactcggttaacttcccggtaggtaacccagtcccgtaaccccgtttacccccgggggaaccaccccggtaacccccccctaaaaaccttccccttacctaacgttacctttaagttaacgggtaaaacgttaaccttttttaacccgggaccccgtaacccccgttacggtaacgggttacctttccccggttccgggtacccgtacttttccgtaccgttcgggtacccttaccgtaacgtccgacggccctaacccgtccgtaccgaccccgtaaccccgttcggaacctacctaccgggaccccgggtaccctacccggaacggggaccccgggggaaccgaacccggggtccgttaattttacgttaccgtacgaccggaccgttaacggttaccggtaacccgttaaccctaaccgttacggtacggtttcggggttccggggttaccggttttaccggggaacgggtaacgggttaacggttaaccgggttccggttaaccccggttaccgttaccggtaccgaaccggtacccgtaacgggtcccgttcccgtccccccggtaccggttccctacccgtttcccgttaccccgttaccccccgttacccccttaccccccgttacccttaaccgtttaaccccgttccgttaccggtaccgttacggggaccgggtccgggtccgggtaacgggg

SEQ ID NO: 62805 - DNA, 789 bp, Homo sapiens
  misc_feature: GYAE6OF01ANROL.10.86.H09.1.454.CMB.1.raw
tcagcatagtagtgcacgaccggtgctcgatttagtgctatagacttgggtttggggactcgggacaatcttcatcatgacctgcctcccctctcctcctctcccttctcattcactgcacgagggtcctgggcccagttctttgttgacgcagcccgccctcagtgtctgccggcccaggacaggacggtcaccgtctcctgctcgtaggacgccgccctaccaaactagttcggcaacgtaatttatgttactccgtcggtaccagcctaacccgttccccgggaacaccgacccccaaactcctacacttactagtagtaaacgttacgttttaccggacccgtaccctcggtaagggtaccttccggtcggtaccgtatttccgtcgtaccggtcctacccgtaaggttccgacggtaccctacccgttcgtacccgaccccgtaacccgtacggacctacgtccgaaccggtccgggacccgtacccggacgggaacccggggtaggaccggtaccgttaactttaacgttacgtcgtaccgtaccgttaaacgttcgggtacctaaccgtaaccgtacgtcggttacggttcggggtcgtttccggggacgggtacgggtacttacgggtccgtacccgttccgtaacgtcccaccggtacccgaacggtcccgttacccgtccccgttcggttaccctaccgttccccgttcccgttacccccctacccttcccccgtaccctaccgttctccgggtcagggtacccgggcggtccggtcgg

SEQ ID NO: 62806 - DNA, 755 bp, Homo sapiens
  misc_feature: GYAE6OF01BXRG4.10.86.H09.1.454.CMB.1.raw
  modified_base (162)..(162): a, c, t, g, unknown or other
  misc_feature (162)..(162): n is a, c, g, or t
  modified_base (209)..(209): a, c, t, g, unknown or other
  misc_feature (209)..(209): n is a, c, g, or t
tcagcatagtagtgcacgaccggtgctcgatttagtgctatagacttggggtttggggactcgggacaatcttcatcatgacctgctcccctctcctcctctcccttctcattcactgcacagggtcctgggccctagtctttgttgacgcagcccgccctnagtgtctgccgccccaggacaggaggtcaccgtctctgctctggacnccgcctacgaactgttggactacgaattatgtactccgtaggaccagcctaccgttcccggaacaccgaccccaaacgtccactactacctatagacgttactttaccgcccgtacctacgacggtacttccgtacggtcctattcgtacgtcgcctaccgaagtccacggacctacctcgtccgacccgtaccgtacggacacgtcccgacccggtcgtaccggaccggacccggggtaacgccggtaccggttaatttacgttacgtcgggaccgtacctaaccgggttacggaccttaacccgaacgttccggtacggttacgggttcgggttcccgtttacggggacgggtacggttaaccgttacggttacgacccggtttaccgtaccggacggtacccgtaaccggtccggtacccggttccccgaccccggttccgtaaacccgttccggttaaccccgtttcccgtacccccttaccccgtacctacccccgtaactacgttaccgtggcctacgggaccggtcgggcgtaacgggg

SEQ ID NO: 62807 - DNA, 785 bp, Homo sapiens
  misc_feature: GYAE6OF01CMU96.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagttctttgtgacgcagccgcctcagtgtctgccggcccaggacagagggtccaccgtctccgtgctcgtaggaacgccgcctaccgaaactagttcggacaacggtaatttagtacgttaacgttcccgtaggtaaccagccctaaccgtttccccgggaacaaccgtaacccccctaaaactccctaccaacttacgtaataacggtaaaacgtttactttaacccggaccgtaaccccgtaggaacgggttacctttccggacggtacccgtacttttccgacttcggaccttaaccgaagttccgaacgctacccgttcgcgacccctacgtggactacgtacccggaccggactacccgggaacggggaacccggggtacacggtaccgttaattacgttacgcggtaccgtactaacggtacggtaacctaccgtaacgttgtacggttggttccggggtcgttacgggacgggtaacggtaacgttaacgttccgtaaccgtacgtaccgtacgtaccgaccgacgtacccgtccgtaccccgtcgtctaacccgttccgttacccgttaccccaccccgttaccctaaccgtaaccgttacgttacgtacggtacgtaccgggaaccggtccgggcgtacggg

SEQ ID NO: 62808 - DNA, 1009 bp, Homo sapiens
  misc_feature: GYAE6OF01AH5X8.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagtctttggtgacgcagccgcctcagtgtctgccggccccaggacaggacgggtcaccgtctcctgctcgtaggaacgccgtccctaccaaactagttcgggaccaaccgtaatttagtggttaacctcccgtaggtaacccaggtcccaacccggtttacccccgggaacccacccggaaccccccctaaaaccttcccctactaacttaccgttaagtacggtaaaggtttaacgtttttaaccccggacccggtaaccccccgttacggaacgggttaccgtttaccccggttcggggtaccccgttaacgttttcccgttaccggttcccgggtcccgttaacccggtaaaacggttcccggtaacgggtacccctaacccctttcccgtccgacccccgttaaccccggaccggtaaccctaacgtaccccgggaacccggggtaccccttaacccgggaaacccggggtaaccccggggggaaccggtaaccgggggtaccccgttaaacgttttaccgttacccggtacgggaccggtaacccgttaaccggggtttacccgggaaaccctttacccggaaacccgtttcgggttaacccggttcgggggtttaccggggttacccgggtttaccggggacggggttaacgggtaaccgtttaacgggtttccgggtaaccccggttccgttaacggtacccgtaccggaacccggtaacggtcccgtacccggtccccgttacgggttaccctacccgttcccgttaccccggttccccaacccccgtttaccctaccccgttaaccgtacccgttacggtacccgtaccggttaccgggtacggggtcccgggtcggtaaccgggg

SEQ ID NO: 62809 - DNA, 701 bp, Homo sapiens
  misc_feature: GYAE6OF01BY28S.10.86.H09.1.454.CMB.1.raw
  modified_base (210)..(210): a, c, t, g, unknown or other
  misc_feature (210)..(210): n is a, c, g, or t
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtccaccgtctcctgctcgtggaacnccgccctaccaactagttcggacaacgtaattatcgtactccgtggtaccagcctaccgttcccggacaccgaccccaactcctcatctagtagaacgttactttaccgccgtacctgacggtacttccgtcggccgtatttccgtcgtcggtcctaccgtaacggtccacggtcctacctcgtaccgacccctacccgtggaacctacgtcccggacccggtcctacccggaacgggacccggggtacgaacggtaccgtaactttacgtaccgtcggacgtacgtaacgttcggacctaccgtaaccgtgtacgttggttcgggtaccgtttcgggacgggtacggtaacttacggttcgacccgttactacgaccgtacgaccgtacggtacccgtcccgtccccgtcgtcctccgttaccgttcccgttcccctacccttccctcctaccgttaacacgtcgacgtccggacggtccggtccgtcgg

SEQ ID NO: 62810 - DNA, 970 bp, Homo sapiens
  misc_feature: GYAE6OF01B1W15.10.86.H09.1.454.CMB.1.raw
tcagcatagtagtgcacgaccggtgctcgatttagtgctatagacgttgggtttggggactcgggacaatcttcatcatgacctgctcccctctcctcctctcccttctcattcactgcacagggtcctgggcccagttctttgttgacgcagcccgccctcagtgtctgccgcccaggacaggacgggtcaccgtctcctgctcgtaggaacgccgcctaccaaactagttcgggacctaacggtaaatttacgtcggttaacttcccgtagggttaaccccaggtaccccttaacccggtttaccccccgggggaaccaacccggtacccccccctaaaaaccttccctaccctaacttacctaacgttacggtaaaacggttaaccttttttaacccggcccgtaacccccgttccggtaaggggttacctttcccggtcggggtacccgtaacgttttccgtacgttacgggtacccttacccgtaaacggttccgaacgggtaccctaacccgttccgttaccggacccctaaccccggttacggaacctaccgttacccggaaccccgggtaccgttaccccggaaaccgggaccccgggggtaaccggaccgggtacccgtaacgttttaacgttacccggtacggaccgtaccgttaaaccggttcgggtaaacccttacccgtaaaccgttacgtaccggttccgggtttacggggtcccgttttacggggacggggtaacgggtaacgttaaccgggtttccggtaaccccgtttaccgtaccggtaccgacccggtacccggtaaacgggtcccgtaccccggtccccccggttaccgggttacctacccggtttcccgttccccggttccccccgttacccccgttaccccttcccgtaacccgttaaccgttccggttacggtcccgtacgggacgggtccgggtcggtaaccgggg

SEQ ID NO: 62811 - DNA, 897 bp, Homo sapiens
  misc_feature: GYAE6OF01DMXKN.10.86.H09.1.454.CMB.1.raw
  modified_base (184)..(184): a, c, t, g, unknown or other
  misc_feature (184)..(184): n is a, c, g, or t
  modified_base (212)..(212): a, c, t, g, unknown or other
  misc_feature (212)..(212): n is a, c, g, or t
  modified_base (233)..(233): a, c, t, g, unknown or other
  misc_feature (233)..(233): n is a, c, g, or t
  modified_base (265)..(265): a, c, t, g, unknown or other
  misc_feature (265)..(265): n is a, c, g, or t
  modified_base (282)..(283): a, c, t, g, unknown or other
  misc_feature (282)..(283): n is a, c, g, or t
  modified_base (300)..(300): a, c, t, g, unknown or other
  misc_feature (300)..(300): n is a, c, g, or t
tcagcatagtagtgcacgaccggtgctcgatttagtgctatagacttgggttggggactcgggacaatcttcatcatgacctgctccctctcctcctctcccttctctattcactgacacgacgggtcctcgggccctaggttcctttagtacgaccgcgacgcccgtccctacagttcgtccncggcccgacccgagacgaggcggtaccnccgtctccgtgctcgaggacnccgacctaccgaatgttaggactaagtagttntacgtatccgtgaaccnnccgtaccggtcccgacncccgaacctaccgtcacgacctagtacgtagtaacgtttacgtttaccgaccgtaccgtagggtacggtacctttaccggacggttaccgtaaccttccgttacgtaccgtacccgttaacccggtaacgtaccgggaccctaacccgtccgttacccggtaccgtaaccccgtaccgttaaccggaactaccccggtcccgggtaacccggtaccgacccgggggaaacccggaaccccggggggtaaagtacccggttaaacccggttttacttaaccgggttaccgtaacggtccccgttaaaccggttaccgggttaaccccgggttacccttaaacccgggtaccgtttaacgggttaacccgggttccgggttttacgggttacccgggttacgggtaaccggggtaacgggtttaaccgggttaaccggtttaccggaaccccggttaaccctaccggttaccgaaccggtaccccgtcggtaaccccgttccccgtacccggtccgttaccgacccgttcgtacccccgtaaccctccccgtacctaccgaccgttacaccgtcgtacgacggtccgtggccggtacgg

SEQ ID NO: 62812 - DNA, 736 bp, Homo sapiens
  misc_feature: GYAE6OF01BFIU3.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtccaccgtctcctgctcgtggaagccgccctaccaaacattcggcaacgtaattatgtactccgtggtaacccagccaccgttccccgggacaccgacccccaaactcctcatctatagaacgtacttttaccgccgacccctcgagggtaccttccgtcggccgtattcctcgtcggcctaccgtaagtccaggccctacctccgtccgacccacccgtggacacgtccgacccgggcctaccggacggaccggggacgacggtccgtattactacgtcgccgacgtaaccggttcggacctaccctaaccgtcgtacgttcgggttcgggtccgtttcgggacgggtaacgggtacttaacgggttcggtaacccgttacccgttaccggtaccgaaccggtacccgtaacgggtccgtaccccggtcccccgttccggtacccttaccgttcccggttcccggtttcccccgtcccccttccccgttacccctaccttaaccgttacgttcggtaccgttacgggccgggtccgggtccggtaccggg

SEQ ID NO: 62813 - DNA, 883 bp, Homo sapiens
  misc_feature: GYAE6OF01ECISY.10.86.H09.1.454.CMB.1.raw
  modified_base (215)..(215): a, c, t, g, unknown or other
  misc_feature (215)..(215): n is a, c, g, or t
tcagcatagtagtgcacgaccggtgctcgatttagtgctatagacttgggtttggggactcgggacaatcttcatcatgacctgctcccctctcctcctctcccttctcattcactgcacagggtcctgggcccagttctttgttgacgcacgccgccctcagtgtctgccggcccaggacaggagggtccaccgtctccgtgctcgtaggaacnccgcctaccgaaactgtttacgggactaacggtaaatttacgttaggtacctcccgttacgggttaacccacggaccctaaccccggtttcccccgggaaccaacccggaaccccccctaaaaccttcccttaccgtacttacctaagttaacgtaaacgttaacgtttttacccgacccggtaaccccttaccggaaggggttacctttacccggtcgggtaacccgttaacttttcccgtccggttacggtcccgttaaccgtaacggtaccgtaccggtaccctaacccgttccgtacggtccccgtaacccggtacggacctacgttaacccggacccggggtacctacccggaaccggggaacccggggaacgtaccgggtaccgttaacgtttacttaaccggtcggaccgtaacgttaaccgttacgggtaacctaaccgtaacgtcgtacgtttcggggttcgggtacccgtttcgggaccgggtacggtaaccgtttaacggtacgacccgtttccctacggtacgtaccggacccgtaacggtcccgtccgttaccccgtggtaccctacccggttcctaccccggttcccccaccccgtttaccctcccgtaacttccgttacgtccgtcggtacggacggtcgggtccgtaacggg

SEQ ID NO: 62814 - DNA, 970 bp, Homo sapiens
  misc_feature: GYAE6OF01E5DU6.10.86.H09.1.454.CMB.1.raw
tcagcatagtagtgcacgaccggtgctcgatttagtgctatagacgttggggtttggggactcgggacaatcttcatcatgacctgcctcccctctcctcctctcccttctcattcactgcacgagggtcctgggccctagttctttgtgacgcacgcccgccctgagtgtctcggccggccccaggacaggacgggtccaccgttctccgtgacctcgtaggaacgcccgtcctacaaacgtgttcggactaacgttaattacgtcggttaaccttccgtaacgggtaacccacggtcctaacccggttaccccggggaacaaccccggaccccctaaacgtccctactactactaagtcgtaaacgtttacgtttaccgaccgtacctacggaacggttaccttccgtacggtacccgttatttcccgtcggttacggtaccctaaccggtaagtccgtaacggtcccaccgtttaccgacccgtccccgtttacccggtacggtacctaacgggtccgtaaccggggttccgggggttacccccgtccggggttaacggaggttaaccgggttacggacccgtttccgtaagggtttaactttttaccgggttaacggtttcgggtaacggttaaggtaccggttagggtacggggtaaccttacgggaaacccgttcggttaacccggttggttaaccggtttacttaccggttttacgggtcccggtttaacccgggttaaccggggttaacccgggtaacgggttaaccccggttaaccgggtttaccccgttaaccccggtttaccgtaccgggtaaccccgaacccccggtaaaaccccggtaccccggtaaacccccttaccccggtacgttacccggttacccgttaccccgtttccccggtttacccccggttaccccccttacccccgttaccgtaccccttaaacggtttaacccgg

SEQ ID NO: 62815 - DNA, 873 bp, Homo sapiens
  misc_feature: GYAE6OF01E05DA.10.86.H09.1.454.CMB.1.raw
  modified_base (108)..(108): a, c, t, g, unknown or other
  misc_feature (108)..(108): n is a, c, g, or t
tcagcatagtagtgcacgaccggtgctcgatttagtgctatagacttggggtttggggactcgggacaatcttcatcatgacctgctcccctctcctcctctcccttntcattcactgcacgacgggtcctgggcccagttctttggttgacgcacgccgtccctcgagtgtctcggccggacccaggacaggtacggtacctaccgtctctgctcgtaggacgccaccctacaactgttcggacctaacgtaacgtttagtacggttactcccgttaaggaaccgtacgtacccgtacccggttaccccgggaacctaacccgaaccccctaaaacctccctactaacttctaacgttaagtaacgttaaccgtttaccgtacccggtaacccgtacggtaaccggttacgttccgtcggtacccgttattcctacgtcgtacctacctaagcgaccggtcctaccgtctaccgtaccccgaccgtacggactacggtcccgaacggtccgtacgggaaccgggtaacggggacgtacggtaccgtagtttacgtacgtacgtaccggaacgttaacgggttacccgtaacctaacccggtaaccttacgggttaacgggttcggggtttaccggggttacggtttacccgggggtaacgggtaaccggggtttaaaccgttacggtttacccggtaacgttacccggttacggtcccgaaccggtacccggtaacgtccccggttacccgtacccggtccggttaaccttacccgttccgttccccggttacccgtacccccttccttaacccgtaccgtaaccttaccggtacgtccggtaacgggtaccggccgggtaccgggtaacgg

SEQ ID NO: 62816 - DNA, 638 bp, Homo sapiens
  misc_feature: GYAE6OF01BJNEQ.10.86.H09.1.454.CMB.1.raw
  modified_base (99)..(99): a, c, t, g, unknown or other
  misc_feature (99)..(99): n is a, c, g, or t
  modified_base (586)..(586): a, c, t, g, unknown or other
  misc_feature (586)..(586): n is a, c, g, or t
  modified_base (590)..(590): a, c, t, g, unknown or other
  misc_feature (590)..(590): n is a, c, g, or t
  modified_base (594)..(595): a, c, t, g, unknown or other
  misc_feature (594)..(595): n is a, c, g, or t
  modified_base (604)..(638): a, c, t, g, unknown or other
  misc_feature (604)..(638): n is a, c, g, or t
tcagcatagtagtgcacgaccggtgctcgatttagtgctatagacttgggtttggaagcgcctccaacattggcacgaattatgtatcctggtaccacncacttccccgggacagccccccaaactccctcatcctatgaagtatttttaccgcggaccccttcgagggtactttcccgtgggcccgtatttccgtcttcgggaccttacccaaggttccaagggccacccttctcgcccaaccccgtggaaccactccgaccgggtcctccggaaggacccgggggacgtacggacccgtaagtttacttacgtcggtacgcctaaaacgtttcggggaacccttaccccgaaaaccgttcgtaaccgttgggttttaccggggggtccgttttccgggggaccggggtaaacggggtacctttaacggttccggttaccccgttacccttacggtacaccggacccctaaggcctcccgacccccgtggtccacctttccgttccgtttccccccgaccccttcccctaccgacccttacgtacttggcctagggcggtccggacgtcggacgaaggtccgaanagtngacnnctggacagnnnnnnnnnnnnnnnnnnnnnnnnnnnnnnnnnnn

SEQ ID NO: 62817 - DNA, 847 bp, Homo sapiens
  misc_feature: GYAE6OF01BDHMV.10.86.H09.1.454.CMB.1.raw
tcagcatagtagtgcacgaccggtgctcgatttagtgctatagacttgggtttggggactcgggacaatcttcatcatgacctgctccctctctcctctcccttctcattcactgcacgaggtcctggcccagtctttgtgacgcacgccgcctacagtgtcgtgccggaccccaggacaggacgggtaccaccgtctccgtgcctcgtaggaacgccgtaccctacgaaactgttcgggactaacgtaaactttatcggttaactaccgttacggtaaccagtccgttaacccgttaccccgggacaccggtaccccaaactcctactacttactaagttacggtaaacggttacttttaccggacccaaccccgttacggtaacgggtacctttacccggtacggtaccgttacttccgttaccgttcggaccttaccgtaaggtaccacggcctaaccggtctaccggccctacgtacggtacactccggtaaccggctaccggaagggaacccggggacggtacggaccgttaacgttacgttaccgtacgtacgtaaccgttaacggtacgggtaaccctacccgtaaacgttcggtaacgtttcgggtttaccgggtcggtttaccgggtacgggtaacgggtttaacctaacgggttaaccggtcccggttaacccggttacggtaccgtaaccggaacccggtaacggtccgtacccggtaccccggtccgttaccgtcccgtacccggttacccggttcccctacccgttacccgtccctaaaaccgttcctacgttccttacccggagggttaaccggtccgggacgtaaaccgggg

SEQ ID NO: 62818 - DNA, 769 bp, Homo sapiens
  misc_feature: GYAE6OF01AJ6HE.10.86.H09.1.454.CMB.1.raw
  modified_base (109)..(109): a, c, t, g, unknown or other
  misc_feature (109)..(109): n is a, c, g, or t
  modified_base (160)..(160): a, c, t, g, unknown or other
  misc_feature (160)..(160): n is a, c, g, or t
  modified_base (682)..(682): a, c, t, g, unknown or other
  misc_feature (682)..(682): n is a, c, g, or t
tcagcatagtagtgcacgaccggtgctcgatttagtgctatagacttgggtttggggactcgggacaatcttcatcatgacctgcctcccctctcctcctctcccttcncattcactgcacgagggtcctggcccagttctttgtgacgcagcccgcctnagtgtctgccggcccaggacaggcggtccaccgtctcctgtctcgtaggacgccgcctaccaacgtagttcggacctaagttaaattcgtacgttaacctcccgtacgggtaaccacggtacccgtacccgttaccccgggaaccaccccgtaccccctaactcccctagtactccgttaataacgttaaacgtttccgacccgtcccaggtacggaccttccgcgtctattccgtctcggacctacgacgtcgaccgtcctaccctcggtccaccccgtacggtacgtaccgcgtccccggaccggtccgtaccgggaccggggaaccggggtaccgcggtaccttaacgtttaccgtcgtacgccgttaccgtaccggtaccgtaccctacccgtaacgtcggttacggttcgggtcgggttcgttaccgggacggttacggtacgttacggtacccgtaccgttccgtaccgacgtaccgtacccgtacggtccctacccgtccccgtagtaccccgtnttccccgtcccgttccccgtcccttcccgtaaccttcggttacctaccgtggtaccggttacggcggaccgggtacgtcgggacccg

SEQ ID NO: 62819 - DNA, 148 bp, Homo sapiens
  misc_feature: GYAE6OF02HZ8W1.10.86.H09.1.454.CMB.1.raw
  modified_base (147)..(148): a, c, t, g, unknown or other
  misc_feature (147)..(148): n is a, c, g, or t
tcagcatagtagtgcacgaccggtgctcgatttagtgctatagacttgggtttgggaccgtcctacgtcagcccaaggctgcccctcggtcactctgttcccgccctcctccactattatgctgagcgggctggcaaggcgcatagnn

SEQ ID NO: 62820 - DNA, 149 bp, Homo sapiens; identical to SEQ ID NO: 62631
  misc_feature: GYAE6OF02H7IMF.10.86.H09.1.454.CMB.1.raw
  modified_base (149)..(149): a, c, t, g, unknown or other
  misc_feature (149)..(149): n is a, c, g, or t

SEQ ID NO: 62821 - DNA, 192 bp, Homo sapiens
  misc_feature: GYAE6OF02I781K.10.86.H09.1.454.CMB.1.raw
  modified_base (190)..(192): a, c, t, g, unknown or other
  misc_feature (190)..(192): n is a, c, g, or t
tcagcatagtagtgcacgaccggtgctcgatttagtgctatagacttgggtttgggactccaacctgactgttgggctttcggcggagggactaagttgaccgtcctacgtcagcccaaggctgcccctcggtcactctgttcccgccctcctccactactatgctgagcgggctggcaaggcgcatagnnn

SEQ ID NO: 62822 - DNA, 191 bp, Homo sapiens
  misc_feature: GYAE6OF02JBONZ.10.86.H09.1.454.CMB.1.raw
  modified_base (191)..(191): a, c, t, g, unknown or other
  misc_feature (191)..(191): n is a, c, g, or t
tcagcatagtagtgcacgaccggtgctcgatttagtgctatagacttgggtttgggactccaacctgactgttggggctttcggcggagggactaagttgaccgtcctacgtcagcccaaggctgcccctcggtcactctgttcccaccctcctccactactatgctgagcgggctggcaaggcgcatagn

SEQ ID NO: 62823 - DNA, 532 bp, Homo sapiens
  misc_feature: GYAE6OF02I99YN.10.86.H09.1.454.CMB.1.raw
  modified_base (399)..(399): a, c, t, g, unknown or other
  misc_feature (399)..(399): n is a, c, g, or t
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtaccagcacttccccgggacacgcccccaaactcctcatctatgaagattttacgcgaccctcagggattcctggccgattctctggctccaagtcaggcacctctcgccaccctgacatcaccgggctccagaccggggacgaggccgattattacngcgcaacttgggactccaactgactgttgggctttcggcggagggactaagttgaccgtcctacgtcagcccaagctcgcccctcgtcactctcgttcccacctcctccactactactcgctgacgcggctgg

SEQ ID NO: 62824 - DNA, 522 bp, Homo sapiens
  misc_feature: GYAE6OF02FUHYT.10.86.H09.1.454.CMB.1.raw
  modified_base (518)..(518): a, c, t, g, unknown or other
  misc_feature (518)..(518): n is a, c, g, or t
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtaccagcacttccccgggacagcccccaaactcctcatctatgaagattttacgcgaccctcagggattcctggccgattctctggctccaagtcaggcacctctgccaccctggacatcaccgggctccagaccggggacgaggccgattatactgcgcaacttgggactccaactgactgttgggctttcggcggaggactagttgaccgtctacgtcagcccaagctgcccctgtcactctgttcccgcctcctccactactatgctgagcggntcgg

SEQ ID NO: 62825 - DNA, 531 bp, Homo sapiens
  misc_feature: GYAE6OF02GX6C9.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtaccagcatttccccgggacagccccaaactcctcatctatgaagattttacgcgaccctcagggattcctggccgattctctggctccaagtcaggcacctctgccacctggacatcaccgggctccagaccggggacgagggccgattatactgcgcaacttgggactccaacctgactgttgggctttcggcggagggactaagttgaccgtcctacgtcagcccaaggctgcccctgtcactctcgttcccaccctcctccactactatcgctgacgcgggctcgg

SEQ ID NO: 62826 - DNA, 152 bp, Homo sapiens
  misc_feature: GYAE6OF02HFNX6.10.86.H09.1.454.CMB.1.raw
  modified_base (149)..(152): a, c, t, g, unknown or other
  misc_feature (149)..(152): n is a, c, g, or t
tcagcatagtagtgcacgaccggtgctcgatttagtgctatagacttgggtttggggaccgtcctacgtcagcccaaggctgccccctcggtcactctgttcccaccctcctccactactatgctgagcgggctggcaaggcgcatagnnnn

SEQ ID NO: 62827 - DNA, 403 bp, Homo sapiens
  misc_feature: GYAE6OF02HQSZK.10.86.H09.1.454.CMB.1.raw
  modified_base (396)..(403): a, c, t, g, unknown or other
  misc_feature (396)..(403): n is a, c, g, or t
tcagcatagtagtgcacgaccggtgctcgatttagtgctatagacttgggtttggaagcgcctccaacattggcacgaattatgtatcctggtaccagcacttccccgggacagcccccaaactcctcatctatgaagattttacgcgaccctcagggattcctggccgattctctggctccaagtcaggcacctctgccaccctggacatcaccgggctccagaccggggacgaggccgattattactgcgcaacttgggactccaacctgactgttggggctttcggcggagggactaagttgaccgtcctacgtcagcccaaggctgccccctggtcactctgttcccgccctcctccactactatgctgagcgggctggcaaggcgcatagnnnnnnnn

SEQ ID NO: 62828 - DNA, 548 bp, Homo sapiens
  misc_feature: GYAE6OF02HDZ79.10.86.H09.1.454.CMB.1.raw
  modified_base (276)..(276): a, c, t, g, unknown or other
  misc_feature (276)..(276): n is a, c, g, or t
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtaccagcacttccccgggacagcccccaaactccncatctatgaagattttacgcgaccctcagggattcctggccgattctctggctccaagtcaggcacctctgccacctggacactcaccgggctccagacccggggacgacggcccgattacttactgcgcaacgttgggactccaacctgactggttcgggctttcggcggagggactaagttgaccgtcctacgtcacgcccaaggctcgcccctcgtccactctcgttccccaccctcctccactactactcgcctggacgcggctcggg

SEQ ID NO: 62829 - DNA, 535 bp, Homo sapiens
  misc_feature: GYAE6OF02GW4DJ.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtaccagcacttccccgggacacgcccccaaactcctcatctatgaagattttacgcgaccctcagggattcctggccgattctctggctccaagtcaggcacctctgccacctggacatcaccgggctccagaccggggacgacggccgattacttactgcgcaacgttgggactccaacctgactgttgggctttcggcgaggctaagtgaccgtctacgtcagcccaagctcgcccctcggtcactcctcgttccccaccttcctccactactatcgctgacgcgggctcgg

SEQ ID NO: 62830 - DNA, 522 bp, Homo sapiens
  misc_feature: GYAE6OF02FUMYD.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacaggctcctgggcccagtctttgttgacgcagccgccctcagtgtctgcggccccaggacagagggtcaccgtctcctgctctggaagcgcctccaacattggcacgaattatgtatcctggtaccagcacttccccgggacagcccccaaatcctcatctatgaagattttacgcgaccctcagggattcctggccgattctctggctccaagtcaggcacctctgccacctggacatcaccgggctccagaccggggacaggccgattatactgcgcaacttgggactccaactgactgtgggctttcggcgagggactaagttgaccgtcctacgtcagcccaaggctgcccctggtcactctcgtcccgccctcctccactactactgctgagcggtcg

SEQ ID NO: 62831 - DNA, 530 bp, Homo sapiens
  misc_feature: GYAE6OF02HM0Z9.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtaccagcacttccccgggacagcccccaaactcctcatctatgaagattttacgcgaccctcagggattcctggccgattctctggctccaagtcaggcacctctcgccaccctggacatcgaccgggctccgaggaccggggacgaggccgattacttactgcgcaacgttggactcaacctgactgttgggcttcggcggaggactaagttcgaccgtctacgtcagccagctcgcccctgtcactctcgtcccaccctctccactactatcgctgacgcggctcgg

SEQ ID NO: 62832 - DNA, 407 bp, Homo sapiens
  misc_feature: GYAE6OF02HNGYA.10.86.H09.1.454.CMB.1.raw
  modified_base (400)..(407): a, c, t, g, unknown or other
  misc_feature (400)..(407): n is a, c, g, or t
tcagcatagtagtgcacgaccggtgctcgatttagtgctatagactttggggtttggaagcgcctccaacattggcacgaattatgtatcctggtaccagcacttccccgggacagcccccaaactcctcatctatgaagattttacgcgaccctcagggattcctggccgattctctggctccaagtcaggcacctctgccaccctggacatcaccgggctccagaccggggacgaggccgattattactgcgcaacttgggactccaacctgactgttggggcttttcggcggagggactaagttgaccgtcctacgtcagcccaaggctgccccctcggtcactctgttcccgccctcctccactactatgctgagcgggctggcaaggcgcatagnnnnnnnn

SEQ ID NO: 62833 - DNA, 734 bp, Homo sapiens
  misc_feature: GYAE6OF02HGALA.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtaccagcacttccccgggacagcccccaaactcctcatctatgaagtattttacgcgaccctcagggacttcctggccgattctctggctccaagtcatcgcacctctcgccaccctggacatccgaccgggctccgacggacccggggacgacgggcccgtaatttacgttacgtggccgactaaaccggtttcggggaacccttacccgaaacccgttgaaccgttgggtttcgggggtccgttttccggggaccggggtaacggggtaaccgttaaagggtttccggtaacccggttcccgttaaccgggttccgaaccgggtacccccgtaaagggtcccttacccgggtcccccccgttacgggttaccctaaccgtttcccgttcccgggtttaccccccggtccccctttaccccgttacccctaacccgtttaacccgttaacgttcccggtacccgttacgggtaccggtcccggggtacccgg

SEQ ID NO: 62834 - DNA, 540 bp, Homo sapiens
  misc_feature: GYAE6OF02H2GM4.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcgccccaggacagagggtcaccgtctcctgctctggaagcgcctccaacattggcacgaattatgtatcctggtaccagcacttccccgggacagcccccaaactcctcatctatgaagtattttacgcgacccctcaggggattcctggccgattctctggctccaagtcaggcactctgccaccctgacatcaccgggctccagaccggggacgaggccgattattactgcgcaactgggactccaacctgactgttcgggtctttcggcggaggacgtagttgccgtctacgtcacgcccaagcctgccccgtcgtcactcctcgttcccgccctcctcctacctactactcgcctgacggcggcgtcgg

SEQ ID NO: 62835 - DNA, 541 bp, Homo sapiens
  misc_feature: GYAE6OF02I81CH.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtaccagcacttccccgggacacgcccccaaactcctcatctatgaagtattttacgcgaccctcagggattcctggccgattctctggctccaagtcaggcacctctgccacctggacatcgaccgggctccaggacccggggacgacgggcccgatttacttactgccgcaacgttgggactccaacctgactggttgggctttcggcggaggactagttgaccgtctacgtcagcccaagctcgcccctgtcactctcgtcccacctcctccactactatcgctgacggcggtctcgg

SEQ ID NO: 62836 - DNA, 537 bp, Homo sapiens
  misc_feature: GYAE6OF02F9UE5.10.86.H09.1.454.CMB.1.raw
  modified_base (533)..(533): a, c, t, g, unknown or other
  misc_feature (533)..(533): n is a, c, g, or t
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtaccagcacttccccgggacacgcccccaaactcctcatctatgaagattttacgcgaccctcagggattcctggccgattctctggctccaagtcaggcacctctgccacctggacatcaccgggctccgagaccggggacgacggccgattacttactgcgcaacttgggactccaacctgactgttgggctttcggcggagggactaagttgaccgtcctacgtcagccaagctcgcccctcgtcactctcgttcccacctcctccacctactactcgctgacgcgggntcgg

SEQ ID NO: 62837 - DNA, 532 bp, Homo sapiens
  misc_feature: GYAE6OF02F5ZR2.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtaccagcacttccccgggacagccccaaactcctcatctatgaagattttacgcgaccctcagggattcctggccgattctctggctccaagtcaggcacctctgccacctggacatcaccgggctccagaccggggacgaggccgattattactgcgcaacttgggactccaactgactgttgggctttcggcggagggactaagttgaccgtcctacgtcagcccaaggctcgcccctcggtcactctcgttcccaccctcctccactactactcgctgagcggctcgg

SEQ ID NO: 62838 - DNA, 541 bp, Homo sapiens
  misc_feature: GYAE6OF02IRYQD.10.86.H09.1.454.CMB.1.raw
  modified_base (438)..(438): a, c, t, g, unknown or other
  misc_feature (438)..(438): n is a, c, g, or t
  modified_base (537)..(537): a, c, t, g, unknown or other
  misc_feature (537)..(537): n is a, c, g, or t
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtaccagcacttccccgggacacgcccccaaactcctcatcctatgaagattttacgcgaccctcagggattcctggccgattctctggctccaagtcaggcactctgccacctgacatcaccgggctccagaccggggacgaggccgattactactgcgcaacgttggactccaactgactggttgggctttcgggnggacgggactaaggttcgaccgtcctacgtcagcccaaggctcgcccctcggtccactcctcgttcccgccctcctccactactactcgctgacgcggntcgg

SEQ ID NO: 62839 - DNA, 549 bp, Homo sapiens
  misc_feature: GYAE6OF02HGXLK.10.86.H09.1.454.CMB.1.raw
  modified_base (517)..(517): a, c, t, g, unknown or other
  misc_feature (517)..(517): n is a, c, g, or t
  modified_base (535)..(535): a, c, t, g, unknown or other
  misc_feature (535)..(535): n is a, c, g, or t
  modified_base (545)..(545): a, c, t, g, unknown or other
  misc_feature (545)..(545): n is a, c, g, or t
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtaccagcacttccccgggacacgcccccaaactcctcatctatgaagtattttacgcgaccctcgagggtacttccgtggccgtattctctggctccaagtcaggcacctctcgcccacctggacatcgaccgggctccgacggacccggggacgacggcccgtaattacttactcgcgacaacgttcgggacctccaacctgactgttgggcttcggcggaggactagtcgaccgtctacgtcagccaagcctcgcccctgcactcgtcgtcccncctcctccactactctcnctgacgcggntcgg

SEQ ID NO: 62840 - DNA, 399 bp, Homo sapiens
  misc_feature: GYAE6OF02H59J4.10.86.H09.1.454.CMB.1.raw
  modified_base (388)..(388): a, c, t, g, unknown or other
  misc_feature (388)..(388): n is a, c, g, or t
  modified_base (394)..(399): a, c, t, g, unknown or other
  misc_feature (394)..(399): n is a, c, g, or t
tcagcatagtagtgcacgaccggtgctcgatttagtgctatagacttgggtttggaagcgcctccaacattggcacgaattatgtatcctggtaccagcacttccccgggacagcccccaaactcctcatctatgaagattttacgcgaccctcagggattcctggccgattctctggctccaagtcaggcacctctgccaccctggacatcaccgggctccagaccggggacgaggccgattattactgcgcaacttgggactccaacctgactgttggggctttcggcggagggactaagttgaccgtcctacgtcagcccaaggctgcccctcggtcactctgttcccacctcctccactactatgctgagcgggctggcaggcncatagnnnnnn

SEQ ID NO: 62841 - DNA, 404 bp, Homo sapiens
  misc_feature: GYAE6OF02I02QX.10.86.H09.1.454.CMB.1.raw
  modified_base (397)..(404): a, c, t, g, unknown or other
  misc_feature (397)..(404): n is a, c, g, or t
tcagcatagtagtgcacgaccggtgctcgatttagtgctatagacttgggtttggaagcgcctccaacattggcacgaattatgtatcctggtaccagcacttccccgggacagcccccaaactcctcatctatgaagattttacgcgaccctcagggattcctggccgattctctggctccaagtcaggcacctctgccaccctggacatcaccgggctccagaccggggacgaggccgattattactgcgcaacttgggactccaacctgactgttggggctttcggcggagggactaagttgaccgtctacgtcagcccaaggctgccccctcggtcactctcgttcccgccctcctccactactatgctgagcgggctggcaaggcgcatagnnnnnnnn

SEQ ID NO: 62842 - DNA, 409 bp, Homo sapiens
  misc_feature: GYAE6OF02JS1BV.10.86.H09.1.454.CMB.1.raw
  modified_base (394)..(394): a, c, t, g, unknown or other
  misc_feature (394)..(394): n is a, c, g, or t
  modified_base (400)..(409): a, c, t, g, unknown or other
  misc_feature (400)..(409): n is a, c, g, or t
tcagcatagtagtgcacgaccggtgctcgatttagtgctatagacttgggtttggaagcgcctccaacattggcacgaattatgtatcctggtaccagcacttccccgggacagcccccaaactcctcatctatgaagattttacgcgaccctcagggattcctggccgattctctggctccaagtcaggcacctctgccaccctggacatcaccgggctccagaccggggacgaggccgattatactgccgcaacttgggactccaacctgactgttggggctttcgggcggagggactaagttgaccgtcctacgtcagcccaaggctgcccctggtcactctcgttccccaccctcctccactactatcgctgacgcgggctggcaaggcncatagnnnnnnnnnn

SEQ ID NO: 62843 - DNA, 539 bp, Homo sapiens
  misc_feature: GYAE6OF02GHRFV.10.86.H09.1.454.CMB.1.raw
  modified_base (535)..(535): a, c, t, g, unknown or other
  misc_feature (535)..(535): n is a, c, g, or t
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtaccagcacttccccgggacacgcccccaaactcctcatctatgaagattttacgcgaccctcagggattcctggccgattctctggctccaagtcaggcacctctgccacctggacatcaccgggctccagaccggggacgacgggccgattattactgcgcaacttgggactccaacctgactgttgggctttcggcggagggactaagttcgaccgtcctacgtcacgcccaagctcgcccctcggtccactctcgttcccgccctcctccactactactcgctgcgcggntcgg

SEQ ID NO: 62844 - DNA, 535 bp, Homo sapiens
  misc_feature: GYAE6OF02IB3TB.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtaccagcacttccccgggacagcccccaaactcctcatctatgaagattttacgcgaccctcagggattcctggccgattctctggctccaagtcaggcacctctgccacctggacatcaccgggctccagaccgggacgaggccgattatactgcgcaacttgggactcaactgactgttgggctttcggcggaggactaagttgaccgtctacgtcacgcccaagcctgcccctcggtccacgtctcgttcccaccttcctcctactactactcgcctgacgtcggctcggg

SEQ ID NO: 62845 - DNA, 533 bp, Homo sapiens
  misc_feature: GYAE6OF02F3PMV.10.86.H09.1.454.CMB.1.raw
  modified_base (529)..(529): a, c, t, g, unknown or other
  misc_feature (529)..(529): n is a, c, g, or t
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtaccagcacttccccgggacagccccaaactcctcatctatgaagattttacgcgaccctcagggattcctggccgattctctggctccaagtcaggcacctctgccaccctggacatcacgggctccagaccgggacgacggccgattattactgcgcaacgttgggactccaacctgactgttgggctttcggcggaggactaaggttgaccgtctacgtcacgcccaaggctgcccctcggtcactctcgttcccacctcctccactactactcgctgacgcggntcgg

SEQ ID NO: 62846 - DNA, 537 bp, Homo sapiens
  misc_feature: GYAE6OF02FK3KM.10.86.H09.1.454.CMB.1.raw
  modified_base (397)..(397): a, c, t, g, unknown or other
  misc_feature (397)..(397): n is a, c, g, or t
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtaccagcacttccccgggacagcccccaaactcctcatctatgaagattttacgcgaccctcagggattcctggccgattctctggctccaagtcaggcacctctgccaccctggacatcaccgggctccagaccggggacgaggccgattatacngcgcaacttggactccaactgactgttgggctttcggcggaggactagttgaccgtctacgtcagccaagctcgcccctcggtcactctcgttccccgccctcctccctactacctactcgccgtgacgtcgggctcggg

SEQ ID NO: 62847 - DNA, 545 bp, Homo sapiens
  misc_feature: GYAE6OF02IX1T0.10.86.H09.1.454.CMB.1.raw
  modified_base (511)..(511): a, c, t, g, unknown or other
  misc_feature (511)..(511): n is a, c, g, or t
  modified_base (541)..(541): a, c, t, g, unknown or other
  misc_feature (541)..(541): n is a, c, g, or t
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtaccagcacttccccgggacacgccccaaactcctcatctatgaagattttacgcgaccctcagggattcctgccgattctctggctccaagtcaggcacctctcgccaccctgacatcaccgggctccgacggaccgggacgacggccgattactactgcgctaacgttgggactccgaacctgacttgttggggtctttcgggcgagggtactaaggttcgaccgtctacgtcgagcccaaggctcgccctcggtcactctcgtcccncctcctaccactacgatcgctggacgcggntcgg

SEQ ID NO: 62848 - DNA, 542 bp, Homo sapiens
  misc_feature: GYAE6OF02FGEN5.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtacccagccacttcccccgggacagcccccaaaactcctcatctatgaagattttacgcgaccctcagggattcctggccgattctctggctccaagtcaggcacctctgccaccctggacatcaccgggctccagaccggggacgaggccgattattactgcgcaacttgggactccaacctgactgttgggctttcggcggagggactaagttgaccgtctacgtcagcccaaggctcgccccctcggtcactctcgttcccaccctccctcccactactatcgctgacgcgggctcgg

SEQ ID NO: 62849 - DNA, 524 bp, Homo sapiens
  misc_feature: GYAE6OF02GIVUH.10.86.H09.1.454.CMB.1.raw
  modified_base (376)..(376): a, c, t, g, unknown or other
  misc_feature (376)..(376): n is a, c, g, or t
tcagcatagtagtgcacgaccggtgctcgatttagtgctatagacttgggtttggggagagctctggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaagggccctcggtacttgatgaaggttaacagtgatggcagccacaccgaaggggacgggatcccgtgattcgttttcgacgggtcagctcgtgggctgagcgctacctcaccntctccacgcctccagtctgagatgagctgacttatactgtacagaccgtgggactacgttggttatggttgggtttcggcgggtacgggacctaacggtcgtacgaccgttaccgtacggtaccgacggacccgaggccgtaccccgg

SEQ ID NO: 62850 - DNA, 567 bp, Homo sapiens
  misc_feature: GYAE6OF02HN02H.10.86.H09.1.454.CMB.1.raw
  modified_base (563)..(563): a, c, t, g, unknown or other
  misc_feature (563)..(563): n is a, c, g, or t
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtaccagcacttccccgggacagcccccaaactcctcatctatgaagattttacgcgaccctcagggattcctggccgattctctggctccaagtcaggcacctctgccaccctggacatcaccgggctcccgaggacccggggacgacgggcccgtattacttacgtgccgactaaccgttgggacctaccgaaccctgacctggttggggcttttcgggcggtagggactaaggttcgaccgttccgtacgtcacgcccaaggcctcgcccctggtccactctcgttccccaccctcctccacttcactcgctgacgcggntcgg

SEQ ID NO: 62851 - DNA, 558 bp, Homo sapiens
  misc_feature: GYAE6OF02GNLVJ.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtaccagcacttccccgggacacgccccaaactcctcatctatgaagattttacgcgaccctcgaggattcctggccgattctctggctccaagtcaggcacctctcgccacctggacatcaccgggctccgacgaccggggacgacggccgattacttacgtgcgctaacgttgggaacctccgaacctgacgttggttcgggtctttcgggacgggagggactaagttcgaccgtctacgtcacgcccaaggcctcgcccctggtccacgtctcgttcccaccctcctccactactctcgctgacggtcggctcgg

SEQ ID NO: 62852 - DNA, 553 bp, Homo sapiens
  misc_feature: GYAE6OF02IAHPB.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtaccagcaccttccccgggacagcccccaaactccctcatctatgaagattttacgcgacccctcagggattcctggccgattctctggctccaagtcaggcacctctcgccacctggacactcaccgggctccgaggacccggggacgacgggccgatttacttactgcgcaacgttgggactccaacctgacgtggttcggggctttcgggcggtagggactaacggttgaccgtcctacgtcagcccaagctcgcccctgtcactctcgttcccacctcctccactactactcgctggacgcggctcgg

SEQ ID NO: 62853 - DNA, 556 bp, Homo sapiens
  misc_feature: GYAE6OF02F99HU.10.86.H09.1.454.CMB.1.raw
  modified_base (513)..(513): a, c, t, g, unknown or other
  misc_feature (513)..(513): n is a, c, g, or t
  modified_base (524)..(524): a, c, t, g, unknown or other
  misc_feature (524)..(524): n is a, c, g, or t
  modified_base (530)..(530): a, c, t, g, unknown or other
  misc_feature (530)..(530): n is a, c, g, or t
  modified_base (539)..(539): a, c, t, g, unknown or other
  misc_feature (539)..(539): n is a, c, g, or t
  modified_base (544)..(544): a, c, t, g, unknown or other
  misc_feature (544)..(544): n is a, c, g, or t
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtaccagcacttccccgggacacgcccccaaactcctcatctatgaagattttacgcgaccctcgagggacttcctggccgattctctggctccaagtcaggcacctctcgccaccctggacactcgaccgggctccgacggaccggggacgacggccgtattacgttactcgcgactaacgttcgggacctccaacctgacgttggttcgggtctttcgggcggagggactaagttcgaccgtctacgtcgacgccaagcctcgcccctgcnctctcgtcccncctccnccactactncgtcngacgcggctcgg

SEQ ID NO: 62854 - DNA, 602 bp, Homo sapiens
  misc_feature: GYAE6OF02GOCT8.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtaccagccaccttccccggacacgcccccaaactcctcatctatgaagtacttttacgccgaccctcgagggtacttcctggccgtattctctggcctccaagtcaggcacctctcgccacctgaccatccgaccgggtctccgacggacccggggacgacggaccgtattacttacctgccgacgtaacgttcgggacctaccctaacctcgacgttggttcggggtccgttttcgggccgggtagggacgttaagttcgacccgttccgtacgtccgacgacccgaaggcctcgccccgtcggtcctacgtcgtccgtccctaccctcctcctactactagtcgctaggcgcggctcgg

SEQ ID NO: 62855 - DNA, 530 bp, Homo sapiens
  misc_feature: GYAE6OF02GFN6H.10.86.H09.1.454.CMB.1.raw
  modified_base (314)..(314): a, c, t, g, unknown or other
  misc_feature (314)..(314): n is a, c, g, or t
  modified_base (458)..(458): a, c, t, g, unknown or other
  misc_feature (458)..(458): n is a, c, g, or t
  modified_base (526)..(526): a, c, t, g, unknown or other
  misc_feature (526)..(526): n is a, c, g, or t
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtaccagcacttccccgggacacgcccccaaactcctcatctatgaagattttacgcgaccctcagggattccnggccgattctctggctccaagtcaggcacctctgccacctggacatcaccgggctccgagaccggggacgacggccgattatactgcgcaactgggactccaactgactgttgggctttcggcggcgggactaggtgaccgtcngggtcagccaagctcgcccctcggtcactctcgtcccaccctcctccacctactatcgctgcgtcggntcgg

SEQ ID NO: 62856 - DNA, 534 bp, Homo sapiens
  misc_feature: GYAE6OF02HB647.10.86.H09.1.454.CMB.1.raw
  modified_base (504)..(504): a, c, t, g, unknown or other
  misc_feature (504)..(504): n is a, c, g, or t
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaaacattggcacgaattatgtatcctggtaccagcaccttccccgggacacgcccccaaactcctcatctatgaagattttacgcgaccctcagggattcctggccgattctctgctccaagtcaggcacctctcgccacctggacactcaccggctccagacgaggggacgaggccgtattactactgcgacaacgttggactccaacctgacttggttcgggtctttcgggcggaggactaagtcgaccgtctacgcacgccaggctcgccctgtcactctcgtcccncctcctccactactctcgctcgacgcggcg

SEQ ID NO: 62857 - DNA, 553 bp, Homo sapiens
  misc_feature: GYAE6OF02FU8BH.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtaccagcacttccccgggacagcccccaaactcctcatctatgaagattttacgcgaccctcagggattcctggccgattctctggctccaagtcaggcacctctgccaccctggacatcaccgggctccgagacccggggacgacggccgattatactgcgcaacttgggactccaacctgactgttgggctttcggcggagggactaagttgaccgtctacgtcagcccaaggctcgccccctggtccactcctcgttccccacccttccctacccaccttacctactcgtcctgacggccgggctcggg

SEQ ID NO: 62858 - DNA, 539 bp, Homo sapiens
  misc_feature: GYAE6OF02F9U6A.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtaccagcacttccccggacagccccaaactcctcatctatgaagattttacgcgaccctcagggattcctggccgattctctggctccaagtcaggcacctctgccaccctggacatcaccgggctccagaccggggacgacggccgattacttactgcgcaacgttgggactccaacctgactggttcggggctttcgggcggagggactaaggttcgaccgtcctacgtcagccaaggctcgcccctcgtcactctcgtcccgccctcctccactactactcgctgcgcggctcgg

SEQ ID NO: 62859 - DNA, 406 bp, Homo sapiens
  misc_feature: GYAE6OF02IIJ9L.10.86.H09.1.454.CMB.1.raw
  modified_base (389)..(389): a, c, t, g, unknown or other
  misc_feature (389)..(389): n is a, c, g, or t
  modified_base (395)..(406): a, c, t, g, unknown or other
  misc_feature (395)..(406): n is a, c, g, or t
tcagcatagtagtgcacgaccggtgctcgatttagtgctatagacttgggtttggaagcgcctccaacattggcacgaattatgtatcctggtaccagcacttccccgggacagccccccaaactcctcatctatgaagattttacgcgaccctcagggattcctggccgattctctggctccaagtcaggcacctctgccaccctggacatcaccgggctccagaccggggacaggccgattattactgcgcaacttgggactccaacctgactgttggggctttcggcggagggactaagttgaccgtcctacgtcagcccaaggctgcccctggtcactctgttcccaccctcctccactactatgctgagcgggctggcaaggcncatagnnnnnnnnnnnn

SEQ ID NO: 62860 - DNA, 559 bp, Homo sapiens
  misc_feature: GYAE6OF02F19O8.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtacccagccacttccccgggacacgcccccaaactcctcatctatgaagattttacgcgaccctcagggattcctggccattctctgctccaagtcagcacctctcgccacctggacatcgaccggctccgaggacccgggacgacggccgtattattactgcgctaacttgggactccgaacctgacgtgttcgggctttcggcggtaggactaagttcgaccgtactacgtcacgcccgaagcctcgccccgtcgtacaccgtctcgttcccacccgtccctcctaactactacgtcgtctggacgtcggctacgg

SEQ ID NO: 62861 - DNA, 863 bp, Homo sapiens
  misc_feature: GYAE6OF02J28BD.10.86.H09.1.454.CMB.1.raw
  modified_base (206)..(206): a, c, t, g, unknown or other
  misc_feature (206)..(206): n is a, c, g, or t
  modified_base (230)..(230): a, c, t, g, unknown or other
  misc_feature (230)..(230): n is a, c, g, or t
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgtgacgcagccgccctcagtgtctgcggccccaggacagagggtcaccgtctcctgctctggaancgcctcaacattggcacgaattangtatcctggtaccagccacgttccccgggacacgcccccaaactcctcatctatgaagtacttttaacgccgtaaccctcgacgggtacttccgtggcccgtatttccgtcgtcgggtacctacccgtaaaggttccgaacgggtccctaacccgtaccgttcggacccctaacccgttgggaacctacgttcccgaacccgggtctacccgaacggtacccggggaacgtacgggtcccgtaatttaacgttaccgcggtaccgtacgtaaaccgtttcgggaacccttacccgtaaaccgttcggtaacccgttgggtttaccgggggtaccctttttaccgggggaccgggttaaacggggtaacccgtttaaacgggtttaccggtaaccccggtttacccggttaaaccggttcccgtaaaccgggtacccccgttaaaacgggggttcccttaacccgggtcccccccgttacggggtttacccctaacccggtttccgtttacccgggtttacccccccggtcccgtttacccccgttaaccccgttaaccgttaacccgtttaaccgttcccgggacccgtttaccgggtaaccgggttccccggggttaccgttaacccggggg

SEQ ID NO: 62862 - DNA, 564 bp, Homo sapiens
  misc_feature: GYAE6OF02IKHXC.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtaccagcaccttccccgggacacgcccccaaactcctcatctatgaagattttacgcgaccctcgagggattccgtggccgtattctctcggcctccaagtcaggcacctctcgccaccctggacatcgaccgggctccgacggaccggggacgacgggccgtattattacgtgcgacaacgttcggactccaacctgacttggttcgggcttcgggcggtaggtactaagttcgaccgtctacgtcacgccaagcctcgccccgtggtccacgtctccgttcccacccttcctacctactactactcgctgcgtcggctcgg

SEQ ID NO: 62863 - DNA, 692 bp, Homo sapiens
  misc_feature: GYAE6OF02JFHJH.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtaccagccacttccccgggacacgcccccaaactcctcatctatgaatattttacgccgaccctcacgggtattcctcggccgattctctggcctaccaagtcaggccacctctcgcctaccctcggaacactccgaccgggctcccgacggacccggggacgacgggccgtaatttacgtactcggcgacgtaaccgttggggaccttacccaaccgttcgaccgttacgggttcggggtccttttacggggacgggtacgggtaacgtttaacggttcggaacccggtttccgttaaccgtccgtaacggtccccgaaacggggtcccttaccggtccccccgttacgggtcccgtaccgtttccgtaccgtttaccccctacccgttccctacccgtaaccgttaccgtttactcgtaccgttcgggacggtccgggccttaccgggg

SEQ ID NO: 62864 - DNA, 551 bp, Homo sapiens
  misc_feature: GYAE6OF02H21F2.10.86.H09.1.454.CMB.1.raw
  modified_base (233)..(233): a, c, t, g, unknown or other
  misc_feature (233)..(233): n is a, c, g, or t
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagccgcctccaacattggcacgaattangtatcctggtaccagcacttccccgggacacgcccccaaactcctcatctatgaagtattttacgcgaccctcagggattcctggccgattctctggctccaagtcaggcactctcgccacctggacatcaccgggctccgagaccgggacgacggccgtattacttactggcgacaacgttgggactccaactgactggttcgggtctttcgggcggtagggtactaaggttcgaccgtcctacgtcacgccgaagcctcgcccctgtcactctcgtcccaccctcctaccactactactcgcgtgacgcggctcgg

SEQ ID NO: 62865 - DNA, 887 bp, Homo sapiens
  misc_feature: GYAE6OF02HYBIJ.10.86.H09.1.454.CMB.1.raw
tcagcatagtagtgcacgaccggtgctcgatttagtgctatagacttgggtttgggactcgggacaatcttcatcatgacctgctcccctctcctcctctcccttctcattcactgcacagggtcctgggcccagtctttgttgacgcagccgccctcagtgtctgccggccccaggacagagggtcaccgtctcctgctctggaagccgcctccaacattggcacgaattatgtatcctggtaccagcacttccccgggacacgcccccaaactcctcactctatgaagtattttaccgcgtacccctcgacgggtactttccgtcggtcccgtattcctcttcgggccttacccgtaaacgttccgaacgggtccctaacccttcccgtaccggtacccctaccccgttacgggaacctaccgttacccggaacccggggtcccttaccccggaaacggggaaccccggggggaaccgaaccggggaccccggttaaacgttttaacgtttaacccgttacggtaccccggtaccgtaaaacccgggtttcggggtaaccccttaccccgtaaaaccccgttgggtaacccggtttcggggtttccggggggttcccgtttttaccgggggacccggggttaaacgggggttaacccgtttaaacgggtttccgggtaaacccccggtttcccgttaacccgggttacccgtaaccggacccccgtaaagggtccccgttaccggtcccccccggtttacgggtccctacccggttcccgtttcccggtttaccccccggccccctttcccgtaacccgtaacccgtttaccgtaccgtttccggtaccgttaccgggacggttcccggggtcttaacccggggg

SEQ ID NO: 62866 - DNA, 626 bp, Homo sapiens
  misc_feature: GYAE6OF02IZZMH.10.86.H09.1.454.CMB.1.raw
  modified_base (205)..(205): a, c, t, g, unknown or other
  misc_feature (205)..(205): n is a, c, g, or t
  modified_base (216)..(216): a, c, t, g, unknown or other
  misc_feature (216)..(216): n is a, c, g, or t
  modified_base (307)..(307): a, c, t, g, unknown or other
  misc_feature (307)..(307): n is a, c, g, or t
  modified_base (576)..(576): a, c, t, g, unknown or other
  misc_feature (576)..(576): n is a, c, g, or t
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagaggtcaccgtctcctgctctggancgcctccaacnttggcacgaattatgtatcctggtaccagcaccgttccccgggacacgcccccaaactccctcactctatgaagtattttacgcgaccctnagggtacttcctggccgattctctggctccaagtcaggcacctctcgccacctggacactcgaccgggctccgacggaccggggacgacgggcccgtaattacgttaccgtgacgactaaccgtttcgggacctacccgaaacctcggtaccttgggttacggggtccgttttcgggcgggtaacgggtaacttaaggttcgtaacccgttccgtaacgtcacggccccgaaaggtcctcgcccccgtagtccacttcctcgtaccccnccctcccgtaccaaccttacctatccggtctcggacggtccggcgtacgg

SEQ ID NO: 62867 - DNA, 663 bp, Homo sapiens
  misc_feature: GYAE6OF02H7MQ2.10.86.H09.1.454.CMB.1.raw
  modified_base (260)..(260): a, c, t, g, unknown or other
  misc_feature (260)..(260): n is a, c, g, or t
tcagcatagtagtgcacgaccggtgctcgatttagtgctatagacttgggtttgggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtaccagcacttcccgggacncgccccaaactcctcatctatgaagtattttacgcgaccctcagggtacttccgtggccgattctctggctccaagtcaggcacctctcgcctacctggacagtcaccgggctccacggaccggggacgacggcccgtattacgttacgtcgcgacgtaacgttcggtactaccctaacctgtacgttcggttcggggtccgttttcgggacgggtacgggtacgtaacggttcggtacccgttaccgtacgtaccgacggtaccccgtaacgggtccgtccggtcccccgttaccgggtcctaccgttcccgtttcccggttccccggtaccccttcccgtaccccgtaaccttaccgttacgtccggtccgttacggtacgggtcccggggtacgtcgggg

SEQ ID NO: 62868 - DNA, 532 bp, Homo sapiens
  misc_feature: GYAE6OF02H5TRJ.10.86.H09.1.454.CMB.1.raw
  modified_base (315)..(315): a, c, t, g, unknown or other
  misc_feature (315)..(315): n is a, c, g, or t
  modified_base (474)..(474): a, c, t, g, unknown or other
  misc_feature (474)..(474): n is a, c, g, or t
  modified_base (528)..(528): a, c, t, g, unknown or other
  misc_feature (528)..(528): n is a, c, g, or t
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtaccagcacttccccgggacagcccccaaactcctcatctatgaagattttacgcgacccctcagggacttccnggccgattctctggctccaagtcaggcactctgccacctggacatcaccgggctccagccggggacgaggccgattatactgcgcaacgttggactcaacctgactgttcgggctttgggcggtagggactaagttgaccgtctacgtcagcccaagcncgcccctggtccactctcgtcccgccctcctccactactactgcctgacgcggntcgg

SEQ ID NO: 62869 - DNA, 402 bp, Homo sapiens
  misc_feature: GYAE6OF02HCIY9.10.86.H09.1.454.CMB.1.raw
  modified_base (398)..(402): a, c, t, g, unknown or other
  misc_feature (398)..(402): n is a, c, g, or t
tcagcatagtagtgcacgaccggtgctcgatttagtgctatagacttgggtttggaagcgcctccaacattggcacgaattatgtatcctggtaccagcacttccccgggacagcccccaaactcctcatctatgaagattttacgcgaccctcagggattcctggccgattctctggctccaagtcaggcacctctgccaccctggacatcaccgggctccagaccggggacgaggccgattattactgcgcaacttgggactccaacctgactgttggggctttcggcggagggactaagttgaccgtcctacgtcagcccaaggctgccccctcggtcactctgttccccgccctcctccactactatgctgagcgggctggcaaggcgcatagnnnnn

SEQ ID NO: 62870 - DNA, 603 bp, Homo sapiens
  misc_feature: GYAE6OF02HT3Q7.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggagcgcctccaacattggcacgaattatgtatcctggtaccagcacgttccccgggacacgcccccaaactcctcatctatgaagtattttacgccgacccctcagggtacttcctggccgtattctctggctccaagtcaggcacctctcgccacctggacatccgaccgggctccgacggacccggggacgaggaccgtattacttacgtcgccgactaacgttgggacctaccaaccgtgacgttcggttcggggtcgtttcgggcgggaacgggtactaacggttcggacccgttaccgtaccgtacgacgacccgtaacgccgtccgcccccgttgtccacgtccttccgtcccgtccctcctccactactactcgcgtcgacgtcggcgtacgg

SEQ ID NO: 62871 - DNA, 400 bp, Homo sapiens
  misc_feature: GYAE6OF02GMYNB.10.86.H09.1.454.CMB.1.raw
  modified_base (397)..(400): a, c, t, g, unknown or other
  misc_feature (397)..(400): n is a, c, g, or t
tcagcatagtagtgcacgaccggtgctcgatttagtgctatagacttgggtttggaagcgcctccaaaattggcacgaattatgtatcctggtaccagcacttccccgggacagcccccaaactcctcatctatgaagattttacgcgaccctcagggattcctggccgattctctggctccaagtcaggcacctctgccaccctggacatcaccgggctccagaccggggacgaggccgattattactgcgcaacttgggactccaacctgactgttggggctttcggcggagggactaagttgaccgtcctacgtcagcccaaggctgccccctcggtcactctgttcccaccctcctccactactatgctgagcgggctggcaaggcgcatagnnnn

SEQ ID NO: 62872 - DNA, 601 bp, Homo sapiens
  misc_feature: GYAE6OF02FT3S5.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtaccagccacttccccgggacacgcccccaaactcctcatctatgaagtattttacgcgaccctcagggacttccgtggccgattctctcggctccaagtcaggcacctctgccacctggacatcgaccgggctcccgacggaccggggacgacgggccgtaattacttacgtcgcgctaacgttgggacctccaacctcgacgttggttcggggcttttccgggacgggtacgggtacttaaggttcgaccgttccgtacgtcacgcccaagggcctccgccccgttgtccactccgtcgttcccctacccttccctaccctacctacttacgtcgtccgtcggacgtccgggctcggg

SEQ ID NO: 62873 - DNA, 690 bp, Homo sapiens
  misc_feature: GYAE6OF02GNMEH.10.86.H09.1.454.CMB.1.raw
  modified_base (363)..(363): a, c, t, g, unknown or other
  misc_feature (363)..(363): n is a, c, g, or t
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtaccagcacttccccgggacacgcccccaaactcctcatctatgaagtattttacgcgaccctcagggacttcctggccgattctctggctccaagtcagccacctctcgccaccctggacntcgaccgggctccgacggaccgggacgacggccgtattacttacgtgccgactaacgttcgggacctacccgaaccgtcgaccgttggttcgggggtaccgttttccggggaccgggtaagggtaaccttaagggttccggaacccggttacccgttaaccggttccgaacggtaccccgtaaagggcccttccggtcccccccgttcgggtaccctaccgttcccgttaccggtttcccccctaacccccttccccgttaccccgtacccttaacccgttaacgttcggttacccgttcggaccgggtcccggggtcgtaccgggg

SEQ ID NO: 62874 - DNA, 646 bp, Homo sapiens
  misc_feature: GYAE6OF02FUZ0W.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtaccagccaccgttccccgggacacgccccaaactcctcatctatgaagtattttacgccgaccctcgagggacttccgtggccgattctctggctccaagtcaggcacctctcgccacctgacacgtccgaccgggcctccgacggacccggggacgacggccgtattacgttactcggcgactaacgttgggacctacccaaccgtgaccgttggttacggggtcttttcggggcgggtaacgggtacgttaacggttcgtacccggtccttacgtccgacggtcccgaaagggtcctccggcccccgtcgggtcctaccgttccgttccgtttcccccacccttccccgtaccctaacccgttacttacgtcgtaccgtcggacggtccgggtcgtaccggg

SEQ ID NO: 62875 - DNA, 640 bp, Homo sapiens
  misc_feature: GYAE6OF02HRW5U.10.86.H09.1.454.CMB.1.raw
  modified_base (634)..(634): a, c, t, g, unknown or other
  misc_feature (634)..(634): n is a, c, g, or t
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtacagcacgttccccggacacgcccccaaactcctcatctatgaagtattttacgccgtaccctcgagggtacttccgtggccgtattcctcgtacggccttaccgaacgtcacggccacctctcgacccaccgtggacacgtccgaccgggcctaccgacggaacccggggacgacgggaccgtaatttacgtacgtcgcgacgtaacgttcgggactaccgaacgtgtacgttggttcggggtccgtttcgggcgggtaaggtactaggttcgtaccgttccgtacgtcgacgaccgaacgtcctaccgccccgtcgtcctacgttccttccggttccccgccccttccctaccctaccttacgttacgtcgccgtacggcggaccgggtntacggg

SEQ ID NO: 62876 - DNA, 623 bp, Homo sapiens
  misc_feature: GYAE6OF02FG5YJ.10.86.H09.1.454.CMB.1.raw
  modified_base (217)..(217): a, c, t, g, unknown or other
  misc_feature (217)..(217): n is a, c, g, or t
  modified_base (231)..(231): a, c, t, g, unknown or other
  misc_feature (231)..(231): n is a, c, g, or t
  modified_base (279)..(279): a, c, t, g, unknown or other
  misc_feature (279)..(279): n is a, c, g, or t
  modified_base (299)..(299): a, c, t, g, unknown or other
  misc_feature (299)..(299): n is a, c, g, or t
tcagcatagtagtgcacgaccggtgctcgatttagtgctatagacttgggtttggggactcgggacaatcttcatcatgacctgctcccctctcctcctctcccttctcattcactgcacagggtcctggcccagtctttgtgacgcagccgccctcagtgtctgcggccccaggacagagggtcaccgtctcctgctctggaacgcgcctccaacnttggcacgaattangtatcctggtacccagccacgttccccgggacacgcccccaaactccncatctatgaagacttttacnccgtaccctcaggacttccgtggcccgatttctctcggctaccaagtcaggccacctctacgccacccgtggaccatccgaccgggctccgaagggacccggggtacgacggccgaattaacttacgtgccgactaacgttcggggaccctacccgaaaccgtcgaccgttggttcggggcctttacgggccgggtaagggtacctaagttccggaccgttccgtacgtaccacgacccaaggcctcggcccctcggtcacgtcgtcgttccccgccctccctccctacttacctactcgccgtggacggtccggtcgtacggg

SEQ ID NO: 62877 - DNA, 647 bp, Homo sapiens
  misc_feature: GYAE6OF02IJ4CS.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagcccgccctcagtgtctgcggccccaggacagagggtcaccgtctcctgctcgtggaagccgcctccaacattggcacgtaaattatgtactcctggtaccagcaccgttccccgggacacgacccccaaactcctacactctatagtaacgtacttttaccgaccgacccttacgacgggtacttccgtggcctaattcctctcggtcctactaagtcacggccaccctcgtacgccacccgtggaccactccgaccggtctaccgacggaccggggacgacggaccgtattacgttacgcggaccgtactaacgttgggacctccgaaccgtgacgtggttacgggtctttcgggcggtaggtactagttcgaccgttacgtacgtacacgaccgaacgcgtcccgtacccgtcgtacctacctcgttcccgttccctacccctccctacccgtacttaacctcgtacgtccgttaggaccggtcggtactcggg

SEQ ID NO: 62878 - DNA, 537 bp, Homo sapiens
  misc_feature: GYAE6OF02HY15X.10.86.H09.1.454.CMB.1.raw
  modified_base (344)..(344): a, c, t, g, unknown or other
  misc_feature (344)..(344): n is a, c, g, or t
  modified_base (533)..(533): a, c, t, g, unknown or other
  misc_feature (533)..(533): n is a, c, g, or t
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtaccagcacttccccgggacagccccaaactcctcatctatgaagattttacgcgaccctcagggacttccgtggccgatctctggctcaagtcaggcactcngccaccctggacatcaccggctcccgaggaccgggacgaggcccgattacttactgcgcaacgttggactccaactgactgttgggcttcggcggaggactagttgaccgtctacgtcacgccagcctcgcccctcggtcactcctcggttcccaccctcctccactacctatcgcctggacgtcgggntcgg

SEQ ID NO: 62879 - DNA, 701 bp, Homo sapiens
  misc_feature: GYAE6OF02JABZV.10.86.H09.1.454.CMB.1.raw
  modified_base (673)..(673): a, c, t, g, unknown or other
  misc_feature (673)..(673): n is a, c, g, or t
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctcaacattggcacgaattatgtactcctaggtaccagcaccgttccccgggacacgccccaaactcctcatctatagaagtattttacgcgtaccctcgagggtacttccgtggaccgactttcctcgtcgggcctaccgaaagttccgaacggcctaaccctcgtcgacccctacccgtggaacctaacgttccgaccgggtacctcccgaaacgggaccccgggggtaacgacgggcccgtaatttacgttaccgtcgaccgaccgtaacgttcgggaccttaccgaaacgtcggtacgttgggttacgggtccgtttaccgggacgggtaacgggtacttaacggttccgacccgttaccgttaaccgtcaaccggacccgtaaggcccgtcgtacccccgtgttacccgtacttccgtccggtttccccgccccttcccgtacccacctaccgttacnccggccttgggaacgtccgggctacggg

SEQ ID NO: 62880 - DNA, 553 bp, Homo sapiens
  misc_feature: GYAE6OF02I18BR.10.86.H09.1.454.CMB.1.raw
  modified_base (502)..(502): a, c, t, g, unknown or other
  misc_feature (502)..(502): n is a, c, g, or t
  modified_base (535)..(535): a, c, t, g, unknown or other
  misc_feature (535)..(535): n is a, c, g, or t
  modified_base (548)..(548): a, c, t, g, unknown or other
  misc_feature (548)..(548): n is a, c, g, or t
tcagcatagtagtgcacgaccggtgctcgatttagtgctatagacttgggtttggggactcgggacaatcttcatcatgacctgcttccctctcctcctctcccttctcattcactgcacagggtcctgggcccagtctttgttgacgcagccgccctcagtgtctgcggccccaggacagagggtcaccgtctcctgctctggaagcgcctcaacattggcacgaattatgtatcctggtaccagccaccttccccgggacacgcccccaaaactcctcatctactgaagattttacgcgtaccctcgacgggattccgtggccgtaattccgtctgggtcctccaagttcacgggtcaacctctcgcctaccctcggacatcgaccgggctccgagaccggggacgacgggccgattactactgcgcaacgttggactcaactgactggttggcttcggcgaggactagtcaccgtctacgtcagccaagctcgtccccngtccactctcgtcccgcctcctcctactctacncgctgacgtcggntacgg

SEQ ID NO: 62881 - DNA, 815 bp, Homo sapiens
  misc_feature: GYAE6OF02G5FSV.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattcggcaacgtaattatgtatcctggtaccagccaccgttccccgggacacgacccccaaactcctcatctatagaagtattttaccgccgtaccctacgagggtacttccgtcggtccgtatttcctcgttcggccttacccgaaggtccgacggtcctacccttcctccgccccgtacccgtacggaacctacgttcccgacccggggacctacccggaaccggggaacccgggggaaccggaaccgggtacccgtaacgtttaaccgtttaaccgtaccggtaccggtaacctaaaccgggtttacggggaacccttacccgtaaacccggttcgtaccgtttacggggtttccgggggtaccgttttaccgggggaccgggtacgggggtaaccttacgggttaccgaacccgggttacccgttaccgggtaccaccggtaccccgtaaggtcccgttcccgtccccccggttaccggtaccgttacccttcccggttacccgttacccccccgtacccccttaccccgtacccctaaccgttacccttaccgtcggtacccttacgggtaccggtccgggtaccgtaccggg

SEQ ID NO: 62882 - DNA, 568 bp, Homo sapiens
  misc_feature: GYAE6OF02GSIXJ.10.86.H09.1.454.CMB.1.raw
  modified_base (563)..(563): a, c, t, g, unknown or other
  misc_feature (563)..(563): n is a, c, g, or t
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtaccagcacttccccgggacacgccccaaactcctcatctatgaagtacttttacgcgaccctcgagggacttccgtggccgtattcctctggctaccaagtcacggcacctctcgcccaaccgtcggaacactcgaccgggctccgacggacccggggacgacggccgtaattacgttacgtgcgacaacgttcggacctaccaacctgactggttcgggcgtttcggcggaggtactaggtcgaccgtctacgctacgaccaagctcgcccgtcgtcactctcgtcccaccttcctcctactactactcgctcgcgcggntacgg

SEQ ID NO: 62883 - DNA, 612 bp, Homo sapiens
  misc_feature: GYAE6OF02I3AJY.10.86.H09.1.454.CMB.1.raw
  modified_base (597)..(597): a, c, t, g, unknown or other
  misc_feature (597)..(597): n is a, c, g, or t
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagcccgccctcagtgtctgccggccccaggacagagggtcaccgtctcctgctctggaagccgcctccaacattggcaacgaattatgtatccgtggtaccagccaccgttcccgggacacgccccaaactcctcatctatgaagtacttttacgccgacccctcgaggtacttccgtcggccgtacttctctggcctaccaaacgtcacggccacctctcgcccacccgtggacactcgaccgggcctaccgacggaccggggacgacggccgtattacttactcgcgactaacgttcgggacctaccaaccgtgtacgttcggtttcggggtccgtttcgggcgggacgggtaacgtaaggttcgaccgttaccgtacgtcgacgtacccgaagtcctcgcccctggtccactctccgtccctacctcctccgactacgtactcgntcggcgcggctacgg

SEQ ID NO: 62884 - DNA, 717 bp, Homo sapiens
  misc_feature: GYAE6OF02H398Y.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtaccagcacttccccgggacagcccccaaaactcctcactctatagaacgtattttaccgcgacccctcacgggtacttcctggccgtattctctggctccgaagtcacggcacctctcgccacctggacatccgaccgggcctccgaacggaccgggggacgacgggcccgtaagtttacgttacctcggaccgtacaaaccgtttcgggactacccgtaaacccgtggtaaccttcgggttacggggtccttttcggggaccgggtaacgggtaaccgtaaaggtttcgaaccccggttaccgtaaccgttccgaaccggaccccgtaaacgggtccctcggtacccccccgttacgggtaccctaccgttacccgttcggttcccgaacccggttcccccttaccccgtttaccccgtaaccctttaaccgttaacgttccgtacccgttacggaccgggtaccgggtcccgg

SEQ ID NO: 62885 - DNA, 577 bp, Homo sapiens
  misc_feature: GYAE6OF02JCBRE.10.86.H09.1.454.CMB.1.raw
  modified_base (361)..(361): a, c, t, g, unknown or other
  misc_feature (361)..(361): n is a, c, g, or t
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtaccagcacttccccgggacacgccccaaactcctcatctatgaagattttacgcgaccctcgagggtattcctggccgattctctggctccaagtcaggcacctctcgccacctggacntccaccgggctccgacggaccggggacgacgggccgtattacttacgtggcgcaacgttcgggacctccaacctgacttggttcgggctttcgggcggacgggtacgtaaggttcgaccgttcctacgtcgacgcccgaagcctccgccccgtggtccacttctcgttccccacccttccctaccaccttactctcgtcctggacggtcggctcgg

SEQ ID NO: 62886 - DNA, 534 bp, Homo sapiens
  misc_feature: GYAE6OF02FQZWO.10.86.H09.1.454.CMB.1.raw
  modified_base (478)..(478): a, c, t, g, unknown or other
  misc_feature (478)..(478): n is a, c, g, or t
  modified_base (530)..(530): a, c, t, g, unknown or other
  misc_feature (530)..(530): n is a, c, g, or t
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtacccagcacttccccgggacacgcccccaaactcctcatctatgaagattttacgcgacccctcagggattcctggccgattctctggctccaagtcaggcacctctcgccaccctggacatcaccgggctccacggaccggggacgacggccgattattactgcgcaacttgggactccaactgactggttggctttcggcggaggactagttgaccgtctacgtcacgccagcncgcccctcgcactctcgtcccacctcctccactactactcgctgacgtcggntcgg

SEQ ID NO: 62887 - DNA, 411 bp, Homo sapiens
  misc_feature: GYAE6OF02FUMOD.10.86.H09.1.454.CMB.1.raw
  modified_base (400)..(401): a, c, t, g, unknown or other
  misc_feature (400)..(401): n is a, c, g, or t
  modified_base (403)..(411): a, c, t, g, unknown or other
  misc_feature (403)..(411): n is a, c, g, or t
tcagcatagtagtgcacgaccggtgctcgatttagtgctatagacttgggtttggaagcgcctccaacattggcacgaattatgtatcctggtaccagcacttccccgggacagcccccaaactcctcatctatgaagattttacgcgaccctcagggattcctggccgattctctggctccaagtcaggcacctctgccaccctggacatcaccgggctccagaccggggacaggcccgattatactgcgcaacttgggacctccaacctgactgttgggctttcggcggagggactaaggttgaccgtcctagtcagcccaaggctcgccccctggtcactctgttccccaccctcctccactactactgctgagcgggctggcaagggcgacatagnngnnnnnnnnn

SEQ ID NO: 62888 - DNA, 803 bp, Homo sapiens
  misc_feature: GYAE6OF02GTMHD.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggcccaggacagagggtcaccgtctcctgctctggaagccgcctaccaactattcggcaacgtaattatgtatcctggtaccagcctaccgttccccgggacaccgacccccaaactcctacactctagtacgaagttattttaccgccgtaccctcggacggtacttcccgtggtacccgtatttcctcgtcggtcctaccgtaacggttcacggtacctacccgtctcgaccctacccgtaggacctaactccggacccgggtacctaccggaaccgggaacccggggggtaccgaaccgggtaccgtaacgtttaacgttaccgtcggtccgtaacgtaaccggttacgggaaccttacccgtaaccgttcggtaccgttgggttaccggggttccgtttaccggggaccggggtaacgggtaaccgtttaacggttcgggtaaccccgttaccggttaaccgtaccgaccggtacccgtaacgggtcccgtacccggttccccccggtacggttacccttaccgttcccgtttacccggtttacccccgaccccgtttcccctacccgtacccttaaccgtacgttccggtacccgtacgggtaaccgggtcccgggtacgttacccgggg

SEQ ID NO: 62889 - DNA, 854 bp, Homo sapiens
  misc_feature: GYAE6OF02JTZZ7.10.86.H09.1.454.CMB.1.raw
  modified_base (218)..(218): a, c, t, g, unknown or other
  misc_feature (218)..(218): n is a, c, g, or t
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgccggccccaggacagagggtcaccgtctcctgctctggaagcgcctcaacnttggcacgaattatgtactccgtggtaccagctaccgttcccggacacgccccaaactcctcatctatgtaagtacttttacgcgtaccctgacgggtacttccgtaggtccgtatttccgtcgttcgggccttaccgtaaacggttcgaaccgggtcctaaccccgttccgttacgaccccgtaaccccgttcgggtaaccctaacgtacccggtaacccgggtccgttacccgaacggggaaccccgggggtaaccgaacgggtacccgtaacgttttaaccgtttaccgtacggaccgtaccgttaaacgtttcgggggtaaacccttacccgtaaacccgttcggtaaccggttgggtttcggggtacccgtttttacggggaaccgggttaaacggggttaacctttaaacggggttttccggaacccggtttcccgttaaaccgggtaccgtaaaccggtaccccggtaaagggttcccgtaacccggttacccccgttacgggtttacccgtaccgttccgtttcccggttcccccgttaccccttacccgttacccgttaaccgtttacccgttaccgtttaccggtacccgttacggaccgggttccccggggtacttacccggggg

SEQ ID NO: 62890 - DNA, 606 bp, Homo sapiens
  misc_feature: GYAE6OF02HC0DV.10.86.H09.1.454.CMB.1.raw
  modified_base (568)..(568): a, c, t, g, unknown or other
  misc_feature (568)..(568): n is a, c, g, or t
  modified_base (602)..(602): a, c, t, g, unknown or other
  misc_feature (602)..(602): n is a, c, g, or t
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatccgtggtaccagcaccttcccgggacacgaccccaaactcctcatctatgaagtattttacgcgaaccctcgagggtacttccgtcggccgtatttcctcgttcggccttaccaaaggttcacgggcctacctctcgcccacccgtacggaccactcgaccgggctaccgacggaccggggacgacgggccgactttacttacgtcgcgacaacgttcgggacctaccaacctcgacgttggttgggtctttcgggcggagggtacgtacgtcgtaccgtaccgtacgtacgacgccgaacgtcctcgccccgtgtcctctccgtcgtcccnccctcctccacttactactcgcgtcgacgtcggntcgg

SEQ ID NO: 62891 - DNA, 896 bp, Homo sapiens
  misc_feature: GYAE6OF02FGPVK.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgccggcccaggacagagggtcaccgtctcctgctctggagccgcctccaactagttcggcacgtaattatgtactccgtggtaccagccaccgttccccgggacaccgaccccaaactcctacactctatgaagtacttttacgccgtacccctcgagggtactttccgtcggaccgtactttctccgtgggtaccttacccgtaaacgttccgacggcctacccttcgttccggacccctaccccgttacgggaacctacgttccccggaacccggggtcccttaccccggaaacggggaaccccgggggggtaaccggaaccggggtaccccgtaagttttaaccgttttaaccgtacggtaccgaaccgtaaaccggtttccggggaacccttaaccccgtaaacccgttcggtaaccgttggggtttacgggggtccgtttttaccggggccgggggaagggttaacccgttaaacgggtttaccggtaaccccggttacccgtttaacccggtacccgtaaaccggtaccccggtaaaccgggtcccgttacccggacccccccgtttcggggttaccccttaccgttccccggtttcccggttttcccccccgggtccccctttaccccccgttacccccgttaacccgtttaacccgttaaccgtttcccggtaccggttaccggtaccgggggtacccggggttcccgggttaacccggggg

SEQ ID NO: 62892 - DNA, 644 bp, Homo sapiens
  misc_feature: GYAE6OF02I19OG.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtaccagcctacgttccccggacacgcccccaaactcctcatctatgaagtacttttacgccgtaccctcgagggtacttccgtggccgtatttcctcgtggcctaccgaagtcaggcctacctctcgacccacccgtcggaacactccgaccgggtcctcccgaacggacccggggaacgacgggcccgtagtttacttaccgtgccgactaacgttcgggacctaccaacgtcgacgttggttcgggtcgtttcgggacgggaagggtacttaaggttcgaccggttaccctacgtccgacgacccgagtccgtccgtccccgtggtcctacgttcctccggttccccgcccttccctaccctactaccttagtccgtcgttcggacggtcggtcgtacggg

SEQ ID NO: 62893 - DNA, 754 bp, Homo sapiens
  misc_feature: GYAE6OF02HTIJI.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagaggtcaccgtctcctgctctggaagcgcctccaacattggcacgaattatgtactcctggtaccagcacttccccgggacacgcccccaaaactcctacacgttacctatacggaaagtacttttaaccgccgtaaccccttacgaggggtaacttcccgtagggacccgtaatttccgtcgtcgggtaccttaccgtaaacggttaccaacgttcggacctaacccgttcgttacggaccctaacccgttcggaacctacgtaccgacccggggtctacccgacgggacccggggacgacggtccgtaattacgttacgtacgcgactaacgttcgggacctaccaacgtacgtacgttgggttcgggtcgttttacgggaacgggtagggtaacgttaacggttcgtaacccggttacgttaaccgtacgtaaccggtacccgtaaacgggtcctacccggtcccccgttacgggtacctaccgtacccggttcccgtttacccctaacccgttcccgttaaccctactttaaccgtacgttaccgccgttacggacggccgggttaccgg

SEQ ID NO: 62894 - DNA, 641 bp, Homo sapiens
  misc_feature: GYAE6OF02FUR0F.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctaggtaccagccaccttccccgggacacgcccccaaactcctacatctatagaagtattttacgcgacccctcgagggacttccgtcggccgattcctctggctccaagtcacggccaccctcgtcgcccaccctcggacactccgaccggcctaccgacggaccggggacgacggccgattacttacgtgcgacgtaacgttcgggactacccgaacctgacgttgggtttacgggccgttttcgggccggtaagggtacgttaacggttcgacccggttccttaacggtcctaacgccccgaaggtcctccggtcccccgttcggtacctaccgtccgttccggttcccccgcccttccctccctaccttacgtacgtcggtgcggtcggtctgggaaccg

SEQ ID NO: 62895 - DNA, 702 bp, Homo sapiens
  misc_feature: GYAE6OF02GK0U6.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtaccagccaccgttccccgggacaccgacccccaaactcctcatctatgaagtacttttacgaccgtaccctcgacgggtacttccgtcggccgtattcctcgtcggtacctaccgtaacgtcacggcctacctcgtcgccctacccgtggactactccgaccgggtcctaccgacggacccggggacgacggtaccgtattacgttacgtcgccgacgtaaccgttcgggacctacccgaaccgttcgtacgttgggttcgggtccgtttacggggcgggtaagggtaaccgttaacggttccggtacccgtaccgttaccggtaccgacgacccgtaacggtcccgtacccggtcccccgttccggtacctaccgttccgttcccggttcccccgccccttccctaccctaccgttaccgtacgtcggtccgttacggaccggtccgggtacctacggg

SEQ ID NO: 62896 - DNA, 767 bp, Homo sapiens
  misc_feature: GYAE6OF02G956H.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgtgacgcagccgccctcagtgtctgccggccccaggacagaggtcaccgtctcctgctctggaagcgcctcaactattggacacgtaattatgtactccgtaggtaccagccaccgttccccggacacgacccccaaactcctacactcctagtagaacgtacttttacgaccgaccctcgacgggtacttccgtcggaccgtacttccgtcgtcggcctccgaacgtcgacggacctacctcgtacgaccctacccgtacggtaacacgtaccgacccgggtacctaccgaacgggtaccggggacgacgggccgtaattaacgttacgtcgaccgtaacgtaacgttcgggacctacccgaaccgtcggtacgttacgggtttcgggtaccgttttaccggggacgggtaacgggttaaccgttaacgggtttaccggaccccgtttacccgttaaccgggtaccgaaccgggtacccgaaacgggttccccgtacccggtccccccgttacggttcccctactttcccgtttacccggttaccccctaccccgttacccgtaacccctaacgttaccgttaacgtccgtaccgttcgggaccggtaccgggtccgtaaccggg

SEQ ID NO: 62897 - DNA, 612 bp, Homo sapiens
  misc_feature: GYAE6OF02HB57P.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtaccagccaccttccccgggacacgacccccaaactcctcatctatgaagtatttacgccgtaccctcgagggtcttccgcggacctatttcctcgtggcctcaagtcacggccacctctcgcccaccgtggacatccgaccgggctaccgacggaccggggacgacgggacccgtatttacgttacgtcggaccgtacgtaaccgttcgggaccttacccgaaaccgtcgtacgttcgggttcgggtccgtttcgggacggtacgggtactaggttcgaccgtccgtacgtcacgccgaagcctccgcccgtgtccactcgttccgtcccgcccttcctcctactctacgtcgcgtggcggcggtctcgg

SEQ ID NO: 62898 - DNA, 671 bp, Homo sapiens
  misc_feature: GYAE6OF02F8TTL.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtaccagcacttccccggacacgccccaaactcctcatctatgaagtacttttaacgcgacccctcgagggtacttccgtggccgattctctggctccaagtcacggcacctctcgccctacccgtggacactccgacccgggctacccgacggaacccgggggacgacggccgtaatttacgttacgtgaccgctaaacgttcgggaccctaccgaacctcgtacgttcgggtttcgggtccgttttcggggcggtaacggggtacttaaacggttcggtaacccgtccgttacgtaccgaacggtaccctaacggccgtccggtaccccgttcgggtaccaccgttccgtccggtttacccccaccccttcccgtaccctaccttaaccttacgtaccgtccgttacgggacggtccgggtcgtacggg

SEQ ID NO: 62899 - DNA, 629 bp, Homo sapiens
  misc_feature: GYAE6OF02F1LXP.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtaccagcacgttccccgggacacgcccccaaactcctcatctatgaagtacttttacgcgaccctcgagggacttccgtggccgattctctggctccaagtcaggcacctctcgccacctggacactcgaccgggctaccgacggacccggggacgacggaccgtatttactacgtggccgacgtaacgttcgggacctacccgaaacctcgtacgttggttcggggtcttttccggggcgggtacgggtacgttaaggttcggacccgtccgtacgtcgacgcccgaaggcctccggccccgtcgtcctacgttccgtccggttcccccgccccttcccgtccctaccgttacctacgtcgtccgtcggacggtccgggtcgtcggg

SEQ ID NO: 62900 - DNA, 445 bp, Homo sapiens
  misc_feature: GYAE6OF02GJJ54.10.86.H09.1.454.CMB.1.raw
  modified_base (146)..(146): a, c, t, g, unknown or other
  misc_feature (146)..(146): n is a, c, g, or t
  modified_base (232)..(232): a, c, t, g, unknown or other
  misc_feature (232)..(232): n is a, c, g, or t
  modified_base (249)..(249): a, c, t, g, unknown or other
  misc_feature (249)..(249): n is a, c, g, or t
  modified_base (276)..(276): a, c, t, g, unknown or other
  misc_feature (276)..(276): n is a, c, g, or t
  modified_base (283)..(283): a, c, t, g, unknown or other
  misc_feature (283)..(283): n is a, c, g, or t
  modified_base (369)..(369): a, c, t, g, unknown or other
  misc_feature (369)..(369): n is a, c, g, or t
  modified_base (414)..(414): a, c, t, g, unknown or other
  misc_feature (414)..(414): n is a, c, g, or t
  modified_base (418)..(445): a, c, t, g, unknown or other
  misc_feature (418)..(445): n is a, c, g, or t
tcagcatagtagtgcacgaccggtgctcgatttagtgctatagacttgggtttggaagcgcctccaacattggcacgaattatgtatcctggtaccagcacttccccgggacagcccccaaactcctcatctatgaagattttacncgaccctcagggattcctggccgatctctggctccaagtcaggcacctctgccaccctggacatcacgggctccagaccgggacgnggcccattattactgcncaacttggactcaacctgactgttggntttcggnggagggactaagttgaccgtctacgtcagcccaaggctcgcccctggtccactcttcgttccccgccctcctccacgtacctctancctggacggtcgggctcggactaaacgggccgtccgaattagctncgcnnnnnnnnnnnnnnnnnnnnnnnnnnnn

SEQ ID NO: 62901 - DNA, 524 bp, Homo sapiens
  misc_feature: GYAE6OF02H3F5M.10.86.H09.1.454.CMB.1.raw
  modified_base (436)..(436): a, c, t, g, unknown or other
  misc_feature (436)..(436): n is a, c, g, or t
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtaccagcacttccccgggacagcccccaaactcctcatctatgaagattttacgcgaccccttcaggggattcctggccgattctctggctccaagtcaggcacctctgccacctggacatcaaccggctccaggaccgggacgaggccgattatactgcgcaacgttggactccactgactgttgggcttcggngaggactaagtggcctcctacgtcagccagctcgcccctgtcactctcgtcccgcctcctccactactatcgctggacgtcggctcgg

SEQ ID NO: 62902 - DNA, 531 bp, Homo sapiens
  misc_feature: GYAE6OF02FWGPA.10.86.H09.1.454.CMB.1.raw
  modified_base (328)..(328): a, c, t, g, unknown or other
  misc_feature (328)..(328): n is a, c, g, or t
  modified_base (434)..(434): a, c, t, g, unknown or other
  misc_feature (434)..(434): n is a, c, g, or t
  modified_base (479)..(479): a, c, t, g, unknown or other
  misc_feature (479)..(479): n is a, c, g, or t
  modified_base (483)..(483): a, c, t, g, unknown or other
  misc_feature (483)..(483): n is a, c, g, or t
  modified_base (491)..(491): a, c, t, g, unknown or other
  misc_feature (491)..(491): n is a, c, g, or t
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtaccagccacttccccgggacacgcccccaaactcctcatctatgaagattttaacgcgaccctcagggattcctaggccattctcnggctccaagtcaggcacctctgccaccctgacatcaccggctccagaccggggacgagccgattatactgcgcaactggactccaactgactgttcgggcttcggngaggactagtgacctccgtacgtcacgccaagctcgccctcgtcnctcncgttcccnccctcctccacgtactactcgtctggacgtccggcgtcgg

SEQ ID NO: 62903 - DNA, 679 bp, Homo sapiens
  misc_feature: GYAE6OF02HUOM1.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagccgcctccaacattcggcacgtaattatgtatcctggtaccagcctaccttccccgggacacgacccccaaactcctcatctatagaagtattttaccgccgtaccctcgagggtacttccgtacggcccgtaattccttccgtacgggtcctaccgaaggttccacgggccaacccgttctcgacccaccctggacctaactccgaacccgggctacccgaacggaacccgggggacgacgggcccgtatttaacttaccgtcgccgactaacgttcgggacctacccgaaccgtgaccgttggttcggggtcctttacgggcgggtagggacttaacggttcgaccgttccgtacgtccgacgtcccgaacggtctacgcccccgttcggtacctaccgttccgtccgttccccgccccttcccgtaccctacttacctactcgtaccgtcggacgtcgggtcgtaccgg

SEQ ID NO: 62904 - DNA, 708 bp, Homo sapiens
  misc_feature: GYAE6OF02HL35Z.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgccggccccaggacagagggtcaccgtctcctgctcgtggaagccgcctaccaaacattggcaacgtaaattatgtactccgtggtaccagcctaccgttccccgggacacgacccccaaactcctacactctatgaagtattttaccgcgaccctcgaggtacttccgtcggcctattctcgtcggccttaccgaagtccaggcctacctctcgccctacctggacactccgaccgggtcctaccggaacggaccggggacgacgggccgtaatttacgttacgtcggaccgtactaacggttcgggaacctcccgaaaccgtgtacgttgggttacggggtccgttttcgggacgggaagggtaaccttaaggttccgaacccgttccgtaccgtcgaccggacccgaaggtccctaccggtcccccgtacggtcctaccgttccgttcccggtttacccccgcccctttacccgttaccctaacccgtttacgttacgttaccgtccggttacggacggtcccgggtacgtaaccgggg

SEQ ID NO: 62905 - DNA, 883 bp, Homo sapiens
  misc_feature: GYAE6OF02JEBT6.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgtgacgcagccgccctgagtcgtctggcccggacccgaggacaggacgggtccaccgtctccgtgcctcgtaggaacgccgtccctaccaacgtagttcggcctaacgtaattatcgtacttccgtacggtaaccagcctacccggttccccgggaacaccgaccccctaaacttcctactactactatacggtaagttacttttaccggcccgtaccctcgacggttacttccgtacgggcctatttccgtcgtcggtccttaccgaaggttccgacggtcctaccttccgtaccgaccccgtacccgttacggacctacgtacccggaccgggtcctacccggaaaccggggacccgggggacggaccgggtaccgttaacgtttacgttaccgtacggaccgtaaccgttaaacggttaccgggaccttaacccgtaaaccgttcggtaacggttcggggtttacggggtccggttttaccggggacggggtaacggggttaacgttaacgggttaccggtacccggttaccgttaccggtaccgtaaccggtaaccccggacgtacccggttcccggtaccccccgttcgggttacccgtacccgtttaccggtttccccggttccccccgttacccccgtttaccccgttacccccgtaaccgtttaaccctttacggttaacccggttcccggttaacggggtacccgggtacccggggtcccggttaacccgggg

SEQ ID NO: 62906 - DNA, 412 bp, Homo sapiens
  misc_feature: GYAE6OF02FWQR6.10.86.H09.1.454.CMB.1.raw
  modified_base (398)..(399): a, c, t, g, unknown or other
  misc_feature (398)..(399): n is a, c, g, or t
  modified_base (401)..(412): a, c, t, g, unknown or other
  misc_feature (401)..(412): n is a, c, g, or t
tcagcatagtagtgcacgaccggtgctcgatttagtgctatagacttgggtttggaagcgcctccaacattggcacgaattatgtatcctggtaccagcacttccccgggacagcccccaaactcctcatctatgaagattttacgcgaccctcagggattcctggccgattctctggctccaagtcaggcacctctgccaccctggacatcaccgggctccaggaccggggacgaggccgattatactgcgcaacgttgggactccaacctgactgttggggctttcggcggagggactaagttgaccgtcctacgtcagcccaaggctgcccctggtcactctcgttcccgccctcctccactactatcgctgagcgggctggcaaggcgcatagnngnnnnnnnnnnnn

SEQ ID NO: 62907 - DNA, 642 bp, Homo sapiens
  misc_feature: GYAE6OF02F883T.10.86.H09.1.454.CMB.1.raw
  modified_base (135)..(135): a, c, t, g, unknown or other
  misc_feature (135)..(135): n is a, c, g, or t
tcagcatagtagtgcacgaccggtgctcgatttagtgctatagacttgggtttggggactcgggacaatcttcatcatgacctgctcccctctcctcctctcccttctcattcactgcacagggtcctgggcccngtaactttgttgacgcagccgccctcagtgtctgccggccccaggacaggagggtcaccgtctcctgctctggaagcgcctccaacattggcacgtaattatgtactccgtggtaccagccaccgttccccgggacacgcccccaaactcctcactctatagaagtacttttacgccgtaccctcgagggtacttccgtcggccgtattctcgtcggtcctacctaagtcgaggccacctctacgaccaccctggacactcgaccgggctaccgacggaccggggacggacggaccgtattacgttacctgcggactaacgttcgggaccttacccgaacctaggacgttgggttcggggtcgtttcgggacgggtacgggtaacgttaaggttcgacccgttaccgtacggtccacggaccgaggtcctcgtccccgtcgtaccacgttcctccgttccccacccttccctaccgtactactacgtcgcgtagcggtcggcgtcgg

SEQ ID NO: 62908 - DNA, 728 bp, Homo sapiens
  misc_feature: GYAE6OF02HMJPZ.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgccggccccaggacaggagggtcaccgtctcctgctctggaacgccgccctaccaaactagttcgggaccaacggtaaatttagtcgtacttccgtcggtaaccacgcctacccgttccccgggaacaccgaccccctaaactcctcatctatagaagttactttaccgccgaccctacgacgggtacttccgtcggccgtacttcctcgtcgcctaccgaacgtcacggcctacctctcgccctaccgtagacctacgtccgaccggcctaccgacggacccggggacgacggtccgtaattacgttacgcgccgtacgtaacgttacggacctaccgtaaccgtcggtacgttgggttcgggttccgttacggggacgggtaacgggtaacgttaacggttcggtacccgttaccgtaccggtaccgaaccggacccgtaaggtcccgtacccggccccgttcggtcctaccgttccgttcccgttaccccctaccccgttccctacccttaaccgtaccgttacgtaccgtcgttacgggaccgtccgggtctaccggg

SEQ ID NO: 62909 - DNA, 716 bp, Homo sapiens
  misc_feature: GYAE6OF02GZTWS.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacaggagggtcaccgtctcctgctctggaagccgcctccaacattggcacgtaattatgtatcctggtaccagccaccgttccccgggacaccgacccccaaactccctacactctatagaagttacttttaccgccgtaccctcgagggtacttccgtcggccgtacttctcgtggtcctaccgaacgtcgacggacctaccgtcgtccgcccgtacccgtacggaacctacgtccgaacccgggtcctaccggaaacgggacccggggaacggacggtaccgtagtttacgtacgtcgaccgtacgtaacggttacggacctaccgaaccgtgtacgttgggttcggtcgttcgggacggtacgggtactaaggtcgtaccgtacgtaccgtacacgacccgtaacggtcctcccggtaccccgtccggtccctaccgtttcccgttccccgttacccccttacccgttaccctaacccttacccgtttaccgtacgttccggtaccgtccgggtacggtaccgggtcggtaccggg

SEQ ID NO: 62910 - DNA, 149 bp, Homo sapiens
  misc_feature: GYAE6OF02H7B0O.10.86.H09.1.454.CMB.1.raw
  modified_base (149)..(149): a, c, t, g, unknown or other
  misc_feature (149)..(149): n is a, c, g, or t
tcagcatagtagtgcacgaccggtgctcgatttagtgctatagacttgggtttggggaccgtcctacgtcagcccaaggctgccccctcggtcactctgttccccgccctcctccactactatgtgagcgggctggcaaggcgcatagn

SEQ ID NO: 62911 - DNA, 734 bp, Homo sapiens
  misc_feature: GYAE6OF02JUVM3.10.86.H09.1.454.CMB.1.raw
  modified_base (357)..(357): a, c, t, g, unknown or other
  misc_feature (357)..(357): n is a, c, g, or t
tcagcatagtagtgcacgaccggtgctcgatttagtgctatagacttgggtttggggactcgggacaatcttcatcatgacctgctcccctctcctcctctcccttctcattcactgcacagggtcctgggcccagttctttgtcgacgcagccgccctcagtgtctgccggcccaggacagagggtcaccgtctcctgctcgtaggaacgccgccctaccaactagttcggaccacgtaattatcgttactccgtaggtaccagtccgtaaccgttccccgggaactaccgaccccctaaactcctcaatcctaatagaatacgtttacgccctacccgtacgacggtacttccgnggtccgtattccgtccgtacggcctacctaacggtcaacggtcctaccttctccgacccctaccgtggacctacgtccgacccgggtctaccgaacgggacccggggacaccgggtaccgtagtttactaccgtacggccgtaacgtaaccggttcgggaaccttacccgtaaccgttcggtaacgtttcgggttcgggtacgtttaccgggcgggtaacgtacgttacggttcgtacccggtaccttaccgtacgaccgccgtaaccgtcgtcccgtacccgtcgtaccgtaccttcgttcccgtccctacccgttcccttaccgtaccgtacgttcttaccggtccgtaccgggtacggtaccggtccggtacgg

SEQ ID NO: 62912 - DNA, 775 bp, Homo sapiens
  misc_feature: GYAE6OF02I834H.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgcctcagtgtctgcggccccaggacagagggtcaccgtctcctgctctggaagccgcctccaacattggcacgaattatgtactcctaggtaccagcctaccgttccccggacacgaccccaaactcctcatctatgaagtactttacgcgaccctacgaggtacttccgtggcctagttcctacgtcggccttaccgaacgtaccgacggcctaaccctccgtacgccctaacccctggaacctacgtaccgacccgggcctaccgaacggacccggggacgaacgggtcccgtaatttacgttaccgtacggaccgaccgtaaacgttcgggaaccttacccgaaaccgtcgtaaccgttcgggttcggggtaccgtttcggggaccgggtaaggggtaccgtttaacgggtttaccgtaacccggttcccttaaacgggtccgtaaaccgggtaccccgtaaacgggtcccgttaccccggtaccccccgttccggtacctacccgttcccggttaacccggtttccccccttaaccccgttccccgttaacccgtacccgtttaaccgttacggtacgtcccgttacgggtacgggtacccggggtccgtaaccgggg

SEQ ID NO: 62913 - DNA, 687 bp, Homo sapiens
  misc_feature: GYAE6OF02GUP3I.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgccggccccaggacagagggtcaccgtctcctgctctggagcgcctccaacattggcacgaattatgtatccgtggtaccagccaccgttccccgggacaccgacccccaaactcctcatctatagaagtactttacgccgacccctgacgggtacttcccgtggccgtattcctcgtcggcctaccgaagtccgacggccacccgtcgtcgccctacccgtggaacctacgtcccgaccgggtctacccgacgggacccggggacgacggaccgtaagtttacgtaccgtcgaccgtacgtaacgttcgggacctaccgtaaccgtcgtacgttgggttcgggtccgtttcgggacgggtacgggtaacgtacggttccgtaccgttaccgtacggtaccgaccgacccgtaacggtcccgtacccggtccccgtcggtacctaccgttccgttacccgttcccccacccttccctaccctaaccttacgtacgtcgtcgtacggcggtccggtcgtcgg

SEQ ID NO: 62914 - DNA, 787 bp, Homo sapiens
  misc_feature: GYAE6OF02G64QC.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgccggccccaggacagagggtcaccgtctcctgctctggaagccgcctaccaacattggcacgtaattatgtactcctggtaccagcctaccgttccccggacaccgacccccaaacctcctcactctatagtaacgtactttaccgccgtaccctcgagggtacttccgtcggccgtatttccgtcgtcggctaccgtaagtcgacggccaccgtcctccgccctacccgtcggaacctacgtaccggacccgggtcctaccggtaaccggggacccggggaccggtaacgggacccgttaactttaacgttaccgtcgaccggtaacgtaaccggttacgggaccttacccgtaaccgtacggtaccgttgggttacggggttcgtttccggggacgggtaacgggtaacgttaaacggttccggtaacccgttcccgtaaccggtaccgaaccggtacccgtaacggtcccgtcccggtcccccgttcgggttaccctaccgtttacccgttccccggttcccccgttacccccgttcccccgtacccttaacccgttaaccgtttaccggtaccgttccggtaccgggtaccgggtacccggggtcgttaacccggg

SEQ ID NO: 62915 - DNA, 694 bp, Homo sapiens
  misc_feature: GYAE6OF02GBH8Y.10.86.H09.1.454.CMB.1.raw
  modified_base (270)..(270): a, c, t, g, unknown or other
  misc_feature (270)..(270): n is a, c, g, or t
tcagcatagtagtgcacgaccggtgctcgatttagtgctatagacttgggtttggggactcgggacaatcttcatcatgacctgctcccctctcctcctctcccttctcattcactgcacaggtcctgggcccagtctttgtgacgcagccgcctcagtgtctgcggcccaggacagaggtcaccgtctcctgctcgtggaacgcgcctaccaacattcggacaacgtaattacgtgtactccgtggtaccagccaccgttccccggganaccgaccccaaactcctacatctatgaatactttacgccaccctgagggtacttccgtggaccgtatttccgtcgtggaccttacaacggttcgacggccaaccttctcgcccaacccgtggacctagtccggaccgggcctaccgaacgggaccggggacacgggcccgtaatttacgttacgtcggacgacgtaacggttcggacctaccgaaccgtcggaccttgggttcgggtccgtttcgggacgggaacgggtacgtaacggttcgtacccgttaccgtaccgtacgaccgtacccgtaacggtcctcccggacccccgttcggtacctaccgttccgttacccgttacccctaaccccttcccgtaccctaacgttaccgttacgtcgtaccgtacggaccggtcggtcgtaccggg

SEQ ID NO: 62916 - DNA, 589 bp, Homo sapiens
  misc_feature: GYAE6OF02HJCDX.10.86.H09.1.454.CMB.1.raw
  modified_base (473)..(473): a, c, t, g, unknown or other
  misc_feature (473)..(473): n is a, c, g, or t
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggcccaggacagagggtcaccgtctcctgctctggaagcgcctccaacattggcacgaattatgtactcctaggtaccagccaaccgttccccgggacacgcccccaaaactcctacatctatgaaagtacttttaccgcgaccctcgagggacttccgtggccgtattctctggctcaagtcaggcacctctgccacctggacacgtcgaccggctccaacggaccggggacgacggccgtattacttacgtgcgtacaacgttcgggacctaccaaccgtcgacgtggttgggtctttcgggnggacgggacttaacggttcgaccgttacctacgtcacgcccaacggtcctcgccccgttagtccacctcgtccgtcccaccctcctcccactactcgtcgacgtgcggcggctcgg

SEQ ID NO: 62917 - DNA, 583 bp, Homo sapiens
  misc_feature: GYAE6OF02FHT66.10.86.H09.1.454.CMB.1.raw
  modified_base (418)..(418): a, c, t, g, unknown or other
  misc_feature (418)..(418): n is a, c, g, or t
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtaccagcacttccccgggacacgccccaaactcctcatctatgaagtattttacgccgaccctcgaggtacttccgtggccgtattctctcggctccaagtcaggcacctctcgcccacccgtggaccactccgaccgggcctccgacggaccggggacgacggccgattacttacngcgactaacgttgggacctccgaacctgacgtggttcgggtcgtttcggcggtaggtactaagttcgaccgtcctacgtcgacgccgaagcctcgccccgtcgtccactccgtcgtccccgccctccctcctactacgtacgtcgtacgtgacggcggtcgtcgg

SEQ ID NO: 62918 - DNA, 789 bp, Homo sapiens
  misc_feature: GYAE6OF02I7MES.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgtggccccaggacagagggtccaccgtctcctgctctggaagcgcctccaacattggcacgaattatgtactcctggtaccagcaccgttccccgggacacgacccccaactcctcatcctatagaagtacttttaccgccgtaccctcgagggtacttccgtcggccgtatttcctcgtcggtcctaccaaggttccaacggtcctacccttccgtcgcccctacccgttcggaacctacgtacccgacccggggtcctacccggaacgggaccccgggggacggaccgggtacccgtaactttacgttaccgtcgcgtacctaaccggttcgggaccttacccgtaaccgttcgtacgttcgggtttcgggggtccgttttaccggggacgggtaacggggttaaccgttaacgggtttccggtaaccccggtttcccgtaccggtaccgaaccgggtaccccgtaacggggtccctacccggtacccccccgtttcgggtaccctaccgttcccgtttaccccggttcccccggtccccccttacccgttaccccgtaacctttacccgttaaccgttccgggtaccgttcgggtaccggtcccggggtccgtaccgggg

SEQ ID NO: 62919 - DNA, 748 bp, Homo sapiens
  misc_feature: GYAE6OF02JXME2.10.86.H09.1.454.CMB.1.raw
  modified_base (203)..(203): a, c, t, g, unknown or other
  misc_feature (203)..(203): n is a, c, g, or t
tcagcatagtagtgcacgaccggtgctcgatttagtgctatagacttgggtttggggtacgtcgggacaatcttcatcatgacctgctccctctcctcctctcccttctcattcactgcacagggtcctgggcccagtctttgttgacgcagccgcctcagtgtctgcggcccaggacaggagggtcaccgtctcctgctcgnggaagcgcctccactattggcacgaattatgtatcctaggtacagctaccgttcccggacacgccccaaactcctcactctatagaagtactttacgcgtaccctcgacggtacttccgtggcctacgttctctcggtcctccgaacgtccgacggtacctaccgtaccgtccgtacccgtacccgttacggacctaccgtccgaacccggtccgtacccgaaccggggaacccggggaaccggacgggtacccgtaagtttacgttaccgtacgaccgtaccgtaacggtttaccggaccttacccgtaaaccgtcgaaccgttcgggttacggggtccgtttaccggggaccgggtacgggtaaccgtttaacgggttacggtaaccggttacccggttacgtaccgtaccggtaacccggtaccgggtttccgccccggttacggtcctaccgttccgttaccgtttccccacccgttcccgttaccaaccgttaccgtacgttaccgtcgtaacggcccggtcggtaccggtaggtaccgg

SEQ ID NO: 62920 - DNA, 697 bp, Homo sapiens
  misc_feature: GYAE6OF02IAU9J.10.86.H09.1.454.CMB.1.raw
  modified_base (220)..(220): a, c, t, g, unknown or other
  misc_feature (220)..(220): n is a, c, g, or t
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacaggagggtcacgtctctgctctaggaagcgcctccaaactnttggacacgaatttatgtactccgtggtaccagtccaccgttccccgggacacgacccccaaactcctacatctatagaagtacgtttacgcgtaccctacgaggacttacgcggtccattctcgtgctacgtaagtcaggcacctctcgccacccgtgacatcgaccggctccgacggaccgggacgacggtacgtatttaactacgtcgacgtaccgtaacgttcgggtacctacccgtaaacgtcgtaacgttcgggttcggggtccgtttacgggacgggtaacgggtacttacggttacggtacccgttaccgaccgttcgaaccgtacccgtaacggccgttccggacccccgttaccgggttaccacccgtttccgtttacccggttaccccctacccgttacccttacccgtaacccgttacgttacgtccgtaccggttacggacgggtcccgggtacgttaccgggg

SEQ ID NO: 62921 - DNA, 793 bp, Homo sapiens
  misc_feature: GYAE6OF02G04NV.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccaccctcagtgtctgcggccccaggacagaggtcaccgtctcctgctcgtggaagccgcctaccaacattcggacacgaattatgtactcctggtaccagccacttccccgggacacgacccccaaactcctcactctatgaagtattttaccgcgtaccctcgaagggtacttccgtaggccgtacttctcgtggcctaccgaagtcaggcacctcgtcgacccaccgtggacactcgaccgggtctaccgaggacccggggacgacgggacccgtaattacgttaccgtacggccgtaccgtaacgttacgggaaccttacccgaaccgtacggtacgttcgggtttacggggtaccgttttaccggggaccgggtaaggggtaaccgtttaaacgggtttccgggtaaccccggttacccgttaaccggttacccgtaaccgggtacccccgaaagggtccccgttaccggtacccccccgttacggggttaccctacccggttaccgtttaccccggtttaaccccccgtaacccccgtttacccctaaccccgttaaacccgtttaacccgttaaccggttcccggtaaccgttacccggggtaaccggtacccgggggttacccgtaaccggggg

SEQ ID NO: 62922 - DNA, 787 bp, Homo sapiens
  misc_feature: GYAE6OF02FZEQ5.10.86.H09.1.454.CMB.1.raw
tcagcatagtagtgcacgaccggtgctcgatttagtgctatagacgttgggtttgggactcgggacaatcttcatcatgacctgctcccctctcctcctctcccttctcattcactgcacagggtcctgggcccagttctttgttgacgcagccgccctcagtgtctgcggccccaggacagagggtcaccgtctcctgctctggaagcgcctccaacgattggcaacgaattatgtatcctggtaccagcacgttccccgggacacgccccaaactcctcacttctactgaagtattttaccgcgaccctcgacgggactttccgtcggccgactttccgtctcggcctacccgaagttccgaagggtccaacccgttcgttcgcccctaaccccttgggaacctacgttccaacccggggtcctacccgtaacggaccccgggggtaacggacgggacccgtaagttttacctttaacgtcggaccgtacctaaaccgtttcggggaaacccttaccccgtaaacccgtcgtaacccgtttcggggtttacgggggtcccgtttttaccggggacgggtaaacggggtaacctttaaacgggtttcggaacccggtttaccgttaccggttactaccggtaccccgtaaagggcccttaccggtccccccgttacgggttacctaccgttcccggttccggtttcccccggtacccctttcccgtaccctaccgtttaaccgtacgttacggtcccgttaggaccggtcccgggtcgtacccggg

SEQ ID NO: 62923 - DNA, 768 bp, Homo sapiens
  misc_feature: GYAE6OF02IGSVQ.10.86.H09.1.454.CMB.1.raw
  modified_base (210)..(210): a, c, t, g, unknown or other
  misc_feature (210)..(210): n is a, c, g, or t
tcagcatagtagtgcacgaccggtgctcgatttagtgctatagacttgggtttggggactcgggacaatcttcatcatgacctgctccccctctcctcctctcccttctcattcactgcacagggtcctgggcccagttctttgttgacgcagcccgccctcagtgtctggggccccaggacagagggtcaccgtctcctgctctggaancgcctcaacattggcaacgattatgtactcctggtaccagcctaccgttccccgggacacgcccccaaactcctcatctatgaagtattttaccgccgtaccctcgaacgggactttccgtggacccgtatttcctcgtcgggtccttaccgaagttcacggcctaaccctcgtcgaccccacccttcgggaacctactccgacccgggcctcccgaacggacccgggggtacgacgggtcccgtaagtttacttaacgtcgaccgtaccgtaaacgttcggggtaacctacccgaacccgtcgtaacgttcgggtttacgggggtccgtttttccggggacgggtaacgggtaaccgttaaaggtttcccggtaacccggttcccgttaacggttccgaaccggtaccccggaaacgggttcccgttcccggtacccccggttccggttacccgtaacccgttccgttccccggtttaccccctaaccccgttccccttaccctacccgttaacctacgttcgacgttcggaccgggtcggtacggtcggtaaccgg

SEQ ID NO: 62924 - DNA, 738 bp, Homo sapiens
  misc_feature: GYAE6OF02JJZJS.10.86.H09.1.454.CMB.1.raw
  modified_base (159)..(159): a, c, t, g, unknown or other
  misc_feature (159)..(159): n is a, c, g, or t
  modified_base (215)..(215): a, c, t, g, unknown or other
  misc_feature (215)..(215): n is a, c, g, or t
  modified_base (442)..(442): a, c, t, g, unknown or other
  misc_feature (442)..(442): n is a, c, g, or t
  modified_base (513)..(513): a, c, t, g, unknown or other
  misc_feature (513)..(513): n is a, c, g, or t
tcagcatagtagtgcacgaccggtgctcgatttagtgctatagacttgggtttggggactcgggacaatcttcatcatgacctgctcccctctcctcctctcccttctcattcactgcacgagggtcctgggccagtctttgttgacgcagccgccctnagtgtctgccggacccaggaccaggacggtccaccgtctacgtgcgtctaggaacnccgtcctccaatagttcggactaacgtaattagtcgtactcccgtaggtaccagtcctaccgttccccgggactaaccgaccccctaaactccgtactacttcgtaacgtagtaacgttaacgttttacggaccgtaccccgtacgacgggttacttccgtacgggtccgtacttcgtccgtcggaccttaccgtaagtccgaacgcctacgtcgtcgacccgtacncggacctcgtaccggtaccggcctaccggaacggaccggggtaccgcggtaaccgttacttaacgtacgtnaccggtacgtaaccgttcggtaaccctacgtacccgtgtaccgttggttccggtcgttacggacgggtacggtacttaggtaccgtaccgttaccgtacgtacgaccgttccgaacgtccgtacccgtcccgtacgtactaccgttacccgtaccggttccccgtacccgttacctccgttaacgtcgtaccgtctaccggtcgacgggtacgccgttaaccggg

SEQ ID NO: 62925 - DNA, 875 bp, Homo sapiens
  misc_feature: GYAE6OF02JQUST.10.86.H09.1.454.CMB.1.raw
  modified_base (231)..(231): a, c, t, g, unknown or other
  misc_feature (231)..(231): n is a, c, g, or t
  modified_base (290)..(290): a, c, t, g, unknown or other
  misc_feature (290)..(290): n is a, c, g, or t
tcagcatagtagtgcacgaccggtgctcgatttagtgctatagacttgggtttgggggactcgggacaatcttcatcatgacctgctcccctctcctcctctcccttctcacttcactgcacagggtctgggcccagtctttgttgacgcagccgccctcagtgtctgcgcccaggacagagggtcaccgtctcctgctctggaagcgcctccacattcggcacgtaattntacgtatccttacggtaccagtctaccttcccgggacaccgccccaaactcctacactntatagtagtactttacgccgtacctcgtaggtacttcgacggtaccgtacttctcgtacgtctaccgacgttaccgacggtcctaccgtctaccgacccgtaccctacgggtaacctaccgtacccggaacccgggtaccgtacccggtaaccgggaacccgggggaaccggtaaccggggtacccggttaactttaccgttaaccgtaccggtaccgggtacccgttaaaccggggttaccgggtaacccgttaacccgtaaccgggttaaccggttaccggttaccggggtttaccgggggtttaccggtttacccgggggtaggggggtaacccgggttaaccgtttaaacgggttaccggtaacccggtttaccggtaacccgtaccgggaaaccgtaccccgggaaaccgttcccggtaacccggtccccccgttacggggtacccgttcccgtttaaccggtttccccgggttaacccccggttcccccctaacccgggtttaccccctaacctttacccggttacgttacccgggtaccttaccgggggtaaccgttccgggggtccgtaaccggggg

SEQ ID NO: 62926 - DNA, 602 bp, Homo sapiens
  misc_feature: GYAE6OF02GOF7Z.10.86.H09.1.454.CMB.1.raw
  modified_base (262)..(262): a, c, t, g, unknown or other
  misc_feature (262)..(262): n is a, c, g, or t
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtaccagcaccttccccggganacgccccaaactcctcatctatgaagattttacgcgaccctcaggacttcctgccgattctctggctccaagtcaggcacctctcgccacctggactatccgtaccggctccacggaccggggtacgacgggtaccgattaacgttactcgcgactaacgttcggacctaccaacctgacttaggttcgggtctttcggcggtagggtactaaagttcggaaccgtcctacgtccacgtacccgaagtcctcgcccccgtgtccacttcgtcggttccccgccccttcccgtccctaacgtaacttacgtcgtaccgttcggacgtaccgggcgtaccgg

SEQ ID NO: 62927 - DNA, 645 bp, Homo sapiens
  misc_feature: GYAE6OF02HQS6A.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagaggtcaccgtctcctgctctggaagccgcctcaacattggcacgaattatgtatcctggtaccagcacttcccggacacgccccaaactcctcatctatagaacgtattttacgccgaccctcgacggtacttccgtcggcctacttcctcgtcggccttccaagttcgaacggcctaccgtcgtcgccctacccgtggaacacgtccgacccggtctacccgacggaccgggacggacggaccgtatttacgttacgtcgaccgactaacgttcgggacctacccgaacgttacgtacgttggttaccgggtcgttacgggcggaagggtactaacggttcgaccgttcctacgcgtaccgccgtaacggcctcgcccctcggtcctccgttcgtcccgttcccacccgttcctacccgtacttaccgttacgtacgtcgtacgtacggtccggagtaccggg

SEQ ID NO: 62928 - DNA, 415 bp, Homo sapiens
  misc_feature: GYAE6OF02HJMVK.10.86.H09.1.454.CMB.1.raw
  modified_base (400)..(400): a, c, t, g, unknown or other
  misc_feature (400)..(400): n is a, c, g, or t
  modified_base (404)..(415): a, c, t, g, unknown or other
  misc_feature (404)..(415): n is a, c, g, or t
tcagcatagtagtgcacgaccggtgctcgatttagtgctatagacttgggtttggaagcgcctccaacattggcacgaattatgtatcctggtaccagcacttccccgggacagccccccaaactcctcatctatgaagattttacgcgaccctcagggattcctggccgattctctggctccaagtcaggcacctctgccaccctggacatcaccgggctccgagaccggggacgaggccgattattactgcgcaacttgggactccaacctgactgttgggctttcggcggagggctagtgccgtcctacgtcagcccaggcctcgccccctcggtccactctcgttccccaccctcctccactacctatgcctgacgcgggctcggacaaggcacgntagnnnnnnnnnnnn

SEQ ID NO: 62929 - DNA, 505 bp, Homo sapiens
  misc_feature: GYAE6OF02I9WH2.10.86.H09.1.454.CMB.1.raw
  modified_base (166)..(166): a, c, t, g, unknown or other
  misc_feature (166)..(166): n is a, c, g, or t
  modified_base (454)..(454): a, c, t, g, unknown or other
  misc_feature (454)..(454): n is a, c, g, or t
  modified_base (461)..(461): a, c, t, g, unknown or other
  misc_feature (461)..(461): n is a, c, g, or t
  modified_base (463)..(505): a, c, t, g, unknown or other
  misc_feature (463)..(505): n is a, c, g, or t
tcagcatagtagtgcacgaccggtgctcgatttagtgctatagacttgggtttggaagcgcctccaacattggcacgaattatgtatcctggtaccagcacttccccgggacagcccccaaactccctcatcctatgaagattttacgcgaccctcagggattccnggccattctcctggctccaagtcaggccacctctgccaccctggacatccaccgggctccaggaccggggacgaggacccgattacttactgccgcaacgttgggacctccaactgactgttgggtctttcggcggagggacttaaggttcgaccgtccttacgccgtacgccccaagggcctcggaccccctcgggtccaccctctccgttccccacccttcccgtaccctactactactcgcttgaccgcggggctggacgtaggtccacctagtacgctagctancagcctncnnnnnnnnnnnnnnnnnnnnnnnnnnnnnnnnnnnnnnnnnnn

SEQ ID NO: 62930 - DNA, 803 bp, Homo sapiens
  misc_feature: GYAE6OF02I01DL.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagccgcctaccaacattggccaacgtaattatcgtaactccgtaggtaccagcctaccgttcccccgggacaccgcccccaaactcctcactctaatgaagtacttttacgccgaccctcgacggtacttccgtggccgtattcctcgtggcctaccaaggtcacggcctacccgtcgtaccgcccgtaacctcgggaacctacgtaccggacccgggtactaccccgaaaccggggaacccgggggaaccgtaaccggggaccccggttaaatttacctttaaaccggtcggtacccgacccggtaaaccgtttcggggaacccttaaccccgaaaccgttcggaacgtttcgggttacggggttccgtttacggggacgggtaacgggtaccgtttaacggttacgtacccggttcctacggacctaccggaccccgaaaggtcccttacccggtccccccgttacggttacctacccggtttccgttacccgttccccccggtaccccgtttacccgttaacccctacccggtttaacccttacgttaccgttcccgttaacggggtaccgggtcccgggtttcccggaaccggg

SEQ ID NO: 62931 - DNA, 746 bp, Homo sapiens
  misc_feature: GYAE6OF02JEDR4.10.86.H09.1.454.CMB.1.raw
  modified_base (197)..(197): a, c, t, g, unknown or other
  misc_feature (197)..(197): n is a, c, g, or t
tcagcatagtagtgcacgaccggtgctcgatttagtgctatagacttgggtttgggggactcgggacaatcttcatcatgacctgctcccctctcctcctctcccttctcattcactgcacagggtcctgggcccagtctttgttgacgcagccgccctcagtgtctgcggccccaggacagaggtcacgtctcctnctctggagccgcctccaacagttggcaacgtaattatgtactccgtaggtaccaggcctacccgttccccgggaacaccgaccccccaaactccctactactcgtaagtagtaagttacttttaccgaccgtacccctcggaagggtccttccgtgggaccctatttcctccgtcggaccttccgaagtcgacggtccaaccttccgtccacccctccgtacggtaccactaccggaaccgggtcctaacccgacggggaacccggggacggtacgggaccgttaattaacgttaccgtcgtaccgtacgtaaccgttacgggacctacccgtaaccgtcgtacgttcgggttacgggttcgtttccggggaccgggaggtaaccggtttacggtacgtacccggttacctacggtaccgtaaccggacccgacggtcctcccggtcccccgtcgttacctacccgttcgtcccggtccccggtacccttccccgtaccgtaccttaccgtacgttcgacccgttgggaccggtccggtacggtaccgg

SEQ ID NO: 62932 - DNA, 805 bp, Homo sapiens
  misc_feature: GYAE6OF02HLJQN.10.86.H09.1.454.CMB.1.raw
tcagcatagtagtgcacgaccggtgctcgatttagtgctatagacttgggtttggggactcgggacaatcttcatcatgacctgcgtcccctctcctccgtctcccttctcattcactgcacagggtcctggcccagtctttgttgacgcagccgccctcgagtgtcctgcggccccaggacagagggtcaccgtctcctgctctggaagccgcctccaacattggcacgaattatgtatcgtggtaccagcacttcccgggatacgccccctaaacgtcctcgatcctagtgaacgtattttaaccgcggaaccccttcgagggtaaccttccgtaggcccgtaagtttcctacgtcggtcccctaccgaagtccgaaggtccctaccgttccgtcgacccacccgttggaaccctattccggaccgggtacctaccgtaacggggacccgggggacgtaacgggtcccgtaaagttttacgttaccgtcggccgtaaccgtacccgttcggggaacccttaccgaaacccgttcggtaaccgttggggtttaaccggggtccgttttaccggggaccgggtaacgggtaccgtttaaaggttccggtaacccggttcccgttaaccgtccgaacgtccccgaaacgggtccgtttacccggccccccttttacggggaccctacccgttccgtttccccgttaacccccgtaccccgtttaaccccggtacccttaaaccgttacccttacgttccggtaacccggttttacggaacccggggtccggggttacaacccgggg

SEQ ID NO: 62933 - DNA, 373 bp, Homo sapiens
  misc_feature: GYAE6OF02FWUUU.10.86.H09.1.454.CMB.1.raw
  modified_base (350)..(350): a, c, t, g, unknown or other
  misc_feature (350)..(350): n is a, c, g, or t
  modified_base (355)..(373): a, c, t, g, unknown or other
  misc_feature (355)..(373): n is a, c, g, or t
tcagcatagtagtgcacgaccggtgctcgatttagtgctatagacttgggtttgggggctgtccccaaactccctcatctatgaagattttacgcgaccctcagggattcctggccgattctctggctccaagtcaggcacctctgccaccctggacatcaccgggctccagaccggggacgaggccgattattacgtgcgcaacttgggacctccaacctcgactggttcgggctttcggcggagggactaagtgaccgtcctacgtcacgtccaaggctcgcccccgtcggtcactctcgttccccgcccctcctcccactacctatcgctgacgcggctggcaggcncatgnnnnnnnnnnnnnnnnnnn

SEQ ID NO: 62934 - DNA, 676 bp, Homo sapiens
  misc_feature: GYAE6OF02H2WXJ.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcaacgaattatgtatcctggtaccagcaccgttccccgggacacgacccccaaactcctcatctatgaagtacttttaccgcaccctcagggtactttcctcggccgtattctcgtcgctaccaagtcacggcacctctcgcccaccgtagacactccgaccggctaccgacggacccggggacgacggtaccgtatttacgttacgtcgaccgtacgtaacgttcgggtacctacccaaccgttcgacgttcgggttcggggttacgtttccggggacgggtaacgggtaacgtaacggttcgtacccgttacctaccgtacacggacccgtaaacggccgtaccgcccccgttcggtacctaccgttccgttaccgttccccctaccccttcccgtaccctaaccttaccttacgttcggtaccgtacggaccgggtccgggtacgtacggg

SEQ ID NO: 62935 - DNA, 776 bp, Homo sapiens
  misc_feature: GYAE6OF02JRPZD.10.86.H09.1.454.CMB.1.raw
  modified_base (429)..(429): a, c, t, g, unknown or other
  misc_feature (429)..(429): n is a, c, g, or t
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgtgacgcagccgcctcagtgtctgcgccccaggacagagggtcaccgtctcctgctctggaagccgcctaccaacagttcggcacgtaattagtgtactccgtaggtaaccagcctaccgttaccccgggacaaccgacccccaaacttccctacacttacctaatacggtaacgtaccttttacgacctaccctacggacggtaacttacccggtggtaccccgtattcgttccgtcggacctccgtaacgtccgaacggtcctaacctcgtcccgaccgtacccgnggtaacctccgtaccggacccggtactaccccgaacgggggacccgggacgaacccgggtaccgttaacgttacgttaaccgttaccggaccgttaacgtaaaccccgggttggtaaaccctacccggtaaaccgtccgttacggttacggtttcggggtaccggtttacggggaaccgggtaggtaaccgtttaacgtacggtaccgttacccgtacgtacgaccgtaaccggtaccgtcgtcccggtcccctgtaccctaccgttaccgtccggtacccccgtcccttaaccgtacccttaacgtaccttacgcggtaccgtaccgtcgggtccgtacgtaccgg

SEQ ID NO: 62936 - DNA, 697 bp, Homo sapiens
  misc_feature: GYAE6OF02IRC68.10.86.H09.1.454.CMB.1.raw
  modified_base (595)..(595): a, c, t, g, unknown or other
  misc_feature (595)..(595): n is a, c, g, or t
  modified_base (601)..(601): a, c, t, g, unknown or other
  misc_feature (601)..(601): n is a, c, g, or t
  modified_base (608)..(608): a, c, t, g, unknown or other
  misc_feature (608)..(608): n is a, c, g, or t
  modified_base (616)..(616): a, c, t, g, unknown or other
  misc_feature (616)..(616): n is a, c, g, or t
  modified_base (619)..(619): a, c, t, g, unknown or other
  misc_feature (619)..(619): n is a, c, g, or t
  modified_base (644)..(644): a, c, t, g, unknown or other
  misc_feature (644)..(644): n is a, c, g, or t
  modified_base (646)..(646): a, c, t, g, unknown or other
  misc_feature (646)..(646): n is a, c, g, or t
  modified_base (651)..(651): a, c, t, g, unknown or other
  misc_feature (651)..(651): n is a, c, g, or t
  modified_base (654)..(654): a, c, t, g, unknown or other
  misc_feature (654)..(654): n is a, c, g, or t
  modified_base (671)..(671): a, c, t, g, unknown or other
  misc_feature (671)..(671): n is a, c, g, or t
tcagcatagtagtgcacgaccggtgctcgatttagtgctatagacttgggtttggaagcgcctccaacattggcacgaattatgtatcctggtaccagcacttccccgggacagcccccaaactcctcatctatgaagattttacgcgaccctcagggattcctggccgattctctggctccaagtcaggcacctctcgccacccgtggacatcgaccgggctccgaggaccggggacgagggtccgatttacgttactggccgacaaacgtttcgggaacctaccctaaaccgtgtaaccgttcggtttcggggtccgttttccgggacgggtaacggggtacttaaacgggtttacggtacccggttacccgttaacggttcaaccggtccccgtaaaacgggccttcccggtcccccgttccgggtacctaacccgttccttccggtttaccccacccccttacccgttacccaccgtttaaccttacgtccggtccgtttacgggaacgggtcccggggttacgttacggggaaccctaacggggcccgtaaccggtaacgttaacggcgacgaccgtcgtacgacgacgngacacncgcgacncgacactntcngtcgacacacgcgacgacagcagantngacgnganacacgtcgcgcgcgtanacgacgcgcgtagacgtcgtacatac

SEQ ID NO: 62937 - DNA, 437 bp, Homo sapiens
  misc_feature: GYAE6OF02IWB67.10.86.H09.1.454.CMB.1.raw
  modified_base (414)..(420): a, c, t, g, unknown or other
  misc_feature (414)..(420): n is a, c, g, or t
  modified_base (422)..(437): a, c, t, g, unknown or other
  misc_feature (422)..(437): n is a, c, g, or t
tcagcatagtagtgcacgaccggtgctcgatttagtgctatagacttgggtttggaagcgcctccaacattggcacgaattatgtatcctggtaccagcacttccccgggacagccccccaaactcctcatctatgaagattttacgcgaccctcagggattcctggccgattctctggctccaagtcaggcacctctgccaccctggacatcgaccgggctccgagacccgggggacgaggccgtattattactgcgcaacgttgggactccaacctgactgttggggctttcggcggagggactaagttgaccgtcctacgtcacgcccaaggctcgcccctcggtcactctcgttcccgccctccgtccactactactcgctggacggcgggctggcaacgggcgcatagnnnnnnngnnnnnnnnnnnnnnnn

SEQ ID NO: 62938 - DNA, 589 bp, Homo sapiens
  misc_feature: GYAE6OF02GCB5W.10.86.H09.1.454.CMB.1.raw
  modified_base (541)..(541): a, c, t, g, unknown or other
  misc_feature (541)..(541): n is a, c, g, or t
  modified_base (574)..(574): a, c, t, g, unknown or other
  misc_feature (574)..(574): n is a, c, g, or t
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctcaacattggcacgaattatgtactccgtggtaccagcctaccgttccccgggacacgacccccaaactcctacactctatagaagtacttttaccgccgtacccgtcgagggtacttccgtggcccgtattcgtactggccttacgagtcgacggcacctctcgcctaccgtggactacgtaccacgggtctaccgacgggaccggggactacgggcctattacttacgtcgcgactaacgtggcctaccgacctgacgttggttcgggtcgttcggaggtacgatacgtcgtcgtacctacgcacgtacgagtcctcgcccgtcgtcnctcgtccgtcccacctcctcctctactctcgtntggcgtcggctacgg

SEQ ID NO: 62939 - DNA, 443 bp, Homo sapiens
  misc_feature: GYAE6OF02FNTXW.10.86.H09.1.454.CMB.1.raw
  modified_base (397)..(397): a, c, t, g, unknown or other
  misc_feature (397)..(397): n is a, c, g, or t
  modified_base (428)..(431): a, c, t, g, unknown or other
  misc_feature (428)..(431): n is a, c, g, or t
  modified_base (433)..(443): a, c, t, g, unknown or other
  misc_feature (433)..(443): n is a, c, g, or t
tcagcatagtagtgcacgaccggtgctcgatttagtgctatagacttgggtttggaagcgcctccaacattggcacgaattatgtatcctggtaccagcacttccccggggacagccccccaaactcctcatctatgaagattttacgcgaccctcagggattcctggccgattctctggctccaagtcaggccacctctgcccaccctggacactcgaccgggctccgaggacccgggacggaggccgtattattactgcgacaacgttggactccaacctgactggttggggtcttcgggcggacgggactaagttggacccggtcctacggtcagcccaacggctcgcccctcgggtcacctctcgttccccgcccctcccgtccacctactangctggtagcgggcgtggacgaggcgcatagnnnncnnnnnnnnnnn

SEQ ID NO: 62940 - DNA, 937 bp, Homo sapiens
  misc_feature: GYAE6OF02IQTBG.10.86.H09.1.454.CMB.1.raw
  modified_base (930)..(930): a, c, t, g, unknown or other
  misc_feature (930)..(930): n is a, c, g, or t
tcagcatagtagtgcacgaccggtgctcgatttagtgctatagacttgggtttggggactcgggacaatcttcatcatgacctgctcccctctccctcctctcccttctcattccactgcacgagggtcctgggccccagttcttttggttgacgcgagcccggccctacgaggttcgtctacggcccgtccccgaaggaccaggtaacgggtccaccgtccttccgtcgccttcggtacggaacgtcccgtccctaaccaaactaacgttgggacccaaacggttaaatttacgtcggttaacctccccggttacgggtaacccgtacggtacccctaccccggtttaacccccggggaaccgaacccccggtaaccccccctaaaaccttccccttaaccgtaacttaccgtaacgtaagtaaacgtttaccgttttaaccgtacccggtaacccctacggtaacggttacctttccccggtacgggtcccgttaactttcccgttcgttaccggtacccgtaccctaacggttaccgtacggaccctaccgttaccgaccgtaccctaacccggcggtaactaacccgtacccggggtaccggaccgtacccggaacccggggtaacccgggggtaaccggaccgggttaacccgttaactttaacggtttacccggacgtacccgtaacggttaacccggttacgggaacccttacccgaaaccgttcgtaccggtttcggttaccggggtccgttaccggggacggaaaccgggtacgttaaccggtccgtacgtaccgtaccgtacgacccgtaccggtaacgtcccgtcccggtacccgtcgtaccttccgttacttccccggtaacccttaccccgtaccgtacctaaccgttctacgtcgtaccggacgtcgggaccggtntaaccgg

SEQ ID NO: 62941 - DNA, 745 bp, Homo sapiens
  misc_feature: GYAE6OF02FT4OL.10.86.H09.1.454.CMB.1.raw
  modified_base (224)..(224): a, c, t, g, unknown or other
  misc_feature (224)..(224): n is a, c, g, or t
  modified_base (701)..(701): a, c, t, g, unknown or other
  misc_feature (701)..(701): n is a, c, g, or t
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgtgacgcagcccgccctcagtgtctgccggccccaggacaggacgggtcaccgtctcctgctctggaacgccgcctacaactnttcggcaacgtaattagtgtactccgtaggtaccagtcctaccgttaccccgggacaccgacccccaaactccctacgtactctacgtgtaacgttacttttaccggaccgtaccccgtcggtacggtaccttccggtcggtacctacgtttccgtcgtcggtacctaccgtacggtcgaccggcctacccgttccgtaccgacccgtacccgtacggtaacctccggtacccggacccgggtacccgtacccgggaaccgggggaacccggggtacggtaccgggtaccgttaagttttaccgtaccgtcggaccgtaaccgtaacgggttaccggtaccctaacccgtaccgtcgtacggttcgggttaccgggtcgttaccggggacgggtaccgttacggttacggtccggtaccgtacgtacgtcgacccgacgtacgtcctccgtccgtcgtcctcgtccgtcccgtcccnccttcccgtcctacgtctacgtcgtacgcggcgcggtcgtacgg

SEQ ID NO: 62942 - DNA, 844 bp, Homo sapiens
  misc_feature: GYAE6OF02G9LZU.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgccggcccaggacaggagggtcaccgtctcctgctcgtggaacgccgcctaccaacatttcgggaccaacggtaaatttagtcgttaacttccctagggtaacccagcctaacccgttcccccggggacaccgaccccccaaaacttccctacaacttcctataggtaaagtactttttaaccggcccgtaacccctcggacgggtactttcccgtagggcccgtaatttccgttacgttcgggtcccttacccgtaaacggttaccgtaacgggtcctaacccgtttcctccggaccccctaacccggtacggtaaccctacgttacccgacccggggtcctaaccccggacgggacccgggggacgacgggtaccgtaagtttacttacgtcggaccgactaaaccggttcgggacctacccgtaacctcggtaacgtttgggttcgggtcgtttacggggcggtaacgggttaacgtaacggttacgtacccgttacccgtacggtaccgaccggtacccgtaaacgggtcctacccggtccccgttacgggttacccaccgtttaccggtttccccggttcccccgccccgtttacccgtaccccgttaacctttacccgttaacgttccggtaccgtccgggtaacccgggtcggggtacccgttaaccgggg

SEQ ID NO: 62943 - DNA, 854 bp, Homo sapiens
  misc_feature: GYAE6OF02IGJB8.10.86.H09.1.454.CMB.1.raw
  modified_base (201)..(201): a, c, t, g, unknown or other
  misc_feature (201)..(201): n is a, c, g, or t
  modified_base (207)..(207): a, c, t, g, unknown or other
  misc_feature (207)..(207): n is a, c, g, or t
  modified_base (385)..(385): a, c, t, g, unknown or other
  misc_feature (385)..(385): n is a, c, g, or t
tcagcatagtagtgcacgaccggtgctcgatttagtgctatagacttgggtttgggactcgggacaatcttcatcatgacctgctcccctctcctcctctcccttctcattcactgcacagggtcctggcccagtctttgtgacgcagccgccctcagtgtctgccggccccaggacaggagggtcaccgtctcctgctcnggaacnccgcctaccaactattcggaccacgtaacttatgttactcctggtaccagcctaccgttccccgggacaccgacccccaaactcctcatcctatagaacgttatttaccgcctacccctgagggtactttccgaggccgtacttccgtcgtcggacctaccgaacgtccgaacggccncttaccaccggtcccaacccgtacggacctagttacccggacccgggtaccgttcccgaaccggggtaacccggggggaaccgtacgggtaaccccggttaaagttttaccgtttaacccgttacggggcccgttaaaccgtaaaccgggtttacccgggtaacccgtttaccccgaaacccggtttcggttaaacccgtttcggggtttaacggggttcccggttttacccgggggaaccgggttaaaccggggttaacgtttaaaccgggtttacgggtaaccccgttacccgggttacgttaacccgaccgggtaaccccgacgggttccccgtaccggttacccccgtaccgggttacctacccgttacccgtttcccgttaacccccgtacccccttcccgtaacccccttaaccttaccgtaccgtacgtccgtaccgggacggtcccgggtaccgtaccggg

SEQ ID NO: 62944 - DNA, 542 bp, Homo sapiens
  misc_feature: GYAE6OF02HDU7I.10.86.H09.1.454.CMB.1.raw
  modified_base (488)..(488): a, c, t, g, unknown or other
  misc_feature (488)..(488): n is a, c, g, or t
  modified_base (491)..(491): a, c, t, g, unknown or other
  misc_feature (491)..(491): n is a, c, g, or t
  modified_base (495)..(497): a, c, t, g, unknown or other
  misc_feature (495)..(497): n is a, c, g, or t
  modified_base (499)..(542): a, c, t, g, unknown or other
  misc_feature (499)..(542): n is a, c, g, or t
tcagcatagtagtgcacgaccggtgctcgatttagtgctatagacttgggtttggaagcgcctccaacattggcacgaattatgtatcctggtaccagcacttccccgggacagcccccaaactcctcatctatgaagattttacgcgaccctcagggattcctggccgattctctggctccaagtcaggcacctctgccaccctggacatccgaccggggcctaccgacggaccgggggacgacggccgatttattactgccgcaacgttgggacctccaacctgacttggttcggggtctttcgggcgggagggtactaggttcgaccgttccgtaacgtcgacgtaccccgaaggtccgtccgccccccgttccggtcctaccgttccgttccgttacccccgacccccttccgttacccaccgttaaccttagtccgtcgtggacggtccgggtcgtcgggtacgaaggccgacgacgtacggntcngcgnnngnnnnnnnnnnnnnnnnnnnnnnnnnnnnnnnnnnnnnnnnnnnn

SEQ ID NO: 62945 - DNA, 820 bp, Homo sapiens
  misc_feature: GYAE6OF02G09OX.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggcccaggacaggagggtcaccgtctcctgctcgtggaagccgcctcaacattgggcacgtaattatgtactccgtggtaccagccaccgttccccgggacacgcccccaaactcctacactcctatgaagtacttttaccgccgtacccgtcgaaggggtacctttccgtcgggtacccgtaactttccgtacgttcgggtcccttacccgaaaggttccgaacgggtacctaacccgttccgtaccggacccctaaccccgttacgggaacctaacgttaccggtaacccggggtccttaacccggtaacggggaaaccccggggggtacgaaccggggtacccggttaacgtttaaccgtttaacccggtcggaccggtaaccgtaaccggtttacggggaacccttacccgaaaccgttcggaaccgtttcggggttacggggttacccgttttacggggacggggtaacggggtaactttaaacggttccggtaacccgttaccgtacgtaccgacggtacccgtaaggtcccgtaccgtccccgtcgtacctaccgttccgttacccggtcccctaccccgttcctacccgtaccgttaaccgttacgtacggtccgtaacgggtacggtcccgggtactaccggg

SEQ ID NO: 62946 - DNA, 905 bp, Homo sapiens
  misc_feature: GYAE6OF02GYSML.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagttctttgttgacgcagccgccctcagtgtctggccggcccaggacaggacgggtcaccgtctcctgcctcgtaggaacgccgccctaccaactagttggacctaacgtaattacgtgttaacttccgtacgggtaacccaggtaccctacccggtttccccccggggaactaacccggaccccccctaaaacgttcccctacacttaccttaagtacggtaaagttaacttttacccggcccggtaacccccgttacggaacggggtacctttaccccggtcggggacccgttacgtttccgtccggttcgggtacccttccgaaaggttcccgaacgggtcccctacccgtacgtcccgaccccgtacccggttacggacctacgtaccccgggacccggtaccctacccggaaccgggggtaccgggggaccgtaacgggtacccgtttaagtttaacgttaccgtacggacccgtaaccgttaaccgggtttaccggacctttaaccccgaaccggttacgaaccgggtttcgggttacgggggtttacccgggtttacggggtaccggggtaaccgggttaaccggtttagggttacccggtaacccggttacccgttaaccggtacgtaacccggtacccgaacgggttcccgtaccccgttacccccggtcggttcctaccgttcccggttacccgtcccctacccggttccctaccgtaccttactaccgtcgttccgtacggacggtaccggtcgtacggg

SEQ ID NO: 62947 - DNA, 938 bp, Homo sapiens
  misc_feature: GYAE6OF02GM8ND.10.86.H09.1.454.CMB.1.raw
tcagcatagtagtgcacgaccggtgctcgatttagtgctatagacttgggtttggggactcgggacaatcttcatcatgacctgcctcccctctcctcctctcccttctcattcactgcacagggtcctgggcccagtctttgtgacgcagcccgcctcagtcgtctcggccggccccgaggacacggagtgtccgaccgttctccgtgctcgtaggaacgtccgccctaccgaactcgttacggaccaacgtaaatttacgttacgttaactccgttacgggtaccacggaccaccgttaccccggaccaccgaaccccctaactcctcgacttacctagtagaacgttacgtttaccgcccgtacccgtacggaacggggttcttaccggtacggtaccgtactttacctcgtacgtaccctaccgtaacgtaccgacggtacctaccctaccgtcccacccgtacccggtacggacctaccggtccggaccccggtacgtaccccgaaccggggtacccggggaacggtacccgggaccgttaacgttaaccgttaccggtaccggacgtaaaccgttaacccgggttaccgggtaaaccccttaacccctaccgggttaccgtaaccgggttcggggttttcccgggggttacggtttaacccggggggaccggggtaacggttaaacgggtttaccggttacccgggtaacccgggttcccttaaccgggttacccggtaacccgggtacccggtaaacccggtttcccccggtaaccccggttccccccggggtttaccgtacccgttaccccggtttacccgtttcccccccgggtttaccccttaacccccccggtacccgtttaaccccttaacccgttttacggtaaccgttcgggtcccgacggggtaccggtccgggtaacccggg

SEQ ID NO: 62948 - DNA, 204 bp, Homo sapiens
  misc_feature: GYAE6OF02FNR9Q.10.86.H09.1.454.CMB.1.raw
  modified_base (184)..(184): a, c, t, g, unknown or other
  misc_feature (184)..(184): n is a, c, g, or t
  modified_base (190)..(204): a, c, t, g, unknown or other
  misc_feature (190)..(204): n is a, c, g, or t
tcagcatagtagtgcacgaccggtgctcgatttagtgctatagacttgggtttgggactccaacctgactgttgggctttcggcggagggactaagttgaccgtcctacgtcagcccaaggctgccccctcggtcactctgttcccaccctctccactactatgctgagcgggctggcaaggcncatagnnnnnnnnnnnnnnn

SEQ ID NO: 62949 - DNA, 710 bp, Homo sapiens
  misc_feature: GYAE6OF02HKDD9.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcacgccgccctcagtgtctgccggccccaggacaggacgggtcaccgtctcctgctcgtaggacgccgccttaccaactagttcggacctaacggtaaatttactacgttactcctacgggtaccacgtctaccgttcccgggacaccgacccctaaactcctacactctatacgaagtactttacgccgtacccgtcgacggtacttaccgtcggaccgtacttcctacgtcggtactaccgacggtcacggtcctacctcgtccgtccctaccgtacgacctacgtccgaccggtcctaccgacgggaccggggtacgacgtccgtatttacgtacgtcgaccgtacgtaacgttcggaacctaccgtaacgtcgtacggttcggttcgggtaccgttacgggtcggaacggtacgtaaggttaccggtacccggttacctacggtaccgacgaccgtacgtccttccgacccgtcgtacctacgttaccgtccgttccccgtccttaccgtaccctaacgttacgtacttcggaccgttacggacggtccgtcgtacgg

SEQ ID NO: 62950 - DNA, 964 bp, Homo sapiens
  misc_feature: GYAE6OF02HV6T0.10.86.H09.1.454.CMB.1.raw
  modified_base (158)..(158): a, c, t, g, unknown or other
  misc_feature (158)..(158): n is a, c, g, or t
  modified_base (228)..(228): a, c, t, g, unknown or other
  misc_feature (228)..(228): n is a, c, g, or t
  modified_base (293)..(293): a, c, t, g, unknown or other
  misc_feature (293)..(293): n is a, c, g, or t
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgcctnagtgtctgccggcccaggacaggacggtcaccggttctccgtgctcgtggaacgccgtacctccaaagtnttcgggacctacgtaatttacgcgttactccgtaggtaccaggtaccgtaccgttcccgggtacnccggtaaccccccaaaacgtcctacgtaacttccgtaacgtacgaaagttacgttttaaccgaccgaaccccgttcgaacggggttacttcccggtcggtacccgtaatttccgtccgtaggtccttacccgtaaaggtcctaacgggaccctaccgttacgtaccgacccgtacccgtacggacctaacgttccggaaaccccgggtccgttacccggtaaacgggtaaaccccgggggtacggtaaccggggtacccgttaaacgtttaaccgttaaccgttaccggtacccggtaaaccgtttaaccgggtttaccgggtaaaccgttaaccccgtaaacccggttaccggtaaccggtttacgggtttaaccggggggttttaccggtttacccggggtaacggggtaaaccggggttaaaccgtttaaaccgggttaccgggttaaaccccggtttaccggtaacccggttaaccgtaacggtaccccgggttaaacggtaacccgttccccggttaacccccgtaccgggggttaccctacccggtttcccgttacccgggtttacccccgttaccccgtaccccgttacccgttaacccgttaacccgttacgttacggtacccggttacgggtaccgggacccgggtccggttaaacccgggg

SEQ ID NO: 62951 - DNA, 702 bp, Homo sapiens
  misc_feature: GYAE6OF02IUPK7.10.86.H09.1.454.CMB.1.raw
  modified_base (219)..(219): a, c, t, g, unknown or other
  misc_feature (219)..(219): n is a, c, g, or t
  modified_base (335)..(335): a, c, t, g, unknown or other
  misc_feature (335)..(335): n is a, c, g, or t
  modified_base (342)..(342): a, c, t, g, unknown or other
  misc_feature (342)..(342): n is a, c, g, or t
  modified_base (382)..(382): a, c, t, g, unknown or other
  misc_feature (382)..(382): n is a, c, g, or t
  modified_base (398)..(398): a, c, t, g, unknown or other
  misc_feature (398)..(398): n is a, c, g, or t
  modified_base (434)..(434): a, c, t, g, unknown or other
  misc_feature (434)..(434): n is a, c, g, or t
tcagcatagtagtgcacgaccggtgctcgatttagtgctatagacttgggtttggggactcgggacaatcttcatcatgacctgctcccctctcctcctctcccttctcattcactgcacaggtcctgggccagtctttgttgacgcagccgccctcagtgtctgcggcccaggacagagggtcaccgtcgtcctgctctggaagccgcctaccaaacnttggcacgtaattatgtactccgtggtaccagcctaccgttccccggaacacgacccccaaagtcctcagtcctatacgaagtacttttaccgcgtaccctcgaggtactttccgnggacctnttcgtctggacctacctaaagttccgaaggccctacctcncgtcccacccgtgacnttaccgaccggtcctacccgaagggacccggggacncggtaccgtacgtttactaccgtggaccgtacctaacggtttccggaacttcccgaaacgtcgtaccgtggttcggggtccttacggggaccggtacggtaacttaaggttccggaacccgttaccttaacgcgtaccggaaccgaagggtccctacccgccccgttggtacccctacgttcccgttcgtccccccggtaccccttcggtaaccccagtttaccgaacggttccgtaccggttggaccggtccgggcgttaacccggg

SEQ ID NO: 62952 - DNA, 712 bp, Homo sapiens
  misc_feature: GYAE6OF02F564O.10.86.H09.1.454.CMB.1.raw
  modified_base (432)..(432): a, c, t, g, unknown or other
  misc_feature (432)..(432): n is a, c, g, or t
tcagcatagtagtgcacgaccggtgctcgatttagtgctatagacttgggtttggggactcgggacaatcttcatcatgacctgctcccctctcctcctctcccttctcattcactgcacagggtcctggcccagtctttgtgacgcagccgcctcagtgtctgcggcccaggcagagggtcacgtctcctgctctggaagcgcctccaacattggcacgaattatgtatcctaggtaccagtccacgttccccgggacacgacccccaaactcctcatctatagaagtacttttaaccgcgtacccctcgaacgggtacttaccgcggccgtatttctctgggcctaccaagtcaaggccactactcgcccacctggacactcgaccggctaccgacggaccggggacgacggacccgtaattattaacgngtaccgactaacgttgggaacctccgaaccgtagtacgtcggttcgggtacgtttcgggacggtaacgggtaccgttaaggttcgtacccggttaccgtacggttaccaaccggtaccccgtaaacgggtcctacccggtacccccggttacggtaccgtaccgttacccgtttaccgtttaaccccccgaccccgtttaccccgtaacccgttaacccgtttaaccgttaccgttcggtacccgttacggtacgggtacccgggtaccgttacccgggg

SEQ ID NO: 62953 - DNA, 779 bp, Homo sapiens
  misc_feature: GYAE6OF02GH4G9.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgtgacgcagcccgccctcagtgtctgccggccccaggacagacgggtccaccgtctcctgctcgtggaagccgcctaccaacgtattgggaccaacgtaaattatgttactccgtggtaaccagcctaccgttacccccgggacaccgaccccctaaacctcctacactactatcgaagtacttttacgccgacccgtcgaagggtacttccgtcggaccgtatttcctcgtacggtcctaccgtaacgtccgacggcctaaccctcgtaccgacccacccgtacggacctactaccggacccgggtacctacccgaacggggtacccggggaacggaccgggtaccgtaagtttacgtacggtcgtccgtaaccgtaaaccggttccggaacccttacccaaccgttacggacgttcgggttacgggttaccgtttccggggaacgggtaacggtaccgttaacggttacggtacccgttacccgtacgtccgaaccggacccgtaacggtcccgtcccgtccccgttaccggaccctccgttccgtcccggtttaccccgaccccctttcccgaccccttaacccgttaccgtacgttccggtaccgtcgggacgggtacccggtcgtacccgggg

SEQ ID NO: 62954 - DNA, 700 bp, Homo sapiens
  misc_feature: GYAE6OF02J2GES.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctggcccagtctttgttgacgcagccgccctcagtgtctgcggccccaggacagagggtcaccgtctcctgctctggaacgcgcctccaacattggcacgtaattagtgtattcctggtaccagacctaccgttaccccgggacaccgacccccaaactccctacactctatacgaatacgtttacgcccgaccctcgaacggtactccgtcggccgtacttccgtccttggcctaccgtaaacgttccgacggtaccaccctctaccgtacccctaacccgtcggaacctactccgaaccgggtccaccgacggacccgggacggacgtcccgtattaacttcgacgccgaacgtacgtacggacctcctaaaccgtgaccgttggttcgggtaccgttcgggccggtaggtacgttacggtctaccgttactaccgtaccgacgtacccgaacgggtcctcccgtaccccgtaccgtaccacccgttaccttcccggtaaccccctaccccgttccgtaccgtaacccttcgtaacgtaccggccttaccgggacggtaccggtgtaccggg

SEQ ID NO: 62955 - DNA, 717 bp, Homo sapiens
  misc_feature: GYAE6OF02I8UUC.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgcctcagtgtctgccggccccaggacagagggtcaccgtctcctgctctggaacgcgcctacaacattggcacgtaattatgtatccgtaggtaccagccaccgttccccggacaccgacccctaaactcctcactctatagtaacgttacttttaccggccgtaccctaggacgggttacttcccggtcgggtccgtaacgtttccttcgtcggtaccctaccgaacgttccgacggacctacctccgtaccgccctacccgtggaacctacgtccggacccgggcctaccgaacggggtacccggggaacgtaccgggaccgttaagtttaccgttaccgtcgtaccggtactaaccggttcgggtaaccctaccgtaaccgtgttaccgttcgggttacgggttccgttcgggacgggtacggtactacggttcgaccgttaccgtaacgtcgacgtaccgtacgtccgtccgtccccgtgacctaccgttcttcccgttccctaccccttccgtaccctacttacgtacgtccgtccgtacggaccggtcggtcgtacgg

SEQ ID NO: 62956 - DNA, 732 bp, Homo sapiens
  misc_feature: GYAE6OF02FQS8U.10.86.H09.1.454.CMB.1.raw
  modified_base (247)..(247): a, c, t, g, unknown or other
  misc_feature (247)..(247): n is a, c, g, or t
tcagcatagtagtgcacgaccggtgctcgatttagtgctatagacttgggtttggggactcgggacaatcttcatcatgacctgctcccctctcctcctctcccttctcattcactgcacagggtcctgggcccagttctttgttgacgcagccgccctcagtgtctgcggccccaggacagagggtcaccgtctcctgctctggaagcgcctcaacattggccacgaattatgtatcctggtaccngctaccttccccgggacacgccccaaactcctcatctatgaagtcttttacgccgaccctcgagggtcttccgtggccgtattcctctcggtcctaccgaagtcaggccaccctcgtcgccctacccgtggacactccgaccggctaccgacggaccggggacgacgggccgtattacgttacgtcgcgtctaaccggttacgggacctacccgaaaccttcggaccgtttcgggttcgggggttcccgtttcgggaccggggtaaacgggtaaccgtttaaacgggttacccggtaccccgttacccgttaccgggttaccaaccgggtacccccgtaaagggcccgttcccggtaccccccgttcccgggtccctacccgttccgttcccgggtttaccccccgcccctttaccccgttaccccgtaactttaacccgtacggtttcgacccgttaggacccgggtccgggtccgtaccgggg

SEQ ID NO: 62957 - DNA, 732 bp, Homo sapiens
  misc_feature: GYAE6OF02I6WU4.10.86.H09.1.454.CMB.1.raw
  modified_base (122)..(122): a, c, t, g, unknown or other
  misc_feature (122)..(122): n is a, c, g, or t
  modified_base (136)..(136): a, c, t, g, unknown or other
  misc_feature (136)..(136): n is a, c, g, or t
  modified_base (162)..(162): a, c, t, g, unknown or other
  misc_feature (162)..(162): n is a, c, g, or t
  modified_base (582)..(582): a, c, t, g, unknown or other
  misc_feature (582)..(582): n is a, c, g, or t
  modified_base (696)..(696): a, c, t, g, unknown or other
  misc_feature (696)..(696): n is a, c, g, or t
tcagcatagtagtgcacgaccggtgctcgatttagtgctatagacttgggtttcggggactcgggacaatcttcatcatgacctgcctccctctcctcctctcccttctcattcactgcacngggtcctgggcccngtctttgtgaccgcacgcccgccctnagtctctggccggccccaggaccaggacggtccaccgtctcctgcctcgtacggaacgccgccctacaacgtattccggacctaacgtaatttagcgttactccgttacggacccacggtcctacccgttaccccgggaaccacccgaccccctaaactcccactactcctagtacgtaaacggtactttaacccgcccgtaaccccgtcggtaacgggttaacttccccgtggtacccgttaattccgttcctcgggtaccctaccgtaaacgttccgaaccggcctaacctcctaccgcccctacccggtagaccctcgtacccgaccggtccctaaccgggaccggacccgggtacggacggtaccttaacttacgttaccgtcgactaccgtacgtcggtacctacaccgacgtcncgggttacggcgttcggacggtagtacgtacgtccgtaccgtacctacgtaccgaccacggacctcccgtacgccccgtctcctactccgtacgtccccctccgtacccttacncctaagtacgtcgccgtacggacgtcggtacgacgg

SEQ ID NO: 62958 - DNA, 864 bp, Homo sapiens
  misc_feature: GYAE6OF02JUFSC.10.86.H09.1.454.CMB.1.raw
  modified_base (219)..(219): a, c, t, g, unknown or other
  misc_feature (219)..(219): n is a, c, g, or t
  modified_base (318)..(318): a, c, t, g, unknown or other
  misc_feature (318)..(318): n is a, c, g, or t
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgcctcagtgtctgcggcccaggacagagggtcaccgtctcctgctcgtggaacgccgcctaccaanattcggccaacgtaattactgtactcctggtaccagtccaccgttccccggacaccgacccccaaactcctacactctatagtaacgtacgttttaccncgtaccctcgaacgggtacttcccgaggaccgtacttcgtcgttcgggacccttaccgaaacggttccgaacggggtaccctaacccgttccgttaccggaccccttaaccccgttacggggaaaccttacccggttacccggaaccccggggtacccgttaaccccggaaaccggggtaaccccggggggaacggtaaccggggttaacccgtaacttttacgttaacccgtttacggaaccggtaaccgtaaaccgtttccggggaacccttaccccgttaaaccggtcgttaaccgttgggtttacggggtacccgttttaccggggaacgggtaacggggttaaccttaacgggttaccgtaaccggttacccgtacggttacccgaaccggtacccgggttaacgggtcccgtacccggttcccccggtacgttcccgtacccgttaccggttcccgtacccccggttccctacccgttcccttaaccgttaccgtacgttaccggtacccgttacggaccggttccggcggttaaccggg

SEQ ID NO: 62959 - DNA, 658 bp, Homo sapiens
  misc_feature: GYAE6OF02GSDM8.10.86.H09.1.454.CMB.1.raw
  modified_base (221)..(221): a, c, t, g, unknown or other
  misc_feature (221)..(221): n is a, c, g, or t
  modified_base (613)..(613): a, c, t, g, unknown or other
  misc_feature (613)..(613): n is a, c, g, or t
tcagcatagtagtgcacgaccggtgctcgatttagtgctatagacttgggtttggggactcgggacaatcttcatcatgacctgctcccctctcctcctctcccttctcattcactgcacagggtcctgggccctaggtctttgttgacgcagcccgccctcagtgtctgccggcccaggacagagggtcaccgtctcctgctcgtggagccgcctccaanattggcacgtaattatgtactcctaggtaccagcctaccgttccccgggacacgcccccaaactcctcatcctatacgtaaagtacttttacggacccgtaccctcgtacggtacttcccgtggccgtattcctcgtcgggcctaccgtaacgtccgacggtccacccttcgtcgaccccgaccgtacggactactccgacccgggctaccgaacggaacccggggtacgacgggaccggtattaacgtactggcgtacgtaacgttcgggacctacccgtaactcgtacgttaggttcggggtcgtttacgggcgggtaaggtacttaaggtccgtccgtacctacgtcaccgtacgaacgctccgcccgtcgctacgtcgtcgttccccncctcctcctacttacgtctcgtactcggacggtccggtcgtacgg

SEQ ID NO: 62960 - DNA, 686 bp, Homo sapiens
  misc_feature: GYAE6OF02IJ9QM.10.86.H09.1.454.CMB.1.raw
tcagcatagtagtgcacgaccggtgctcgatttagtgctatagacttgggtttggggactcgtgacaatcttcatcatgacctgctcccctctcctcctctcccttctcattcactgcacagggtcctgggcccagtctttgttgacgcagccgccctcagtgtctgcggccccaggcagagggtcaccgtctcctgctctggaacgcgcctaccaacattggcacgaattatgtactcctggtaccagctacgttccccgggacacgaccccaaactcctcactctatgaagtacttttacgcgtaccctcgacggtacttccgtcggccgtattctcgtgcctccgaacgtcgacggtcacccgttctccgaccctacccgtacggacctacgtaccgacccgggtcctaccgtaacgggacccggggaccgacgggccgtaatttaacgttaccgtcgacgaccgtaacggttcgggaacctaccctaaacgtgaccgttcgggttcgggtccgtttacgggcgggtacgggtacttaaggttccgacccgtaccgtacggtacgacgtacccgaagggtcctcccggtccccgttacggtacctacccgttcgttccccgttccccaccccttaccctaccctaccgttactacggtccgtctcggacggtcccggtaccgg

SEQ ID NO: 62961 - DNA, 657 bp, Homo sapiens
  misc_feature: GYAE6OF02IZ5YM.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctaccaacattggcacgaattatgtatcctggtaccagccaccgttccccgggacacgacccccaaactcctcattcctatgaagtactttacgccaccctcgaggtacttccgtggccgtattcctctcggcctccaagtcacggccaccgtctcgcccaccctggacctacgtccgaccggtctccgaacggacccggggacgacggaccgtaattacgttaccgtgccgtacgtaacgtcgggtacctaccgaaccgtgaccgttggttcgggtctttcgggcggtaggtactaaggttcgtaccgttaccgtacgtacgacgacccgagtccgtccgaccccgttcgtccgtaccgttccgttacccgttcccccaccccttacccgttaccctaaccttaccgtacttcccggtacgtacggacggccgggtccgtaccggg

SEQ ID NO: 62962 - DNA, 809 bp, Homo sapiens
  misc_feature: GYAE6OF02FPUKH.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgccggccccaggacagaggtcaccgtctcctgcctctggaacgcgcctccaaactagttggctacgaattatagttactccgttcggtaaccacgtccgtacccggtttacccccgggacaaccggacccccctaaaaaccgttccctacctaagtccttaagtacgtaaacgttacgttttaccgccgtacccctacggacggtacttccgtcggtaccgtacttcgtcgtcgtcctaccgaacgtcgaggcctaccgtccgtcgaccctaccgtacggaacctacgtacccggaccggacccgtacccggacgggaacccggggggacgaccggtaccgtaatttaccgttacgtcggtaccgtaccgtaacgttccgggtaaccttaccccgtaacgttaccggtacggttcgggttccgggttccggtttcggggaccgggtaaggggtaaccgtttaacggttacggtaccggttaccgtaccggtaccgtaccggacccgtaaccgggtccgtcccgtacccccggttcgttacccgccgttccgtttcccggtccccgtccccttaccccgtaccccttaaccgttaccgttacgtcgtacccggttacggaccggggtaccggtcggtaaccggg

SEQ ID NO: 62963 - DNA, 872 bp, Homo sapiens
  misc_feature: GYAE6OF02ISOJX.10.86.H09.1.454.CMB.1.raw
  modified_base (162)..(162): a, c, t, g, unknown or other
  misc_feature (162)..(162): n is a, c, g, or t
  modified_base (168)..(168): a, c, t, g, unknown or other
  misc_feature (168)..(168): n is a, c, g, or t
  modified_base (175)..(175): a, c, t, g, unknown or other
  misc_feature (175)..(175): n is a, c, g, or t
tcagcatagtagtgcacgaccggtgctcgatttagtgctatagacttgggtttggggactcgggacaatcttcatcatgacctgctcccctctcctcctctcccttctcattcactgcacgtagggtcctcgggcccagttctttgttagaccgcacgcccnccctangtcgtcncggccgcccgaggacgaggtacgggtccaccgtctcctcgtccttacggaggaacggccgtaccctaccgaaatgttcggacgaacttaattagtacgttccgtccgtacggtaccaccggaccgtaccggttaccccggaacaacccgaaccccctaattcccgtacgtacttacgttaagtaacggttaaacgttacgtttacccggaccctacccgttacggacggttaccttccggtaccggaacttcttccgtcgtaccgtacttaaccggacgttacggcgtaccttacgccgtcgtaaccccgaccggtagaacttaccggcccggtaccggtacccaaacggggaccggggaacccggggacggtaacggtttacccggtaatttaccgtaccgtacggtaccgtaaccgtaacgggttcccggtaacctacccgtacgtacggttaccggttcgggttccgggtttacgggttaccgggagggtacggttaaaccggtacggttacccgtaccgggttactaacccggtaccaccgggtaacccgaaccggtccccgttaccccgggtaacccttacggtacccttacttcccccggttaccccgttcccccgtaccccgtaaccgttaaccttaccgtacccggttacgaccggttacggttaccgggccggttacgacggacccgg

SEQ ID NO: 62964 - DNA, 917 bp, Homo sapiens
  misc_feature: GYAE6OF02JPNEA.10.86.H09.1.454.CMB.1.raw
  modified_base (142)..(142): a, c, t, g, unknown or other
  misc_feature (142)..(142): n is a, c, g, or t
tcagcatagtagtgcacgaccggtgctcgatttagtgctatagacttgggtttggggtactcgggacaatcttcatcatgacctgctccctctcctcctctcccttctcattcactgcacaggtcctggcccagtctttgtnacgcagccgccctcacgtgtctcggccggcccccaggaccaggacgggtccaccggttctcccgtcgtacctccgtggggaaacgcccggtccccttacccgaaaacctagttttcggggccctaaaaccgggttaaattttaacggttcggtaaacttttccccgtacggggttaaaccccaggtacccttaacccgtttacccccggggaaaccgtaacccgggaccccccctaaaaacccgttcccgttaccctaaccgtaccgttacgttaacggtaaaaccggttaacgtttttaaacccgggacccggtaaaccccgttcgtaaaccggggttaactttccccggtacggtacccggttactttacccgttccgttcgggtaccctttaaccgacggttaaccgtaccgggtaccctaaccccgtttccgtaccgaccccggtaacccttacgggaaccttacgtacccggacccggggtacccttacccggaacggggtacccggggaaccgggtaccggtaccgttacgttaaccgtttaacgtccggacgtaccgtaacggtcgggtaacctacccgtaaccgttcgtacgttcgggttacggtaccgtttacgggaccgggtacggtaccgttaacgtcggaccgttcgtaccgtcgaacgtcccgaagtccgtacctccccgtagtaccgtacgttccgtcgtacccccggtcctaacccgtccttacaaccgttcgtacgtcgtacggcggttccggctacgg

SEQ ID NO: 62965 - DNA, 786 bp, Homo sapiens
  misc_feature: GYAE6OF02HXOM8.10.86.H09.1.454.CMB.1.raw
  modified_base (110)..(110): a, c, t, g, unknown or other
  misc_feature (110)..(110): n is a, c, g, or t
  modified_base (636)..(636): a, c, t, g, unknown or other
  misc_feature (636)..(636): n is a, c, g, or t
  modified_base (660)..(660): a, c, t, g, unknown or other
  misc_feature (660)..(660): n is a, c, g, or t
  modified_base (686)..(686): a, c, t, g, unknown or other
  misc_feature (686)..(686): n is a, c, g, or t
  modified_base (758)..(758): a, c, t, g, unknown or other
  misc_feature (758)..(758): n is a, c, g, or t
tcagcatagtagtgcacgaccggtgctcgatttagtgctatagacgttgggtttggggactcgggacaatcttcatcatgacctgctccccctctcctcctctcccgttntcgattcactgcacagggtcctgggacccagtctttgttacgcgcagccgcctcgagtgtctggccgcccaggacaggaggtccaccgtctcctgactcgtagggaacgccgtcccttacccgaagtagttcggaccaacggttaatttacgtacgtaacgtttccctaaggggttaacccacgtacccgtaacccggttcccccgggaacctaccggaacccccctaaaacgttcccctaactaccgttaccgtacggtagtaacgtaactttttaccggacccgtaccccttacggacgggtacttccgccggaccgtaatccgtactcggacctacgtaagtccgaacgcctacgtaccgtcggtcccaccggtactacgtacgtccggtacccggtacgaccgtaccggggaccgggtaacgggacgttacccgtaatttaccggttacgtcggacccgtccgttaaggttcgggactacccgtaactcgtacgtttgggttccggggttacttacccgggngggtaaccgtgttaaacccggttntaccccgggtaacttcggtaacccgngtacccgtaaggtccacccggtacccgtacgtacctaccgtcgttacccgtcccgactacccggtctacccngtcctcgcttggaccgtcggtcgtacgg

SEQ ID NO: 62966 - DNA, 943 bp, Homo sapiens
  misc_feature: GYAE6OF02HMKFF.10.86.H09.1.454.CMB.1.raw
tcagcatagtagtgcacgaccggtgctcgatttagtgctatagacttgggtttgggactcgggacaatcttcatcatgacctgctcccctctcctcctctcccttctcattcactgcacgagggtcctgggccctagtcttttggttcgacgcagcccgccctcgagtcgtcgtcgccggccccaggacaggtagggtccaccgtctccgtgcgttacgtagggaacgccgccctaccgaaactagtttcggaccaacgtaaatttacgtacggttaacttcccgttacgggtaaccacggtacccgttaacccggtttaccccgggaaccaccggtaacccccccaaaaaccgttccctaacacttaccgttaagttacggaaacgttaacgtttttaacccggacccgtaaccccgttacggtaacgggttacgtttaccccggtacgggtacccgttacgtttccgttaccggttaccgggttacccgttaaccgttaaaccgggttccgtaacggggacccttaacccggttccgtaccgtcccccgaacccgttcgggaacctacgtacccggacccgggtacccgttaacccgacggggaacccgggggtaaaccggtacgggtacccggttaaacttttaacgttaccggtacggacccggtaccggtaaacggtttacgggtaacccttaacccgtaaccgttacggacggtttacggggtttacgggttccgtttacggggaaccgggtaacgggttaccgttaacgggttaccgaacccggttccgtaacggtaccacggtaacccgtaagtcccggtaccccggaccccgttcggtccctacgtttcccgttaccgttcccaccccgttaccttacccgtaacgtaccgttcctccggtacggttacccggtacggaccggtcgtacccggg

SEQ ID NO: 62967 - DNA, 661 bp, Homo sapiens
  misc_feature: GYAE6OF02JAQGW.10.86.H09.1.454.CMB.1.raw
  modified_base (511)..(511): a, c, t, g, unknown or other
  misc_feature (511)..(511): n is a, c, g, or t
  modified_base (521)..(521): a, c, t, g, unknown or other
  misc_feature (521)..(521): n is a, c, g, or t
  modified_base (527)..(527): a, c, t, g, unknown or other
  misc_feature (527)..(527): n is a, c, g, or t
  modified_base (533)..(533): a, c, t, g, unknown or other
  misc_feature (533)..(533): n is a, c, g, or t
  modified_base (536)..(536): a, c, t, g, unknown or other
  misc_feature (536)..(536): n is a, c, g, or t
  modified_base (552)..(552): a, c, t, g, unknown or other
  misc_feature (552)..(552): n is a, c, g, or t
  modified_base (560)..(560): a, c, t, g, unknown or other
  misc_feature (560)..(560): n is a, c, g, or t
  modified_base (575)..(575): a, c, t, g, unknown or other
  misc_feature (575)..(575): n is a, c, g, or t
tcagcatagtagtgcacgaccggtgctcgatttagtgctatagacttgggtttggaagcgcctccaacattggcacgaattatgtatcctggtaccagcacttcccgggacagcccccaaactcctcatctatgaagattttacgcgaccctcagggattcctggccgattctctggctccaagtcaggcaccgtctgccacctggacatcaccgggctccacggaccggggacgacggccgtattattactcgtccgctaacgttgggacctaccgaacctcgtacgtaggttcgggggccttttcgggcggtagggaaccttaaggtttcggaccgttcccgttacgttaccgacgtccccgtaaaggccgtcgtaccccccgtggtcctaaccgttccgttcgttccccgtccccttacccgtacccgtaacctaacgtacgtacgaccgtacggacggtaccgggtccgtcggacgttaaacggaccgtacgtaactaggctacgangactacacgngactcngacagnagngacgtagacgtagtanatacacgngtctacgtacgtacncgactacctagtagtacgtacgtagacctacgtacctaccgtacgaacgaactaaggtatacgtaataacgagttacgtaccgtac

SEQ ID NO: 62968 - DNA, 831 bp, Homo sapiens
  misc_feature: GYAE6OF02HKCZ8.10.86.H09.1.454.CMB.1.raw
  modified_base (491)..(491): a, c, t, g, unknown or other
  misc_feature (491)..(491): n is a, c, g, or t
tcagcatagtagtgcacgaccggtgctcgatttagtgctatagacttgggtttggggactcgggacaatcttcatcatgacctgctcccctctcctcctctcccttctcattcactgcacagggtcctgggcccagttctttgttgacgcacgcccgccctcagtgtctgccggccccaggacaggagggtccaccgtctcctgcctcgtggaacgccgtcctaccaacgagttcggactaacgtaaatttagtacgtactccgttaggtaccacgtacctacccgttccccgggaaccaccgtaaccccccaaaccttcccgtactacgttactaacgtaggtaaacgttacttttaaccggccccgtacccttacggaacgggtacttttacccggacgggtacccttactttcccttcggtcggtacctaaccgaacggttccgacggtccctacctccgtccgtacccaaccggttcgaccgttacncccggacccggtctacccggtaaccggggaacccgggacggaccggttacccgttaagtttaacgttacgtccgaccgtaccgttaacggttaccggtaaccctacccgtaacgtcggttacggttcggggttacgggttccggttccgggaacgggtaacggtaacgttacgggttaccgtaccccggttaccgttaccggtccaaccggtcccgtaacggtcccgtacccgtccccggtacgttcctacccgtttccggttcccgttccccgtccccttacccgtaacccgtaccgtacttccggtaccgtcgtaccggacggtccggtgtaaccggg

SEQ ID NO: 62969 - DNA, 970 bp, Homo sapiens
  misc_feature: GYAE6OF02GZGKJ.10.86.H09.1.454.CMB.1.raw
  modified_base (908)..(908): a, c, t, g, unknown or other
  misc_feature (908)..(908): n is a, c, g, or t
  modified_base (962)..(962): a, c, t, g, unknown or other
  misc_feature (962)..(962): n is a, c, g, or t
tcagcatagtagtgcacgaccggtgctcgatttagtgctatagacttgggtttggggactcgggacaatcttcatcatgacctgctcccctctcctcctctccctctcattcactgcacgagggtcctgggcccagttctttggttgaccgcacgcccgccctcgagtcgtctcgccggccccgaggacaggtacgggtccaccgtctcctgctgtacggaacgcgccctaccaactagttcggacacgtaattactagtactccgttacggtaccacgccgtaacccggttaccccgggaacctaacccaaccccccgtaaaacttcccttactaacgttccgtaatacggaaacgtttacttttaacccggcccgtaacccgttacggtaacgggtaccttttcccggtaccgggtacccgtaacgttttccgttcccggtttaccgggtaccccgttaccgtaaaacgggtcccgtaaaccgggtcccttaaaccccttcccggttaacccgaacccccgttaccccggttaaccggggtaaccgttaaccccgtttaaccccggggacccccggggtaaccccgttaaccccggggtaaacccgggggaaaccccgggggggaacggttacccggggaaccgtttaaacgttttaacgttacccggtaccggtacccgaaaccccgtttaaaaccggggttcccgggttaaaccccttaaccccggttaaacccggttaccgggttaaccggttaccgggtttcccgggggtttaccgttaaccggggtaccggggtaaacgggttaccgtaacgggtacgttacccggtacgtacgtaccgaccgtaccgacggtcccgtacccggtaccccgtgtacccgtcctaccggttccccgtccccnccccgttccctcccgaaccgttccgtactccggtacgaccgggtacggcccggngtacccgg

SEQ ID NO: 62970 - DNA, 878 bp, Homo sapiens
  misc_feature: GYAE6OF02G42VN.10.86.H09.1.454.CMB.1.raw
  modified_base (183)..(183): a, c, t, g, unknown or other
  misc_feature (183)..(183): n is a, c, g, or t
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgccggcccaggacaggnggtccaccgtctccgtgctcgtggaacgccgccctacaaactagttggaccaacgtaaatttatcgtactccgtagggtaaccaggaccgtacccgttacccccgggacaaccgaccccccaaaacttccctcaacttcctaacttacggaaagtaccgttttacccggcccgttaaccccttacggtaacgggtaaccgttttcccgagggtacccgttactttcgttccgtcggtaccctacgtaaacgttccggaacggtccctacccgttcgtccgacccgtaccccggttaggaaccgttacgtacccgggaccgggtcctaacccgacgggggtaacccgggggtaccgacgggtaccgttaactttacgttaccgtacggccgtaacgtaaccgttacgggaaccctacccgtaaccgtgtacccgtttacggggttacgggttccggtttccgggacgggtaaacgggtaccgttaacgggtttaccggtacccggttacccttaacccgggcgtacccgtaccccgggaacggggtcccctcccgggtcccccgttacggtacccgttaacctttccgggttacccccggtttaacccctacccctttaccccggtaaccctaaccctttaacggttacgttcccgggacccttaggggtacccggtcccggggttacacccgggg

SEQ ID NO: 62971 - DNA, 819 bp, Homo sapiens
  misc_feature: GYAE6OF02GIY6O.10.86.H09.1.454.CMB.1.raw
  modified_base (185)..(185): a, c, t, g, unknown or other
  misc_feature (185)..(185): n is a, c, g, or t
tcagcatagtagtgcacgaccggtgctcgatttagtgctatagacttggggtttggggactcgggacaatcttcatcatgacctgctcccctctcctcctctcccttctcattcactgcacgagggtcctgggcccagtctttgtgacgcagccgcctcagtgtctggccggccccaggacaggngggtcaccgtctccgtgctcgtggaacgccgcctaccaaactagttcggacctaacggtaatttatgtacttccgtacggtaccagcctacccggttcccccgggacaacccgaccccctaaaacctcctactacttctacgtagaaacgttcttttaaccgcccgtacccctcggaacgggttaccttcccgtcggtcccggtaactttcccgtcgtcggtacccttacccgtaacggtccgaacggtacccttaacccgttccgttaccggaccccctacccgggtacggtaacctacccgttaccgggaaccccgggtccgttacccggaaccgggggtaacccggggggaaccggaccgggtacccttaacgttttaacgttacccggtcggcccgtaaccgtaacggttcgggacccttacccgaacgtcggtaccgttggggttcgggtacggttcgggacgggtacgggtacgttaacggtccgtacccgtaccgtacggtcaccggccgacgtccgtcccggcccgttacgtcccgtaccttccggtttccccgtcccgtaccccgttcctaacccgtaccttaacgtcgtcgtaccggacggtaccggtccgggtcgtaaccggg

SEQ ID NO: 62972 - DNA, 879 bp, Homo sapiens
  misc_feature: GYAE6OF02I8J4C.10.86.H09.1.454.CMB.1.raw
  modified_base (148)..(148): a, c, t, g, unknown or other
  misc_feature (148)..(148): n is a, c, g, or t
  modified_base (152)..(152): a, c, t, g, unknown or other
  misc_feature (152)..(152): n is a, c, g, or t
  modified_base (157)..(157): a, c, t, g, unknown or other
  misc_feature (157)..(157): n is a, c, g, or t
  modified_base (161)..(161): a, c, t, g, unknown or other
  misc_feature (161)..(161): n is a, c, g, or t
  modified_base (165)..(165): a, c, t, g, unknown or other
  misc_feature (165)..(165): n is a, c, g, or t
  modified_base (232)..(232): a, c, t, g, unknown or other
  misc_feature (232)..(232): n is a, c, g, or t
tcagcatagtagtgcacgaccggtgctcgatttagtgctatagacttgggtttggggactcgggacaatcttcatcatgacctgcctccctctcctcctctcccttctcattccactgcacacgggtcctcgggccctagtctttgtnacgnagccncctnagtntctcgcggcccaggacaggaggtcctaccgtctccgtgctgtacgggaacgccgtcctaccaacgtnttcgggacctacgtaaatttataggtacttccgtagggtacccaactcccgtaaccccggtttaccccggggaacctaacccccggaaccccccgtaaaaaccttcccctaacccgttaacttcccgttaaattacgggtaaaactttaccgttttacccggacccgttacccccgtaacgggtaaacggttccgttacccgttacggggtaaccctacgtttcccttccggttacggtaccccttaaccggtaacggttcggacggaacccctcccggtacttcggaaccccgtaccgtacgaccgttacgtacccggtacgggtaccccttaccggaacccggggttaacccgggggaccggaaaccgggttccgttaaacgtttaccgtttacctaccggtaccgtaaaccgttacccggtaccggttacccgttaaccctaaccggtaccggttacggttcgggttacgggtccggtttacgggacggttaacgtacgtacggtaccgtccgttaaccgttcgacctacgtccggaacgttccgacccgtcccgtcgtccttacgtccgtacccgttccctaacccgttcctaaccgtccgttaacacgttcctacggtcgacccgggtacggaccgtaacgg

SEQ ID NO: 62973 - DNA, 790 bp, Homo sapiens
  misc_feature: GYAE6OF02GBO1B.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacaggtcctgggcccagttctttgttgacgcagcccgccctcagtgtctggccggccccaggacaggacgggtcaccgtctccgtgcctcgtagggaacgccgccctaccaactagttgggaccaacgtaaatttatacgttaacttcccgttacggtacccaacggtcctaacccggttacccccggggaacacccggtacccccctaaaactccctactacgttacctaagtacgtaaagttacgttttacccgcccgtaaccccgttcggaagggttacctttacccggtacggtacccggttactttccgttccgtcggtcccgttaaccgaacggtccgtaacggccctaaccctcgttaccggaccctaccgtacggaacctacgtaccggaccgggtccctacccggaacgggtacccgggggaacgtacgggtacccgtaatttacgttaccgcggtaccgtaccgtaacgggttaccggaccttaaccctaaccggtcgtacggttcgggttaccgggtcgtttacgggacgggtaacgtacgtagttaccggtccgtacgtacgtcgacgccgtagtcccgtccgtcccgtacgtcctaccgtcgttaccctccctccctccctaccctagttaccgctcgcgtacggcggtccgacgtacg

SEQ ID NO: 62974 - DNA, 764 bp, Homo sapiens
  misc_feature: GYAE6OF02GRDP8.10.86.H09.1.454.CMB.1.raw
tcagcatagtagtgcacgaccggtgctcgatttagtgctatagacttgggtttggggactcgggacaatcttcatcatgacctgctcccctctcctcctctcccttctcattcactgcacgagggtcctgggcccagtctttgttgacgcacgcccgccctcagtgtcgtcggccggaccccgaggacgaggacgggtccaccgtctcctgctcgtaggaacgccgtacctaccgaactacgttcggactaacgtaattactgtactccgtacggtaccacgtcctaccgtccccggaccacccgaccccctaacctcctacgtactacgtatacggttaacgttacgtttaaccgacccgtacccgtacggtacggtacttccgtacggtccttacttcgtcgtcgtaccctacgtacgtacgaccgtccgtacctcgtaccgaccgtaccgtagacctacgtcccgaccggtacctaccgggaaccgggacgggacgacggtaccgttagtttaccgtacgcgtaccgtaccgtacggtaccgtactacccgtacgtacgtacgttcgggttcgggttccggttacgggtaccgggtaacgtacgttaacggttcccgtaaccgtaccgtaaccgaccgtacccgaccggtacgtccgtcccgtccccgtacgtacccgtccgttcccgtacccggtccccgtccctcccgttaccctacttaccgtacgtcgtccggcggtaccgggtccggtgtaccggg

SEQ ID NO: 62975 - DNA, 625 bp, Homo sapiens
  misc_feature: GYAE6OF02IZM7M.10.86.H09.1.454.CMB.1.raw
  modified_base (206)..(206): a, c, t, g, unknown or other
  misc_feature (206)..(206): n is a, c, g, or t
  modified_base (218)..(218): a, c, t, g, unknown or other
  misc_feature (218)..(218): n is a, c, g, or t
tcagcatagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgcctcagtgtctgcggccccaggacagagggtcaccgtctcctgctctggaancgcctccaaacnttggcacgaattatgtatcctggtaccagcacttcccggacacgccccaaactcctcatctatgaagtattttacgcgaccctcagggtacttcctcggccgattctcgtcggctccaagtcaggcacctctcgccaccctcgacacttcgaccggctccacgaccgggacgacgcgattattactgcgactacgttcggactccaactgtctagttgggtcgtttcggcggtacgggaacgtaaggttacgaccggttaccgtaccgttacgaccgtacccgaacggtccgtccgccccgttaccgggtcctaaccgttccgttccggttcccccctaccccccttccctaacccgttacctaaccgttcgtccgttacggccggtccgggtaccgtcgggaaccg

SEQ ID NO: 62976 - DNA, 606 bp, Homo sapiens
  misc_feature: GYAE6OF01EG127.34.9.A09.1.454.CMB.1.raw
  modified_base (276)..(276): a, c, t, g, unknown or other
  misc_feature (276)..(276): n is a, c, g, or t
  modified_base (305)..(305): a, c, t, g, unknown or other
  misc_feature (305)..(305): n is a, c, g, or t
  modified_base (421)..(421): a, c, t, g, unknown or other
  misc_feature (421)..(421): n is a, c, g, or t
tcagtacacgtgatcacgaccggtgctcgatttagcgagacgcgcaggggcagcaagatggtgttgcagacccaggtcttcatttctctgttgctctggatctctggtgcctacggggacatcgtgatgacccagtctccagactccctggctgtgtctctgggcgagggggccaccatcaactgccagtccagtcagaattgttttatacacctaccaacagtaagagccgcttacagaaaccaggacacgcctactaagttgctctatttacgnggacatcctacccggacacgtccggggtncctgaccgtattcaggtggcaggcgggtcgtagggactagtactttcgaccttcctccccttacgacgccacgtcctgccgtcggactaggaagtagttggtggtactagtttagnggtagttgtacgaagactaactatttaactacctactccgactaaccgtaaacgttcggaaccggaaggggtaaccctaagggttacggaagtactacgagtacggacgtaacgttggtacggtctcgacctactagtccttcgtccttacgtacttcccgttaccccggctacgtccgtaacgg

SEQ ID NO: 62977 - DNA, 580 bp, Homo sapiens
  misc_feature: GYAE6OF01EMCEK.34.9.A09.1.454.CMB.1.raw
  modified_base (354)..(354): a, c, t, g, unknown or other
  misc_feature (354)..(354): n is a, c, g, or t
  modified_base (396)..(396): a, c, t, g, unknown or other
  misc_feature (396)..(396): n is a, c, g, or t
tcagtacacgtgatcacgaccggtgctcgatttagcgagacgcgcaggggcagcaagatggtgttgcagacccaggtcttcatttctctgttgctctggatctctggtgcctacggggacatcgtgatgacccagtctccagactccctggctgtgtctctgggcgagggggccaccatcaactgccagtccagtcagaatgttttatacacctcaacagtaagagccgcttacagaaaccaggacagcctcctaagttgctcatttactggcatctacccggacagtccggggtgccctggaccgattcaggtggcaggcgggtctgggacagtatttcacctcctccccttnacgcacgcctgctggctgaagatgtggctagtttatgagttntcagcaaactattactactacctccgactaactaaacgttcgggaccgaaggggaaccctaaggttcgggaagtacgttacgattcggacgtaaaccgtgggtacggtactacggaccctaaccgaactttcgtacgttccttacctaacgttccccctttaccccggactagttccgtaacgg

SEQ ID NO: 62978 - DNA, 815 bp, Homo sapiens
  misc_feature: GYAE6OF01DSW97.34.9.A09.1.454.CMB.1.raw
tcagtacacgtgatcacgaccggtgctcgatttagcgagacgcgcagggggtcgagcaagatggtgttgcagacccaggtcttcatttcctctgttgctctggattctctggtcgcctacgggacatcgtgatgacccagtctcagacttccctggctgtgtctcgtgggcgacggggccacatcaactcgccgagtccacgtccagtaattgttttaacaccgacctaccaacagtaacgagccgtacttacaacggaaaccacggaacacgacccttacctaaaggttcgaccttactaactttaaccgtcgggacctacgtaccgtaccccggaactacggtccgggggtacacccgttacgaaccgtattaccgaaggttcggaccgtacggtccgggttacgtacgggtaacctaaggtaccttttaccggaccgttaccccgtttacccccgttaacggaccgggacctaacggtcccgttacgccgttcgggtacccttaaggtaaagtaaccgtttggttacgggtacccgtttaaggttttacgtaggtaacggtttacggtactaacgggtacctaaacgtttactttaactttaaccgtaacccgttccccggaacttaaaccgttaaacgttccgggaaccggtaacgggggtaacccctaaggggtttcggaacgttaccgttcggaacgtcggtaacgttaacgtcggtacgtacttacggaccctaacgttacgttcccgttacgttcccttaaccgttaccgttaccccctttaccggtccttacgttcgttaaaccgg

SEQ ID NO: 62979 - DNA, 722 bp, Homo sapiens
  misc_feature: GYAE6OF01DUSSN.34.9.A09.1.454.CMB.1.raw
  modified_base (206)..(206): a, c, t, g, unknown or other
  misc_feature (206)..(206): n is a, c, g, or t
  modified_base (242)..(242): a, c, t, g, unknown or other
  misc_feature (242)..(242): n is a, c, g, or t
  modified_base (293)..(293): a, c, t, g, unknown or other
  misc_feature (293)..(293): n is a, c, g, or t
  modified_base (305)..(305): a, c, t, g, unknown or other
  misc_feature (305)..(305): n is a, c, g, or t
  modified_base (364)..(364): a, c, t, g, unknown or other
  misc_feature (364)..(364): n is a, c, g, or t
tcagtacacgtgatcacgaccggtgctcgatttagcgagacgcgcaggggcagcaagatggtgttgcagacccaggtcttcatttctctgttgctctggatctctggtgcctacggggacatcgtgatgacccagtctccagactccctggctgtgtctctgggcgagggggccaccatcaactgccagtccagtcagatgtttanacacctccaacagtaagagccgcttacagaaaaccnggaacagcctacctaagttgctcaatttactgggacaagtctaccccgganacgtccggggtnccctgaccgtattcagtggaccagcgggtctagggacagactttcacctcctccccttnacgcaacgtccctgccgttggactagggaaagtagtggttacggacgtagttttaagtggtaaggttacggtacaacggtactaaaccgtatttaacttaccttaaaccctaccgacctaaacctaaacgtttacgggacccgaacggggggaaccctaaagggtttacgggaacggtactaccgtaagttaccggacggtaaaaaccgtttcgggtacgggtaccgttacgggtacccggtaaaccccgttactttacgttaaccgggttttcccgttttaaacccctaacccttttaacccccgggtttaccccccgggttaacccccttaaaccgtttcccggtttaaaaccggg

SEQ ID NO: 62980 - DNA, 482 bp, Homo sapiens
  misc_feature: GYAE6OF02JS7IJ.34.9.A09.1.454.CMB.1.raw
  modified_base (296)..(296): a, c, t, g, unknown or other
  misc_feature (296)..(296): n is a, c, g, or t
  modified_base (346)..(346): a, c, t, g, unknown or other
  misc_feature (346)..(346): n is a, c, g, or t
  modified_base (447)..(447): a, c, t, g, unknown or other
  misc_feature (447)..(447): n is a, c, g, or t
  modified_base (475)..(475): a, c, t, g, unknown or other
  misc_feature (475)..(475): n is a, c, g, or t
tcagtacacgtgatcacgaccggtgctcgatttagcgagacgcgcaggggcagcaagatggtgttgcagacccaggtcttcatttctctgttgctctggatctctggtgcctacggggacatcgtgatgacccagtctccagactccctggctgtgtctctgggcgagggggccaccatcaactgccagtccagtcagaatgttttatacacctccaacagtaagagtcgcttacagaaaccaggacagcctcctaagttgctcatttactggcatctacccggacatccggggtncctgaccgattcagtggcagcgggtctgggacagatttcactctcccttnagcagcctgctggctgaagatgtggcagtttatgagtgtcagcaacattatactactcgcacaaacttggaccagggaccaagtgagatcatgcgaactgngctgcaccatctgtcttcatcgttcccncatctag

SEQ ID NO: 62981 - DNA, 509 bp, Homo sapiens
  misc_feature: GYAE6OF02HEQGI.34.9.A09.1.454.CMB.1.raw
  modified_base (297)..(297): a, c, t, g, unknown or other
  misc_feature (297)..(297): n is a, c, g, or t
  modified_base (347)..(347): a, c, t, g, unknown or other
  misc_feature (347)..(347): n is a, c, g, or t
  modified_base (367)..(367): a, c, t, g, unknown or other
  misc_feature (367)..(367): n is a, c, g, or t
  modified_base (394)..(394): a, c, t, g, unknown or other
  misc_feature (394)..(394): n is a, c, g, or t
tcagtacacgtgatcacgaccggtgctcgatttagcgagacgcgcaggggcagcaagatggtgttgcagacccaggtcttcatttctctgttgctctggatctctggtgcctacggggacatcgtgatgacccagtctccagactccctggctgtgtctctgggcgagggggccaccatcaactgccagtccagtcagaatgttttatacacctccaacagtaagagccgcttacagaaaccaggacagcctcctaagttgctcatttactgggcatctacccggacatccggggtncctgaccgattcagtggcagcgggtctgggacagatttcactctcccttnagcagcctgctggctgaagntgtggctagtttatgagtgtcagcaanattatactactccgacaacaaacttggtacgaaggggtaaccctaaggttggaagtatccgatgaccgaacgtgtaggctggcactatctgtctcactccttcccgctatctacg

SEQ ID NO: 62982 - DNA, 513 bp, Homo sapiens
  misc_feature: GYAE6OF02ILC6T.34.9.A09.1.454.CMB.1.raw
  modified_base (370)..(370): a, c, t, g, unknown or other
  misc_feature (370)..(370): n is a, c, g, or t
  modified_base (384)..(384): a, c, t, g, unknown or other
  misc_feature (384)..(384): n is a, c, g, or t
  modified_base (484)..(484): a, c, t, g, unknown or other
  misc_feature (484)..(484): n is a, c, g, or t
  modified_base (504)..(504): a, c, t, g, unknown or other
  misc_feature (504)..(504): n is a, c, g, or t
tcagtacacgtgatcacgaccggtgctcgatttagcgagacgcgcagggggcagcaagatggtgttgcagacccaggtcttcatttctctgttgctctggatctctggtgcctacggggacatcgtgatgacccagtctccagactccctggctgtgtctctgggcgagggggccaccatcaactgccagtccagtcagaatgttttatacacctccaacagtaagagccgcttacagaaaccaggacagcctcctaagttgctcatttactgggcatctacccggacagtccggggtgcctgaccgattcagtggcagcgggtctgggacagatttcacctctccccttcagcagcctgctggctgagntgtggctagtttangtagtgtcagactaactattaactactacctccgactaactaaacgttggaccgaagggacctaagggttgaagtatcatgacgtaatggtgctgcaccntctgtcttcacttcctcccnctactctag

SEQ ID NO: 62983 - DNA, 534 bp, Homo sapiens
  misc_feature: GYAE6OF02G76SU.34.9.A09.1.454.CMB.1.raw
  modified_base (298)..(298): a, c, t, g, unknown or other
  misc_feature (298)..(298): n is a, c, g, or t
  modified_base (373)..(373): a, c, t, g, unknown or other
  misc_feature (373)..(373): n is a, c, g, or t
  modified_base (376)..(376): a, c, t, g, unknown or other
  misc_feature (376)..(376): n is a, c, g, or t
  modified_base (385)..(385): a, c, t, g, unknown or other
  misc_feature (385)..(385): n is a, c, g, or t
  modified_base (410)..(410): a, c, t, g, unknown or other
  misc_feature (410)..(410): n is a, c, g, or t
tcagtacacgtgatcacgaccggtgctcgatttagcgagacgcgcaggggcagcaagatggtgttgcagacccaggtcttcatttctctgttgctctggatctctggtgcctacggggacatcgtgatgacccagtctccagactccctggctgtgtctctgggcgagggggccaccatcaactgccagtccagtcagaatgtttatacacctccaacagtaagagccgcttacagaaaccaggacagcctcctaagttgctcatttactgggcatcctacccggacagtccggggtncctgaccgattcagtggcaggcgggtctggggacagatttccactcctccccttcagcagcctgctggctgaagntgngcagtttangatgtcagcaaacattatacctacncccgacaactaaacttggaccgaaggggaccaaagggttgaagtactacatcgacgtaacgtggtacggctcggaccacctattcgtcgttacttacgacttcccgttcccgacctactctacg

SEQ ID NO: 62984 - DNA, 705 bp, Homo sapiens
  misc_feature: GYAE6OF02HXD63.34.9.A09.1.454.CMB.1.raw
  modified_base (209)..(209): a, c, t, g, unknown or other
  misc_feature (209)..(209): n is a, c, g, or t
  modified_base (372)..(372): a, c, t, g, unknown or other
  misc_feature (372)..(372): n is a, c, g, or t
tcagtacacgtgatcacgaccggtgctcgatttagcgagacgcgcaggggcagcaagatggtgttgcagacccaggtcttcatttctctgttgctctggatctctggtgcctacggggacatcgtgatgacccagtctccagactccctggctgtgtctctgggcgagggggccaccatcaactgccagtccagtcagaattgttttanacaccctccaacagtaagacgccgacttacagaaaccaggacagtcctacctaagttcgctactatttacgtgggctactccgtacccggaactacggtccggggtcgccgtcggaccgtattcgacggtggcaggtcgggtcgtggggactagtactttacnccttcccttccccttcgacgtccacgcccgtgccgtggctaggaagtgtggtcggacgttagtttacgtggtacggtgtactaggtacctaaacgtattaacttaaccttacccgtacccgtaacctaaaccgtaaacggttccgggaaccggtaaaccgggggtaaccgtaaacgggtttaggaacgtacgttacgtaacgtacggtaccggtaaacgttcgggtcgggtaccgtacggaccctaacccgttacgttacccgttacggtttccctttaccctaccgtttacccccgttacccccggtacccttaccgttaccgttaaaccgg

SEQ ID NO: 62985 - DNA, 700 bp, Homo sapiens
  misc_feature: GYAE6OF02J19C9.34.9.A09.1.454.CMB.1.raw
  modified_base (225)..(225): a, c, t, g, unknown or other
  misc_feature (225)..(225): n is a, c, g, or t
  modified_base (307)..(307): a, c, t, g, unknown or other
  misc_feature (307)..(307): n is a, c, g, or t
tcagtacacgtgatcacgaccggtgctcgatttagcgagacgcgcaggggcagcaagatggtgttgcagacccaggtcttcatttctctgttgctctggatctctggtgcctacggggacatcgtgatgacccagtctccagactccctggctgtgtctctgggcgaggggccaccatcaactgccagtccagtcagaatgttttatacacctccaacagtaagngccgcttacagaaaccaggacagcctacctaagttcgctctatttactgggccattccgtacccggactacgtccgggggtnccgttagaccgatttccgaggtcggcacggccggggtctcggggactagtacgtttaccaccgttccttcccccgttacgacggcctacggtcccgtggtccgttgggaccttaggaaacggtcttacgggtcggtccgttaaggttttactaggtaacggtgtaccgtaggaccgtaaactacgtttaactaacctttaacctccgtaaccgtaaccgttaaaacgttccgggtacccggaaaggggttaaccctaaggtttaacgggaacgtaacgtaccgtaacgttacgaccgggtaaaccttggtccgggtaccttaggaccctaaccgtacttcgttacggttccctttacgacgttccctttccccggacttaccttaccgttacg

SEQ ID NO: 62986 - DNA, 544 bp, Homo sapiens
  misc_feature: GYAE6OF02IFS24.34.9.A09.1.454.CMB.1.raw
  modified_base (206)..(206): a, c, t, g, unknown or other
  misc_feature (206)..(206): n is a, c, g, or t
  modified_base (217)..(217): a, c, t, g, unknown or other
  misc_feature (217)..(217): n is a, c, g, or t
  modified_base (224)..(224): a, c, t, g, unknown or other
  misc_feature (224)..(224): n is a, c, g, or t
  modified_base (257)..(257): a, c, t, g, unknown or other
  misc_feature (257)..(257): n is a, c, g, or t
  modified_base (268)..(268): a, c, t, g, unknown or other
  misc_feature (268)..(268): n is a, c, g, or t
  modified_base (294)..(294): a, c, t, g, unknown or other
  misc_feature (294)..(294): n is a, c, g, or t
  modified_base (318)..(318): a, c, t, g, unknown or other
  misc_feature (318)..(318): n is a, c, g, or t
  modified_base (345)..(345): a, c, t, g, unknown or other
  misc_feature (345)..(345): n is a, c, g, or t
  modified_base (388)..(388): a, c, t, g, unknown or other
  misc_feature (388)..(388): n is a, c, g, or t
tcagtacacgtgatcacgaccggtgctcgatttagcgagacgcgcaggggcagcaagatggtgttgcagacccaggtcttcatttctctgttgctctggatctctggtgcctacggggacatcgtgatgacccagtctccagactccctggctgtgtctctgggcgaggggccacatcaactgccagtccagtcagaatgttttanacacctccaanagtaagnccgcttacagaaaccaggacagcctctaagttnctcatttacgnggcatctacccggacatcctgggtcncctgaccgattcagtgcagcggtngggacagtactttcactcctccccttnacgcagcctagcttaggctagaagatgtcggactagtttacgnggtagtcgtacagaccaaatattaatactactccgacaactaaacgtggacccggagggaccaaggttgagtactgtatagacggaactggtcggtctcggacctaccaagtttcgtcttaccgtttctaacttccccgttacccgaccacttacg

SEQ ID NO: 62987 - DNA, 599 bp, Homo sapiens
  misc_feature: GYAE6OF02GO06Z.34.9.A09.1.454.CMB.1.raw
  modified_base (283)..(283): a, c, t, g, unknown or other
  misc_feature (283)..(283): n is a, c, g, or t
  modified_base (368)..(368): a, c, t, g, unknown or other
  misc_feature (368)..(368): n is a, c, g, or t
tcagtacacgtgatcacgaccggtgctcgatttagcgagacgcgcagggggcagcaagatggtgttgcagacccaggtcttcatttctctgttgctctggatctctggtgcctacggggacatcgtgatgacccagtctccagactccctggctgtgtctcgtgggcggagggggccaccatcaactgccagtccagtcagtaattgttttataccacctccaaacagtaagacgccgacttacaagaaaccaggacagcctcctaagttgctctatttacgnggcatcctacccggacacgtccggggtgcctgaccgtatcgagtggcaggcgggtcgtgggacagtacgtttcactcctcccctnagcacgcctgctcggctagaagattggtaggactagtttatggtagtgtcagactaatattactactactcgacaactaacgttcggaccgtaacggggaccttaagggtacggaagtacttacgcgttacgaccgtaagtggtccggacgtacggacctaacccgtacttcgttacttacccgtttactaccgtttccccgttacccctaccgttacgttacgttaaccg

SEQ ID NO: 62988 - DNA, 769 bp, Homo sapiens
  misc_feature: GYAE6OF02FQ28Q.34.9.A09.1.454.CMB.1.raw
  modified_base (281)..(281): a, c, t, g, unknown or other
  misc_feature (281)..(281): n is a, c, g, or t
  modified_base (492)..(492): a, c, t, g, unknown or other
  misc_feature (492)..(492): n is a, c, g, or t
tcagtacacgtgatcacgaccggtgctcgatttagcgagacgcgcaggggcagcaagatggtgttgcagacccaggtcttcatttctctgttgctctggatctctggtgcctacggggacatcgtgatgacccagtctccagactccctggctgtgtctctgggcgaggggccaccatcaactgccagtccagtcagaattgtttatacacctaccaaacagtaagacgccgacttaaccaagaaaccaggacagccctctaagttcgctatatttaccgngggacacgtcctaaccccgggactacggtcccgggggttgacccgttcggaaccgtagtttaccgaaggttcgggccgtagggtccggggtcgttacggggaactaaggttaactttccgaccttcccgttccccttgaacgtccgacgtcctcggtccgttgggacctaaggaaagtacgttagggttcggtaccgttaggttttaacgnggttaggttcgtaccgaacgtaactaacgttaaacttaaccgttaacttaaccgttacccgaacttaaacccgtaacgttaccgggaaccgggtaaccggggtaaaccgtaagggttacggaagttaaccgtactaacggttaccggtaaaccgtaaccgtttgggaccggtccgtaaccggtacccgtaaaccgtacggttcctttacgttaccgtttaccttaacccgtttaccccgtttacccccggccgttaaccgttacccgttaaacccgg

SEQ ID NO: 62989 - DNA, 678 bp, Homo sapiens
  misc_feature: GYAE6OF02I75F6.34.9.A09.1.454.CMB.1.raw
  modified_base (208)..(208): a, c, t, g, unknown or other
  misc_feature (208)..(208): n is a, c, g, or t
  modified_base (226)..(226): a, c, t, g, unknown or other
  misc_feature (226)..(226): n is a, c, g, or t
  modified_base (266)..(266): a, c, t, g, unknown or other
  misc_feature (266)..(266): n is a, c, g, or t
  modified_base (309)..(309): a, c, t, g, unknown or other
  misc_feature (309)..(309): n is a, c, g, or t
  modified_base (457)..(457): a, c, t, g, unknown or other
  misc_feature (457)..(457): n is a, c, g, or t
tcagtacacgtgatcacgaccggtgctcgatttagcgagacgcgcaggggcagcaagatggtgttgcagacccaggtcttcatttctctgttgctctggatctttggtgcctacggggacatcgtgatgacccagtctccagactccctggctgtgtctcgtgggcgaggggccaaccatcaactgccagtccagtcagtatgtttanacacctcaacagtaaganccgcttaacacgaaaccaggacagcctacctaagtgcctntatttacgtcgggcataccgtaacccggacgacgtccggggtnccgtaggtaccgtacgttacgaggtcggcacgggtcgggtcgtagggaactaaggtactttaccgcttcccgttcccttacgacgccgtagtcctaggtcgtagggtctagggtaaaagcgtttacggtcggtaccgtaagttttagnggttaacggtacgttacgaggaactaaacgtaatttaaacctaccgttaaccgtccgaactaaaccgtaaacgttccggaaccgggtaacggggtaactaacggtggaaacgtcgtaacgagttcgaacgtaacttggggacctcgtcgtaccgtaacacgttcgttaccgttcgttaaccctacgttccccgtacccgtctaacttcggaacgttaaccg

SEQ ID NO: 62990 - DNA, 821 bp, Homo sapiens
  misc_feature: GYAE6OF02H0FAN.34.9.A09.1.454.CMB.1.raw
tcagtacacgtgatcacgaccggtgctcgatttagcgagacgcgcaggggcagcaagatggtgttgcagacccaggtcttcatttctctgttgctctggatctctggtgccgtacggggacagtcgtagatcgacccagtcctccacgacctcccgtggctgtgtctcgtgggcggacggggcccaaccatccaacgtcgaccgtacgtccgagtacaagtaatttcgttttaacacctaccctacctaaacgaaggtaaacggccgcctaccttaacgaaacggaaaacccgtagggaacctacgtaccccgttacttaaaggtcgtacttacttacgttacgtaggtacctaccgtaccggttaaccccggaagtcccgggttcccgggggttactaccccggtacggtaacccgttacggtttccggacggttccggggacgtaccgggggtccgggttacggtacgggacttacggttacctttacccggtcccttccccgtaccccgttaggaaccgtccgtcggttccgtcggtaacgtcggtaccgttaggtaaacgtgttcgggtacgtaccgtagttttagtacggtacgtcgtacgtaacgtactaaacgttattaaccgttaccttacccgaaccgtaccgtaaaccgtacggtaccgggaacgggtaacccgggtaacgttaacgggtacgtacgtacgtacgtacggtacgtaacgttagttaccggcgtacgtccgtaacctaccgttacttccgttacgttccttaccgttcccgtaccttaccccgtcttaccgtacgtaacccg

SEQ ID NO: 62991 - DNA, 720 bp, Homo sapiens
  misc_feature: GYAE6OF02F7696.34.9.A09.1.454.CMB.1.raw
  modified_base (290)..(290): a, c, t, g, unknown or other
  misc_feature (290)..(290): n is a, c, g, or t
  modified_base (303)..(303): a, c, t, g, unknown or other
  misc_feature (303)..(303): n is a, c, g, or t
tcagtacacgtgatcacgaccggtgctcgatttagcgagacgcgcaggggcagcaagatggtgttgcagacccaggtcttcatttctctgttgctctggatctctggtgcctacggggacatcgtgatcgaccagtctacagacctccctggctgtcgtctcgtgggcggaggggccaccatacaactgccagtccacgtacaagtaattagttttaacaacctacctaccaaacgacgtaagacgacctacgttaacaacgaaacctaggaccacgcctacgtaagtcnctactatttacgnggactacgtaccgtaacccgggaacgtcccggggtacctacggacctagttaccgaggtcggacgacggcgggttactagggaccgtaagttaactttccaaccgttacctaccaacctactaccgaacccgtacggtacctcggacttaacgaccctaaggaaagtacgtacggtacggtaaccgttaaacgttttattacgtagtaacgaacgtaacgttaaattacttaacgtaccttacccgtacgtacttacgtttaccggttaccgggacggggttaaccgaacggtaaggttagacgtaacgtaaacgaaacgttagtcggtacgtctacggactaccgtagtcgttacgttaaccgtctaaccgtttcccgtacccgagttaccagtacgtaacttagaccggttaacg

SEQ ID NO: 62992 - DNA, 515 bp, Homo sapiens
  misc_feature: GYAE6OF01ERYYV.10.64.F09.1.454.CMB.1.raw
  modified_base (199)..(199): a, c, t, g, unknown or other
  misc_feature (199)..(199): n is a, c, g, or t
tcagcatagtagtgcacgaccggtgctcgatttagcgcgtatacaagggggaggaactgctcagtcaggacccagagggaaccatggaagccccagctcagcgtctcttcctcctgctactctggctcccagatataaccgccggagaaattgtgttgacacagtctccagccaccctgtctttgtctccaggggaaanagccaccctctcctgcagggccagtcagagtgttagcactaacttagtctggtaccaacagaaacctggccaggctcccaggctcctcatctatgatgcatccacgagggccactggcatcccagccaggttcagtggcagtgggtctggggacagacttcactctcaccatccaccggcctacgaccctgaagtattttgctagtttattactgtcagcagcgtagcagctcggcccctctccctctaccgtttcggcggagggaccaagggtggagatacgaaacgtatggtggctgcaccatctgtcttctac

SEQ ID NO: 62993 - DNA, 523 bp, Homo sapiens
  misc_feature: GYAE6OF01CAA69.10.64.F09.1.454.CMB.1.raw
  modified_base (199)..(199): a, c, t, g, unknown or other
  misc_feature (199)..(199): n is a, c, g, or t
  modified_base (257)..(257): a, c, t, g, unknown or other
  misc_feature (257)..(257): n is a, c, g, or t
tcagcatagtagtgcacgaccggtgctcgatttagcgcgtatacaagggggaggaactgctcagtcaggacccagagggaaccatggaagccccagctcagcgtctcttcctcctgctactctggctcccagatataaccgccggagaaattgtgttgacacagtctccagccaccctgtctttgtctccaggggaaangccaccctctcctgcagggccagtcagagtgttagcactaacttagtctggtaccaanagaaacctggccaggctccaggctctcatctatgatgcatccacgagggcccactggcactcccagccaggttcaggtggcaggtgggtctggggacaggacttcactctcaccatccaccgcctacgaccctgaagtattttgctagtttattactgtcagcagcgtagcagctcggcccctcctccctctaccgtttcgggcggacggaccgaggtggagagtacgaaacgtacgtggtcggctgctaccatctcgtcttctac

SEQ ID NO: 62994 - DNA, 550 bp, Homo sapiens
  misc_feature: GYAE6OF01A504S.10.64.F09.1.454.CMB.1.raw
  modified_base (199)..(199): a, c, t, g, unknown or other
  misc_feature (199)..(199): n is a, c, g, or t
  modified_base (282)..(282): a, c, t, g, unknown or other
  misc_feature (282)..(282): n is a, c, g, or t
  modified_base (379)..(379): a, c, t, g, unknown or other
  misc_feature (379)..(379): n is a, c, g, or t
  modified_base (536)..(536): a, c, t, g, unknown or other
  misc_feature (536)..(536): n is a, c, g, or t
tcagcatagtagtgcacgaccggtgctcgatttagcgcgtatacaagggggaggaactgctcagtcaggacccagagggaaccatggaagccccagctcagcgtctcttcctcctgctactctggctcccagatataaccgccggagaaattgtgttgacacagtctccagccaccctgtctttgtctccaggggaaangccaccctctcctgcagggccagtcagagtgttcgcacttcgtagggtgtatcaacataaatccggcaggctccaggctcctnatctttgatgctttcaacgacgggcccctggccgtcccaggcaggttcagtggcagtggtctgggacagacttcactctcaccatcagcagcctagngctgaagtatttgctagtttattactgtcagcagtcgtgcctacgtttcgggcggtaggtcgaccgtacgtttcgggacggtaacgggtaaccaaagtacggaggtaccgaaacgtaacgtaggtcggtcgtcgcacctagttcgtcgttacttacncttccttcccgtac

SEQ ID NO: 62995 - DNA, 622 bp, Homo sapiens
  misc_feature: GYAE6OF01CELW2.10.64.F09.1.454.CMB.1.raw
  modified_base (197)..(197): a, c, t, g, unknown or other
  misc_feature (197)..(197): n is a, c, g, or t
  modified_base (206)..(206): a, c, t, g, unknown or other
  misc_feature (206)..(206): n is a, c, g, or t
tcagcatagtagtgcacgaccggtgctcgatttagcgcgtatacaagggggaggaactgctcagtcaggacccagagggaaccatggaagccccagctcagcgtctcttcctcctgctactctggctcccagatataaccgccggagaaattgtgttgacacagtctccagccaccctgtctttgctccaggggaangccaccctntcctgcagggccagtcagagtgttcgctacttcgttagggtgtatcaacataaatccggcaggctccaggctcctcatctttgatgtctttcaacgcgggcccctggccgtcccaggctaggttcaggtggacaggttgggctggggactagcttcactctcacatcagcagcctagacgtcctaggaattatttagcttaagttttaattacgtgttacagtctaggtcgttacgccttacgtttcgggacggtacggttcgaccgtacggtttcgggaccggtaacgggaaccgtaaagttagggaacggttaccgaaaaccggtaacgttacgggtacgggtaccttacggccgtaacccgtagttccgttacggtttacccttactaccgttcccgtttccccggtaacccg

SEQ ID NO: 62996 - DNA, 527 bp, Homo sapiens
  misc_feature: GYAE6OF01C8UFV.10.64.F09.1.454.CMB.1.raw
  modified_base (198)..(198): a, c, t, g, unknown or other
  misc_feature (198)..(198): n is a, c, g, or t
  modified_base (256)..(256): a, c, t, g, unknown or other
  misc_feature (256)..(256): n is a, c, g, or t
  modified_base (283)..(283): a, c, t, g, unknown or other
  misc_feature (283)..(283): n is a, c, g, or t
tcagcatagtagtgcacgaccggtgctcgatttagcgcgtatacaagggggaggaactgctcagtcaggacccagagggaaccatggaagccccagctcagcgtctcttcctcctgctactctggctcccagatataaccgccggagaaattgtgttgacacagtctccagccaccctgtctttgctccaggggaaanagccaccctctcctgcagggccagtcagagtgttagcactaacttgtctggtaccaanagaacctggccaggctcccaggctccnatctatgatgcatccacggacgggccagtggcactcccagccaggttcagtggcaggtgggtctgggacagacttcactctcacctatccgaccggcctacgaccctagaagtattttgactagtttatactgtcagcagcgtagcagctcggccctctccctctacgtttcggacggagggaccaagggtgagtagtacgaaacgtactggtcggctagacctacctatctagttccttctac

SEQ ID NO: 62997 - DNA, 614 bp, Homo sapiens
  misc_feature: GYAE6OF01AQM6W.10.64.F09.1.454.CMB.1.raw
  modified_base (196)..(196): a, c, t, g, unknown or other
  misc_feature (196)..(196): n is a, c, g, or t
  modified_base (225)..(225): a, c, t, g, unknown or other
  misc_feature (225)..(225): n is a, c, g, or t
  modified_base (283)..(283): a, c, t, g, unknown or other
  misc_feature (283)..(283): n is a, c, g, or t
tcagcatagtagtgcacgaccggtgctcgatttagcgcgtatacaagggggaggaactgctcagtcaggacccagagggaaccatggaagccccagctcagcgtctcttcctcctgctactctggctcccagatataaccgccggagaaattgtgttgacacagtctccagccacctgtctttgctcgaggggaancgccaccctctcctgcagggccagtcagngtgtggcgctacgtagcctggtaccaacagaaacctggccaggctcccgacggccctnactcctagtggtcgcactaccgaacgacggggccacgtggccactccccgagccgtaggttccagggtcggcgtaggtcggggtctgggacagtacttcgactctacactatcatcagccgtggacgtcctagagtattggttgacgttagtttacttacgtgtctagctagtcgtacgttccgtacggtttacggcgggtacgttcggacccgttacgggttcggggacggtaacgggtaacctaaaggtacggaacggtaacgaaaccggtagttgggtacggtaccgacgacccgtaactacgttacgttcggttccttaccgtaccg

SEQ ID NO: 62998 - DNA, 524 bp, Homo sapiens
  misc_feature: GYAE6OF01C7O99.10.64.F09.1.454.CMB.1.raw
  modified_base (200)..(200): a, c, t, g, unknown or other
  misc_feature (200)..(200): n is a, c, g, or t
  modified_base (371)..(371): a, c, t, g, unknown or other
  misc_feature (371)..(371): n is a, c, g, or t
  modified_base (517)..(517): a, c, t, g, unknown or other
  misc_feature (517)..(517): n is a, c, g, or t
tcagcatagtagtgcacgaccggtgctcgatttagcgcgtatacaagggggaggaactgctcagtcaggacccagagggaaccatggaagccccagctcagcgtctcttcctcctgctactctggctcccagatataaccgccggagaaattgtgttgacacagtctccagccaccctgtctttgtctccaggggaaagngccaccctctcctgcagggccagtcagagtgttagcactaacttagtctggtaccaacagaaacctggccaggcctcccgaggctcctcatctatgatgcactccacggacgggccacgtggcactcccagccaggttcagtggcaggtgggtctgggacagcttcactcncaccatccgaccgcctacgaccctagtaagtatttcgtactagttttaacttactgtcagtcagtcgtagcagcgtcgccctctccctctacgttcggcggagggacgagggtggagatacgaaacgatggtgctgactacatctntctctac

SEQ ID NO: 62999 - DNA, 731 bp, Homo sapiens
  misc_feature: GYAE6OF01CJDW9.10.64.F09.1.454.CMB.1.raw
  modified_base (257)..(257): a, c, t, g, unknown or other
  misc_feature (257)..(257): n is a, c, g, or t
tcagcatagtagtgcacgaccggtgctcgatttagcgcgtatacaagggggaggaactgctcagtcaggacccagagggaaccatggaagccccagctcagcgtctcttcctcctgctactctggctcccagatataaccgccggagaaattgtgttgacacagtctccagccaccctgtctttgtctccgaggggaaagcgccaccctctcctgcagggccagtcagagtgtagcactacttagtctggtaccaanagaaacctggaccaggcctcccgaggcctcctcatctatgatgctactccgacggacgggcccacgtcggacctactccccgaaggtcctagggtttacaggttcggaccgtagggtcggggtcgtaggggacctaggtacctttcgaaccttcctacctaaccctaacgttcccgaacccgggtaccccttaacggaaccccgttagggtaaacgttacgtttttacgaacctttaaggtttttaactttacgttacgtacgaggtaccgacggtccggttaagccgtaacggtccgttacccgggtccccccttcccttacccccgttaccgtttacccgggtttccggggaaccgggtaacggggaacccggtaagggtacgggaacgtaacgtaaccggaaaaccggttaacgtgggtacggccgttacggaccctaaccgttacttagtttccttcgttcccttaaccg

SEQ ID NO: 63000 - DNA, 764 bp, Homo sapiens
  misc_feature: GYAE6OF01CEX4I.10.64.F09.1.454.CMB.1.raw
  modified_base (200)..(200): a, c, t, g, unknown or other
  misc_feature (200)..(200): n is a, c, g, or t
tcagcatagtagtgcacgaccggtgctcgatttagcgcgtatacaagggggaggaactgctcagtcaggacccagagggaaccatggaagccccagctcagcgtctcttcctcctgctactctggctcccagatactaaccgccggagaaattgtgttgacacagtctccagccaccctgtctttgtctccgaggggaancgccaccctctcctgcgagggccagtcagagtgttacgctaacttaacgttagtctaggtaaccaacgaacgaaaaccgtcggaccgaacgggtcctacccgaacggtccctacccttactaacttccgttaagttcggtaattcggacctaaccgtacccgaacgggtacgggaccctaacgtcggacctacgtaccccgacgaccgtacggttcgaaggtcggcgtagggttcgggtcgtacgggaacgtacgtaccttactaccgttacctcctaacccgtacgtcccgacccggtacctaacgtacccgtaagtaagtttctttacggacttaacggttttaacttcgttcgtactacgtacgacgtacgtacgtacgacgtcccgtacccggtccccttaccgtccccttaccgttaccggtttacggggacccgggtaacgggtacccggtaaggggttacgaaacggttaactaacccggtaaaccggtaacggtttcggcggtaccgttcgaaccttaccctagtttaccgttccgtttacggtaccctttacccg

SEQ ID NO: 63001 - DNA, 550 bp, Homo sapiens
  misc_feature: GYAE6OF01EI36F.10.64.F09.1.454.CMB.1.raw
  modified_base (196)..(196): a, c, t, g, unknown or other
  misc_feature (196)..(196): n is a, c, g, or t
tcagcatagtagtgcacgaccggtgctcgatttagcgcgtatacaagggggaggaactgctcagtcaggacccagagggaaccatggaagccccagctcagcgtctcttcctcctgctactctggctcccagatataaccgccggagaaattgtgttgacacagtctccagccaccctgtctttgctcaggggaangccacctctcctgcagggccagtcagagtgttagcactaacttgtctggtaccaacagaaacctggccaggcctcccaggctcctcatctatgatgcatccacgacggccactggcatccagccaggttccagtggctaggtggtcgtaggggacaggacttcgactctacacatcgaccggcctaacgaccctagaagtattttagctagtttattactgtcagcagcgtagctagcgtcggaccccttctcccttctacgtttcgggcggaacgggtaccgtaagggtacgagacgtaaccgaaacgtacgtggtcggactggacctaccgacttctcggttcttcgtaccg

SEQ ID NO: 63002 - DNA, 835 bp, Homo sapiens
  misc_feature: GYAE6OF01C5898.10.64.F09.1.454.CMB.1.raw
  modified_base (208)..(208): a, c, t, g, unknown or other
  misc_feature (208)..(208): n is a, c, g, or t
tcagcatagtagtgcacgaccggtgctcgatttagcgcgtatacaagggggaggaactgctcagtcaggacccagagggaaccatggaagccccagctcagcgtctcttcctcctgctactctggctcccagactactaaccgccggagaaattgtagttgaacacagtctccagcccaccctgtcctttgacctccgaggggaaacncgccctaccctctccgtgccgaacgggccaagtcaaggtagttgttacgactaacttaacgtttaggtcctaacggttaacccaaacgaacggtaaaacccgttcgggaaccccgtaacgggtcccttacccccgaagggtcccttacccgttactaacgttacctaacgttagaaacgttcggaacctaccgtacccggaaccgggacggggaccctaacggtccggacctaacccgttcccgaacggtaccgtacggttacgaacgggtttcggcgtaacgggttcggggtcgtacgggtaacgaacgttacttccgaacttccgtacccgtaaaccgtaccgttacccggtaaccccggtaccgttaaccgaacccgttaaggtaaaacgtttcgttttaccgtaacgtttacgtttttaaaccgttacgtcgttaccgtaacgtaccgacgggttaccgtacggactcgggtacccgtccggtcccccttaccgtacccgtttccgaacggtttcgggaaccggttacggaaacgtgggttacgaaccgtagtaaacccgtacggtatcggtacgtacccgtcgacccgtaaccgttactacgttccctacgttcgtaccccg

SEQ ID NO: 63003 - DNA, 746 bp, Homo sapiens
  misc_feature: GYAE6OF01CWF1I.10.64.F09.1.454.CMB.1.raw
tcagcatagtagtgcacgaccggtgctcgatttagcgcgtatacaagggggaggaactgctcagtcaggggacccagagggaaccatggaagccccagctcagcgtctcttcctcctgctactctggctcccagatactaaccgccggagtaaattgtgttgacacagtctccagcccacccttgtctttgcctccgaggggaaagcgccaccctctcctgcgaggccagtcaagagttgtagactactaacttagtctacggtaaccaaacgaacgaaacccgtggaccacggtcctccccgaaggtcctcccgtacattctagtgtactgacacgtccgaacggacgggccacgtcggacaacttccccagaccgtaggttcgacggtggacgtagggtcgggtacgtacgggaactagtaccgttcctaccgttctacctaaccacgtaccgaccggtaccctacggacccttaacggtaattacgttttacgtacgtttaagttttacttaccgttcgttactacgtacgacgttaccgtaacgccaccggtccgttacccggtccccttcccgttaccccgttccggttaccgggtttcccggggaacggggtaaccggtaccgggtaaacggggttcggtaaacgtaacgtaaaccgaaaaccgggttaccgttagggtccggtaaccgtttcgaacccgttaacgacctttcggtaccgtttccttccggttaaccccg

SEQ ID NO: 63004 - DNA, 768 bp, Homo sapiens
  misc_feature: GYAE6OF01ACMHD.10.64.F09.1.454.CMB.1.raw
  modified_base (203)..(203): a, c, t, g, unknown or other
  misc_feature (203)..(203): n is a, c, g, or t
tcagcatagtagtgcacgaccggtgctcgatttagcgcgtatacaagggggaggaactgctcagtcaggacccagagggaaccatggaagccccagctcagcgtctcttcctcctgctactctggctcccagatataaccgccggagaaattgtgttgacacagtctccagccctaccctgttctttgtctccgaggggaaancgcccaccctctcctgccgagggccagtcagagtgttagctactaacttagtcgtggtaaccaacaacgaaacctggaccacggccttccgacggtcctcctcacttactatgatcgcactcccgaacggcgggccctacgtcggaccacgtaccccgacgtccgtaagggttccaggtggacgtaggggtcggggttacgtacgggggaacctacgttaccgtttccgaacccttccgtaaccctaacccgacgttaccccgaacccgggtaacccgtaaccgtaccccgttaagggtaaacgtttcgtttttacccgtaacgtttaacgtttttaacttaccgttacggttaccgtacggtacggtacggtaccggtacggacctaaccgggtcccttaccgggtccccccttcccgtacccccgttacggttacccggtttacggggacccgggaacggtaaccgggtaagggtcggaacggtaaccgtaaacgtaaacggttacgtggtccggtaccctaggaccctaacttcgttacggttcttaccgttcgttaacccg

SEQ ID NO: 63005 - DNA, 610 bp, Homo sapiens
  misc_feature: GYAE6OF01AR5V2.10.64.F09.1.454.CMB.1.raw
  modified_base (197)..(197): a, c, t, g, unknown or other
  misc_feature (197)..(197): n is a, c, g, or t
  modified_base (257)..(257): a, c, t, g, unknown or other
  misc_feature (257)..(257): n is a, c, g, or t
tcagcatagtagtgcacgaccggtgctcgatttagcgcgtatacaagggggaggaactgctcagtcaggacccagagggaaccatggaagccccagctcagcgtctcttcctcctgctactctggctccagatataaccgcggagaaattgtgttgacacagtctccagccaccctgtctttgtctccaggggaaanagcccaccctctcctgcagggccagtcagagtgttagcactaacttagtctggtaccaanagaaacctggccaggctcccaggctcctcatctatgatgcatccacgacggccactggcactcccagccaggttcaggtcggcagggtgggtcgtaggggacagtacttcactctacaccatccgaccggcctacgacccgtgaacgttattttcgacttagtttaattacgtacgtacagcgacgtcgtacgcacgtcctccggccccttcgtccccttacgtaccgtttccgggaccgggtacgggtaaccggtacggtaggtaacgacgtaaccggaaaacggtacgttagggtcggtccgtacggaccctacccgtaacgttcccgttacgtttccttccgttaccccg

SEQ ID NO: 63006 - DNA, 791 bp, Homo sapiens
  misc_feature: GYAE6OF01CNMZC.10.64.F09.1.454.CMB.1.raw
  modified_base (204)..(204): a, c, t, g, unknown or other
  misc_feature (204)..(204): n is a, c, g, or t
  modified_base (313)..(313): a, c, t, g, unknown or other
  misc_feature (313)..(313): n is a, c, g, or t
tcagcatagtagtgcacgaccggtgctcgatttagcgcgtatacaagggggaggaactgctcagtcaggacccagagggaccatggaacgccccagctcagcgtctcttcctcctgctactctggcctccagatactaaccgccggaataaattgtgttgacacagtctccagcctaccctgttctttgctaccgaggggaaancgaccaccctctcctgcgaggccagtcagtagtgttagctaacttaattcgtcgtacggtaaccaaagaacgtaaacctcggccacggtacctcccgaggcctccgtanactcgtatgacgtgacctacgtaccgaaggacggaccacgtcggacctactcccgaacgtccgtaccggttgacggtcggacggtacgggttcgggtcgtagggaacctacggtaccttacaccgttactacctacccgtagtcccaccgggtaccctacgtacccgttagtaaaccgttagttttacgaacgttttaacgtttaacgttaccgttacgtacgtaccgtacggtaacggtacgtaacggtaccgtaacggtcccgtttaacccgccccccgtttaccttaccccgttacccgttaacccgggtttccggggaaaccggggtacccgggtaaaacggtacgggtaaccgggtaacgttaaaccggaacccggtaaaaccggttaggttaacccgggttcgaaccccgtttcgggaacccttaaccgttaaccggttccgtttacgttcccgtttaacccggttaccccg

SEQ ID NO: 63007 - DNA, 796 bp, Homo sapiens
  misc_feature: GYAE6OF01CG6QU.10.64.F09.1.454.CMB.1.raw
tcagcatagtagtgcacgaccggtgctcgatttagcgcgtatacaagggggaggaactgctcagtcaggacccagagggaaccatggaagccccagctcagcgtctcttcctcctgctactctggctccagatataaccgccggagaaattgtgttgacacagtctccagccaccctgttctttgtctccgaggggaaagacgcccaccctctcctgcacgggccagtcagagttgttagcaacttaacttagtctacggtaaccaaacaacgaaaaccgtggacccgaacgggcctaccccgaaggtccttcctacctactcttatgaatcgaccacgtccgaacggacgggccctaacgtcgggacctaccgtccccgaacggtcccgtaagggtttaccaagggtcggtaccgtaggggttcggggtacgtacggggactaacgtaccgttacctaaccttccgtaccgaaccctacgtacccggtaacccgggtaccccttaacggtaaccccgtttaaggtaaaaccttttcgttttacggaaccgtttaaggtttttaaacttccgttacgtaacgtaacgtccgtagggacttacggacgacgggttcccgtcccggttacccccttccgttaccccgttcggttaaccgtttaccgggggacggtaaccgggtaaacgtaggggttaacggaacgtaaccgtaaaccggtaaaccggttagtcggggtaccggtaccttacggaccttaaccggttacgttcgtttacggttcctttacccgtacccg

SEQ ID NO: 63008 - DNA, 764 bp, Homo sapiens
  misc_feature: GYAE6OF01EAT9G.10.64.F09.1.454.CMB.1.raw
tcagcatagtagtgcacgaccggtgctcgatttagcgcgtatacaagggggaggaactgctcagtcaggacccagagggaaccatggaagccccagctcagcgtctcttcctcctgctactctggctccagatataaccgccggagtaaattgtgttgacacagtcctccacgccctacccttgttcttttcgtctaccgaaggggaaagcgcccaccctctcctgcgacgggccagtcaggtagtgttacgactaacttaacttagtcgtacggtaaccaaacgaacgaaacccgtggacccaacgggcccttaccccgaggtccttcccttctacttacctagttaggaattcgacctaacgtcccgaacggggacggcccaacgttggaccctacctccccgaagtccgtacgggttccaagggtcggacgtagggtcgggtcgtgggactacgtaccttcaccgtctacacctacctccgacccggtcctaacgtacccgtaagtaacgtttacgtttcgtacgtttaagttttacgttacctaggtaccacggtctacgtacggtacgccgacccgggtccccgtccccctccgtccccttccgttaccgggtttccggggaacggggtaccgggtaaccggtaacgggtacgggtaacgtaccgttaaaaccggaaaccggtacggttacggtacggtcccgtacggaccctaacgttaccgttctttaccgtttcccttccgttaccgttccccccg

SEQ ID NO: 63009 - DNA, 498 bp, Homo sapiens
  misc_feature: GYAE6OF02FSJ6X.10.64.F09.1.454.CMB.1.raw
  modified_base (199)..(199): a, c, t, g, unknown or other
  misc_feature (199)..(199): n is a, c, g, or t
  modified_base (495)..(495): a, c, t, g, unknown or other
  misc_feature (495)..(495): n is a, c, g, or t
tcagcatagtagtgcacgaccggtgctcgatttagcgcgtatacaagggggaggaactgctcagtcaggacccagagggaaccatggaagccccagctcagcgtctcttcctcctgctactctggctcccagatataaccgccggagaaattgtgttgacacagtctccagccaccctgtctttgtctccaggggaaanagccaccctctcctgcagggccagtcagagtgttagcactaacttagtctggtaccaacagaaacctggccaggctcccaggctcctcatctatgatgcatccacgagggccactggcatcccagccaggttcagtggcagtgggtctgggacagacttcactctcaccatcaccgcctagaccctgaagtatttgctagtttattactgtcagcagcgtagcagctcggccctctccctcactttcggcgaggaccaggtgagatacgaaacgactgtggctgcacatctgtctntac

SEQ ID NO: 63010 - DNA, 499 bp, Homo sapiens
  misc_feature: GYAE6OF02F0ZX1.10.64.F09.1.454.CMB.1.raw
tcagcatagtagtgcacgaccggtgctcgatttagcgcgtatacaaggggaggaactgctcagtcaggacccagagggaaccatggaagccccagctcagcgtctcttcctcctgctactctggctcccagatataaccgccggagaaattgtgttgacacagtctccagccaccctgtctttgtctccaggggaaagagccaccctctcctgcagggccagtcagagtgttagcactaacttagtctggtaccaacagaaacctggccaggctcccaggctctcatctatgatgcatccacgagggccactggcatcccagccaggttcagtggcagtgggtctgggacagacttcactctcaccatcaccggcctagaccctgaagattttgctagtttattactgtcagcagcgtagcagctggccctctccctcactttcggcgagggaccaaggtggagatcgaaacgaactgtgctgcacatctgtcttctac

SEQ ID NO: 63011 - DNA, 516 bp, Homo sapiens
  misc_feature: GYAE6OF02FVHHW.10.64.F09.1.454.CMB.1.raw
  modified_base (199)..(199): a, c, t, g, unknown or other
  misc_feature (199)..(199): n is a, c, g, or t
  modified_base (208)..(208): a, c, t, g, unknown or other
  misc_feature (208)..(208): n is a, c, g, or t
tcagcatagtagtgcacgaccggtgctcgatttagcgcgtatacaagggggaggaactgctcagtcaggacccagagggaaccatggaagccccagctcagcgtctcttcctcctgctactctggctcccagatataaccgccggagaaattgtgttgacacagtctccagccaccctgtctttgtctccaggggaaangccaccctntcctgcagggccagtcagagtgttagcactaacttagtctggtaccaacagaaacctggccaggctcccaggctcctcatctatgatgcatccagagggccactggcatcccagccaggttcagtggcaggtgggtctggggacagacttcactctcaccatccaccggcctagaccctgaagtattttgctagtttacttactgtcagcagcgtagcagctcggcccctctccctctacgtttcggcggacgggaccaagggtcggagagtacgaaacgactgtggctgcaccagtctgtcttctac

SEQ ID NO: 63012 - DNA, 503 bp, Homo sapiens
  misc_feature: GYAE6OF02IF9OL.10.64.F09.1.454.CMB.1.raw
  modified_base (198)..(198): a, c, t, g, unknown or other
  misc_feature (198)..(198): n is a, c, g, or t
  modified_base (206)..(206): a, c, t, g, unknown or other
  misc_feature (206)..(206): n is a, c, g, or t
  modified_base (253)..(253): a, c, t, g, unknown or other
  misc_feature (253)..(253): n is a, c, g, or t
  modified_base (299)..(299): a, c, t, g, unknown or other
  misc_feature (299)..(299): n is a, c, g, or t
tcagcatagtagtgcacgaccggtgctcgatttagcgcgtatacaagggggaggaactgctcagtcaggacccagagggaaccatggaagccccagctcagcgtctcttcctcctgctactctggctcccagatataaccgccggagaaattgtgttgacacagtctccagccaccctgtctttgctccaggggaaangccacctntcctgcagggccagtcagagtgttagcactaacttgctggtaccaangaaacctggccaggctccagctcctcatctatgatgcatccacggngggccagtggcactcccagccaggttcagtgcagtggctggacagacttcactctcacatcgaccgctacgaccctgaagtatttgctagtttattactgtcagcagcgtagcagctcgccctctcctctacgttcggcggacggaccgaaggtgagactacgaaacgacgtggtgctgccacctaccgtgtcttccattcccg

SEQ ID NO: 63013 - DNA, 501 bp, Homo sapiens
  misc_feature: GYAE6OF02GKX6O.10.64.F09.1.454.CMB.1.raw
  modified_base (199)..(199): a, c, t, g, unknown or other
  misc_feature (199)..(199): n is a, c, g, or t
tcagcatagtagtgcacgaccggtgctcgatttagcgcgtatacaagggggaggaactgctcagtcaggacccagagggaaccatggaagccccagctcagcgtctcttcctcctgctactctggctcccagatataaccgccggagaaattgtgttgacacagtctccagccaccctgtctttgtctccaggggaaanagccaccctctcctgcagggccagtcagagtgttagcactaacttagtctggtaccaacagaaacctggccaggctcccaggctcctcatctatgatgcatccacgagggccactggcatcccagccaggttcagtgcagtggtctgggacagacttcactctcaccatcaccggcctacgaccctgaagtattttgctagtttattactgtcagcagcgtagcagctcggcccctctccctctactttcggcggacggacaaatgagtacaacgactgtgctgcacatctgtcttcattcc

SEQ ID NO: 63014 - DNA, 586 bp, Homo sapiens
  misc_feature: GYAE6OF02HW7X4.10.64.F09.1.454.CMB.1.raw
  modified_base (260)..(260): a, c, t, g, unknown or other
  misc_feature (260)..(260): n is a, c, g, or t
  modified_base (288)..(288): a, c, t, g, unknown or other
  misc_feature (288)..(288): n is a, c, g, or t
  modified_base (352)..(352): a, c, t, g, unknown or other
  misc_feature (352)..(352): n is a, c, g, or t
  modified_base (369)..(369): a, c, t, g, unknown or other
  misc_feature (369)..(369): n is a, c, g, or t
tcagcatagtagtgcacgaccggtgctcgatttagcgcgtatacaagggggaggaactgctcagtcaggacccagagggaaccatggaagccccagctcagcgtctcttcctcctgctactctggctcccagatataaccgccggagaaattgtgttgacacagtctccagcccaccctgtctttgtctccgaggggaaagagccaccctctcctgcagggccagtcagagtgttagcactaacttagtctggtaccaanagaaacctggccaggctcccaggctccncatctatgatgcatccaggacggccacgtggcactcccagccaggttcagtggcaggtgggtcngggacagacttcactcncaccatcagcagcctaagacgcctagtaagtatttgactagtttattactgtcagcagtcgtcgtcctacgtttcgggacggtacggtcgtaccgtacggtttcggacggggtaacgggtaaccgtaaaaggttaggtaacgggtaaccgtaaaaccggtaaacgtgggttacggtacgtcggaccgtaaccgtaactccgttacgttaccgttacg

SEQ ID NO: 63015 - DNA, 571 bp, Homo sapiens
  misc_feature: GYAE6OF02GZPX4.10.64.F09.1.454.CMB.1.raw
  modified_base (197)..(197): a, c, t, g, unknown or other
  misc_feature (197)..(197): n is a, c, g, or t
  modified_base (205)..(205): a, c, t, g, unknown or other
  misc_feature (205)..(205): n is a, c, g, or t
  modified_base (251)..(251): a, c, t, g, unknown or other
  misc_feature (251)..(251): n is a, c, g, or t
  modified_base (343)..(343): a, c, t, g, unknown or other
  misc_feature (343)..(343): n is a, c, g, or t
tcagcatagtagtgcacgaccggtgctcgatttagcgcgtatacaagggggaggaactgctcagtcaggacccagagggaaccatggaagccccagctcagcgtctcttcctcctgctactctggctcccagatataaccgccggagaaattgtgttgacacagtctccagccacctgtctttgtctccaggggaangccacctntcctgcagggccagtcagagtgtagcactaattgtctggtaccaanagaaacctggaccaggctcccaggcctcctcatctatgatcgcatccgagacggccacgtggcagtcccagccaggtcagtcgcagtggtcnggaacagtagtcactctcacatcgagcgctgctagtcgtagagtagtttgacttagtttattacgttgtacagtactaagtataagtggtacgttttagggttttacttccgttaccgtttccggtcccgttagggtaacctaaagggttcggttacgtttacgtaacggtaacgtaacgttggtcggtacttaggaccgtacctagttcgttacttccgtattaccg

SEQ ID NO: 63016 - DNA, 663 bp, Homo sapiens
  misc_feature: GYAE6OF02HMF46.10.64.F09.1.454.CMB.1.raw
  modified_base (200)..(200): a, c, t, g, unknown or other
  misc_feature (200)..(200): n is a, c, g, or t
tcagcatagtagtgcacgaccggtgctcgatttagcgcgtatacaagggggaggaactgctcagtcaggacccagagggaaccatggaagccccagctcagcgtctcttcctcctgctactctggctcccagatataaccgccggagaaattgtgttgacacagtctccagccaccctgtctttgtctccaggggaaagngccacctctcctgcagggccagtcagagtgttagcactaacttagtctggtaccaacagaacctggccaggctccaggctcctcatctatgatgcatccacggagggccacgtggcactcccagcccgtaggttccaggtggcagggttcggggtctggggacaggtacctttcgaaccttcctccaccctagtacccgaacccggtaccctacgtacccgtaggtaaacggttacttttacggtacttaggttttaacttacgttacggtcgtacggtccgtacggtacgtacgcgacggtcctccgggtcccccttccgtccccgttaccgttaccggttttcccggggacggggtaccgggacccggtaaggggtacgggacggtaacgtacgaaaccggtaacgttcggtacggaccgtacggacctaccgtacgttccgttcgttaccttcgttaccg

SEQ ID NO: 63017 - DNA, 641 bp, Homo sapiens
  misc_feature: GYAE6OF02G2QIQ.10.64.F09.1.454.CMB.1.raw
  modified_base (201)..(201): a, c, t, g, unknown or other
  misc_feature (201)..(201): n is a, c, g, or t
tcagcatagtagtgcacgaccggtgctcgatttagcgcgtatacaagggggaggaactgctcagtcaggacccagagggaaccatggaagccccagctcagcgtctcttcctcctgctactctggctcccagatataaccgccggagaaattgtgttgacacagtctccagccaccctgtctttgtctccgaggggaaagngccaccctctcctgcagggccagtcagagtgtagctactaacttgtctggtaaccaacagaaacctggaccaggcctcccaggcctcctcattcttgattcgtctttacaacgacgggcccctggccgtcccgaggctaggttcaggtggctaggtcgggtctggggacagtacttcgactcctcgaaccatcgagccgagccctagacgtccgtggaaagtattttcggacttaagtttacttacgttgtacctagtccgaggtccgtcgtacccgttacggtttccgggcgggtacgggtacgtacccggtacgtttccggggaccgggtaacggtaaaccgaaaaggtaacggaaggtaccgtaaacggtaacgtggtacggcgttacgcctaacgtcgttcgttacgttccttacgtacccttccgtcccgtaccg

SEQ ID NO: 63018 - DNA, 599 bp, Homo sapiens
  misc_feature: GYAE6OF02FTR7I.10.64.F09.1.454.CMB.1.raw
  modified_base (199)..(199): a, c, t, g, unknown or other
  misc_feature (199)..(199): n is a, c, g, or t
  modified_base (392)..(392): a, c, t, g, unknown or other
  misc_feature (392)..(392): n is a, c, g, or t
  modified_base (400)..(400): a, c, t, g, unknown or other
  misc_feature (400)..(400): n is a, c, g, or t
tcagcatagtagtgcacgaccggtgctcgatttagcgcgtatacaagggggaggaactgctcagtcaggacccagagggaaccatggaagccccagctcagcgtctcttcctcctgctactctggctcccagatataaccgccggagaaattgtgttgacacagtctccagccaccctgtctttgtctccaggggaaanagccaccctctcctgcagggccagtcagaatattgctaccaacttgcctggtatcaacaaaagcctggccaggctcccagacctcctcatctctggtgcatccgttcgagggcccacgtggtcgtccccaggcctaggttcaggtggcaggtgggtctggaacagtagttcactctcaccatcagcgcctgcngtctgatntttgctagtttattacgtgtacagtcaagttaataacgttgtacgtttgggtttttactttcgttacgttttccggtacccgttacgggtaacctaaaggttcgggtaacttttacggaaggtaacgtaacgttgggttacgggtccttacggaccctaccgtacttaccgtttggttcccttttacacgtttaccccg

SEQ ID NO: 63019 - DNA, 663 bp, Homo sapiens
  misc_feature: GYAE6OF02I86A5.10.64.F09.1.454.CMB.1.raw
  modified_base (198)..(198): a, c, t, g, unknown or other
  misc_feature (198)..(198): n is a, c, g, or t
  modified_base (207)..(207): a, c, t, g, unknown or other
  misc_feature (207)..(207): n is a, c, g, or t
  modified_base (413)..(413): a, c, t, g, unknown or other
  misc_feature (413)..(413): n is a, c, g, or t
tcagcatagtagtgcacgaccggtgctcgatttagcgcgtatacaaggggaggaactgctcagtcaggaccagagggaaccatggaagccccagctcagcgtctcttcctcctgctactctggctcccagatataaccgccggagaaattgtgttgacacagtctccagccaccctgtctttgtctccaggggaaagngccaccctncctgccagggccagtcagatagttagcactaacttatctaggtacccaaactagaaacctggaccaggcctaccccgacggcctccgtctactctactcgtagtcgcacttccgaacgtacggggccacgtcggcactcccagccgtacgtcgtagtcggcaggttacgggtctacggggacacgtaacctttcgaaccgttaccncccgtaaccctgtacccgaacccggcccgtaacgtaccccgttaggaaacgttacgtttacgtacttacgtttaatttacgttcgtactaagtcgacggttacgtacggctacgacgttccggccccttcctaccccgtctacccgttttcgggaccggtacggtaacccgaacgggttcggagtacgttacgaaaccggtactaggtccggtacgtcgtacgactacgttacgtcgtactttccgtacg

SEQ ID NO: 63020 - DNA, 596 bp, Homo sapiens
  misc_feature: GYAE6OF02G2X3E.10.64.F09.1.454.CMB.1.raw
  modified_base (196)..(196): a, c, t, g, unknown or other
  misc_feature (196)..(196): n is a, c, g, or t
  modified_base (433)..(433): a, c, t, g, unknown or other
  misc_feature (433)..(433): n is a, c, g, or t
tcagcatagtagtgcacgaccggtgctcgatttagcgcgtatacaagggggaggaactgctcagtcaggacccagagggaaccatggaagccccagctcagcgtctcttcctcctgctactctggctcccagacaacactgcagaaatagttatgacgcagtctccagcccaccctgtctgtgtctccgagggganagagccaccctctcctgcagggccgtcagaatatgctaccaacttgcctggtatcaacaaagcctggccaggcctcccagacctcctcactctcgtggtgcattcgttcgacgggccacgtggtcgtcccagccgtacggttcaggtggactaggttcgggtacgtaggaactaggtacgttcacgttcctaccaacctatccacggccggaccgttgctaggtcttaggaacgttnttttcgacttagtttattacttcgtactagtactagtagtaagttgtacgtttggtttttaactcgttaccgtttccggaccgtacgggtaacgtaagttcggttatttacgaacggtacgtaacgttggtacggcgtcgactaccgtattcgtagttcttac

SEQ ID NO: 63021 - DNA, 609 bp, Homo sapiens
  misc_feature: GYAE6OF02FPXZW.10.64.F09.1.454.CMB.1.raw
  modified_base (199)..(199): a, c, t, g, unknown or other
  misc_feature (199)..(199): n is a, c, g, or t
  modified_base (208)..(208): a, c, t, g, unknown or other
  misc_feature (208)..(208): n is a, c, g, or t
  modified_base (228)..(228): a, c, t, g, unknown or other
  misc_feature (228)..(228): n is a, c, g, or t
  modified_base (257)..(257): a, c, t, g, unknown or other
  misc_feature (257)..(257): n is a, c, g, or t
tcagcatagtagtgcacgaccggtgctcgatttagcgcgtatacaagggggaggaactgctcagtcaggacccagagggaaccatggaagccccagctcagcgtctcttcctcctgctactctggctcccagatataaccgccggagaaattgtgttgacacagtctccagccaccctgtctttgtctccaggggaaangccaccctntcctgcgagggccagtcagngtgttagcactaacttgtctggtaccaanagaaacctggccaggctcccaggctcctcactctatgatgtatccagccggccactggctccagccgagtcagtggcagtgggtctgggcagacttcactcacgacatcagcacgtcctaagacgtcctagaaacgttgttttaggtacggtttaattaccgtgttacgagtcacgtcggtcgaccgtacgtcggccgttcgtccggtttcccgtttccggcccgttacgggaacccgtaaaggtcgggtaacttaacgttaccgaaaaccggtacgttcgggtacggtaccgtacggtccgtaaccctattccgttccgtttaccttaccgtacttcccgtttaccccccg

SEQ ID NO: 63022 - DNA, 710 bp, Homo sapiens
  misc_feature: GYAE6OF02IH4GV.10.64.F09.1.454.CMB.1.raw
  modified_base (201)..(201): a, c, t, g, unknown or other
  misc_feature (201)..(201): n is a, c, g, or t
  modified_base (264)..(264): a, c, t, g, unknown or other
  misc_feature (264)..(264): n is a, c, g, or t
  modified_base (299)..(299): a, c, t, g, unknown or other
  misc_feature (299)..(299): n is a, c, g, or t
tcagcatagtagtgcacgaccggtgctcgatttagcgcgtatacaaggggggaggaactgctcagtcaggacccagagggaaccatggaagccccagctcagcgtctcttcctcctgctactctggctcccagatataaccgccggagaaattgtgttgacactagtctccagccaccctgtctttgtctccaaggggaanagccacctctcctgcacggcagtcagacgtgttacgcaacttaacttgtcgtaggtacccaanagaaacctggccacggctcccgaggtcctccctanactctatgactcgactacgtacccgaacggtacggccacgtcggactaaccgtccacgtccgaggttccaacggcggtaccggtaggttcgggtccgtcggggtaactacgggtaaccttccgtaactcccgttaccaaccctacgtacccgaccggtcctaaccggtacctacgtaagtacgtttagacctttagtttacgttacgttcgtcgaacgtcggtaacgtccggtacctccgttaaccggttccgggtacggtacgggttccgtaccgtttaccgggtttccgggacccgggttaacggaaaccgttaaaaggaaccgtaacggtaccaaaccggtaaccggtaggtccggtacgtcgaccaaccgttcgtaacgttcgtccttactccgttaccgtaccccg

SEQ ID NO: 63023 - DNA, 653 bp, Homo sapiens
  misc_feature: GYAE6OF02G7LH8.10.64.F09.1.454.CMB.1.raw
  modified_base (167)..(167): a, c, t, g, unknown or other
  misc_feature (167)..(167): n is a, c, g, or t
  modified_base (204)..(204): a, c, t, g, unknown or other
  misc_feature (204)..(204): n is a, c, g, or t
  modified_base (306)..(306): a, c, t, g, unknown or other
  misc_feature (306)..(306): n is a, c, g, or t
  modified_base (341)..(341): a, c, t, g, unknown or other
  misc_feature (341)..(341): n is a, c, g, or t
  modified_base (358)..(358): a, c, t, g, unknown or other
  misc_feature (358)..(358): n is a, c, g, or t
  modified_base (366)..(366): a, c, t, g, unknown or other
  misc_feature (366)..(366): n is a, c, g, or t
tcagcatagtagtgcacgaccggtgctcgatttagcgcgtatacaagggggaggaactgctcagtcaggacccagagggaaccatggaagccccagctcagcgtctcttcctcctgctactctggctcccagatataacccgccggaagaaatttcgtgttgacacngtctccagccaccctgtctttgtctccgaaggggaanacgcccaccctctccgtgccaggccagtcagagtgtagcacttaactagtcgtgtaacacgataacctggaccgtacgcctccgagtcctcctcattcttanatcgtcttaccgacgtacggccctacggcctccgnggtaccgtggttaccgnggtccggngtacggtcggtcgtacgggaaccgtgttaccgttactacccttactaccgtacacgtacgacgcagtaccgtagacgtctacgtagtatttgacttagttactacgtgtacgtgtcgcgtcgtcgccgttcggttccggacgtacggtacgtaccggttacggttccgggacggtaaccgggtaaacgtaaaggtagggtaacgtaaccggtaacgtacggtcgggtcgaacgtcggtaccaccgtacgttacttcgttacccttacgtccttaccgtacccctacg

SEQ ID NO: 63024 - DNA, 786 bp, Homo sapiens
  misc_feature: GYAE6OF02H0J8M.10.64.F09.1.454.CMB.1.raw
tcagcatagtagtgcacgaccggtgctcgatttagcgcgtatacaaggggggaggaactgctcagtcaggacccagagggaaccatgggaagccccagctcagcgtctcttcctcctgctactctggcctccagatactaacccgccggagaaattgtgttagacacagtctccacgcctaccctgttcttttcgtcctccgaagggggaacgacgcccaccctctccgtgcgacggccagtcaggtagtgttagcctaacttaacttagtacctacggtaaccaacaacgtaaaccgtcggaccgacggcctacccgacggtcctacctacgtacttctactgagttcgactacgtacccgacgggaccggtaccgtaccgtcggaccgtacctaccccgaacggaccggtacgggttacgtacgggtcggtacggtacggggtttacggggttcgtacgggacccggtaacgtacggttacccgttaccgtaaccgttaccctaccgtaacctacgttaccgaaccgtaaccgtaccgtaaaccgtaacgttaacgtaacgttacgttttaccgtcgtttaactttttacgtttacgttacggttacctaccgtacgtacgtaccggtaccgtaccgttccggtacccgtaccggttaccggtaccgggtacccgggacggggttaaccggtacgggtaggacggtacgtacgaacgtaacggaacgtggttcggcgttaccgactacccgtctaccgttccgttacgttcctaccgttccccg

SEQ ID NO: 63025 - DNA, 705 bp, Homo sapiens
  misc_feature: GYAE6OF02IFLU0.10.64.F09.1.454.CMB.1.raw
  modified_base (208)..(208): a, c, t, g, unknown or other
  misc_feature (208)..(208): n is a, c, g, or t
  modified_base (369)..(369): a, c, t, g, unknown or other
  misc_feature (369)..(369): n is a, c, g, or t
  modified_base (674)..(674): a, c, t, g, unknown or other
  misc_feature (674)..(674): n is a, c, g, or t
  modified_base (700)..(700): a, c, t, g, unknown or other
  misc_feature (700)..(700): n is a, c, g, or t
tcagcatagtagtgcacgaccggtgctcgatttagcgcgtatacaagggggaggaactgctcagtcaggacccagagggaaccatggaagccccagctcagcgtctcttcctcctgctactctggcctcccagataacgtaccgccggaagaaattgtgttgacacagtctccagcccacctgttcctttgtcctccgaaggggaaancgccctacctctcctggcacgggccagtcgagagttgttagctaacttaacttacgtcgtggtaaccaagacgaaaccgtggaccgaggcctaccgacgtctccctcgaacttactcgtagacgttcgctaacgtaccgaacgggtaccggccctaacggnggtacctaccttcccgaacgcccgtaaggtttaccaaggtccggaccgtagggtacgggttccgtaaggggactaacggtaccttacccacttaccgtacgacccttacgcccgaacccggtacgtaccgacccggttagtaaacgtttgtttacgtacgtttacggtttaacttacctcggtacgtacgtagtaccggacgttacgacgtacgtccgtcccgggtcccctccgtccctcgttaccggtcgggaccggacgggtaacgtacggagtacgacgttaaccgaacgtacgtcggtacncgtcgaccgacttgtcgtctaccgtntaccg

SEQ ID NO: 63026 - DNA, 714 bp, Homo sapiens
  misc_feature: GYAE6OF02HQJ0P.10.64.F09.1.454.CMB.1.raw
tcagcatagtagtgcacgaccggtgctcgatttagcgcgtatacaagggggaggaactgctcagtcaggacccagagggaaccatggaagcccccagctcagcgtctcttcctcctgctactctggctcccagatataaccgccggagaaattgtgttgacacagtctccagccaccctgtctttgtctccgaggggaaagacgcccaccctctcctgcgacgggccagtcagagtgttagcactaacttagtctggaccaacagaaaccgtggccaaggctacccacggctcctcatctatgatgcactccaacggacggccacgtggaccactcccagcctaggttaccagtcggcaggtcgggtcgtgggaacagtaccgttacaccttactaccgtaaccactacccgtacccggaccgttaaaccgaaccccgttagggtaaaacgttacgtttttacgaccgtttaaacgttttaacgttacctacggtactaacggacctaggtaccggttagggaccgtaacggtccgtacccggtacccccttaccgttccccttaccgttacccggttttccggggaccggggtaaaacgggtaaccccgtaaagggggttcgaacggtaactaacccggaaaacggtaaccgttgggtacggtaccgtagacccgaaccgtagtttcccgttaacgttcctttacgtaacccg

SEQ ID NO: 63027 - DNA, 889 bp, Homo sapiens
  misc_feature: GYAE6OF02F023K.10.64.F09.1.454.CMB.1.raw
  modified_base (196)..(196): a, c, t, g, unknown or other
  misc_feature (196)..(196): n is a, c, g, or t
tcagcatagtagtgcacgaccggtgctcgatttagcgcgtatacaagggggaggaactgctcagtcaggacccagagggaaccatggaagccccagctcagcgtctcttcctcctgctactctggctcccagatataaccgccggagaattgtgtgacacagtctccagccacctgtctttgtctccgaggggaancgccaccctctccgtgcgacgggccagtcaggtagtagtagacctacgttaacttaggtcctaggtaacccaaacgaacgtaaacccgtggaccgacggccttaccccgacggtccttccctactacgttaccgtagttagtacgtcgaaccgtactaccccggaacgggaccgggtcccgtaacgtcgggaccttacccgtacccacggtacccggtacggttacgacggttacggactacggggtagggttccgtagggaccgtaacggttcctaccaccttacggttcccaaccgttaccgaccccgacccggggtaaccctaaccggtacccttaaacggtacgtttacgttttaccggacgttttaacgttttaacgttacgtaccggtttacgaaccgttaccggacgggttaaccgttaacggaccttaccgggtcccggtttaaccccccggttccccgttacctttaacccccgttccggttttaaccggggtttcccgggggggaaccggttaaaccggggtaaaccgggtaacgggtttaccgggaagtttaacccccgggaaaaccgtttaaaacccggggtacggttttccgggggaacccgttaggttaaccccgggtaccttacccgtttaccggtcccgggttttacggtttcccccttaacgttttacccccccgg

SEQ ID NO: 63028 - DNA, 531 bp, Homo sapiens
  misc_feature: GYAE6OF02GWMJT.10.64.F09.1.454.CMB.1.raw
  modified_base (198)..(198): a, c, t, g, unknown or other
  misc_feature (198)..(198): n is a, c, g, or t
tcagcatagtagtgcacgaccggtgctcgatttagcgcgtatacaagggggaggaactgctcagtcaggacccagagggaaccatggaagccccagctcagcgtctcttcctcctgctactctggctcccagatataaccgccggagaaattgtgttgacacagtctccagccacctgtctttgtctccaggggaaangccacctctcctgcagggccagtcagagtgttagcactaacttagctggtaccaacagaaacctggccaggctccaggctcctcatctatgatgcatccacgagggccactggcatcccagccaggttcagtgcagtgggtctgggacagacttcacttctacaccatccaccggcctagaccctgaacgtatttgctagtttattactgtacagtacagccgtagcacgctcggtaccccttcgtccccttctaccgtttcggccggtacgggaccaagggtcggagactacgaacgtactagtcggtctagccacagtctcgttctctacg

SEQ ID NO: 63029 - DNA, 1002 bp, Homo sapiens
  misc_feature: GYAE6OF02FLR2J.10.64.F09.1.454.CMB.1.raw
  modified_base (197)..(197): a, c, t, g, unknown or other
  misc_feature (197)..(197): n is a, c, g, or t
tcagcatagtagtgcacgaccggtgctcgatttagcgcgtatacaagggggaggaactgctcagtcaggacccagagggaaccatggaagccccagctcagcgtctcttcctcctgctactctggctcccagatataaccgccggagaaattcgtgttgacacagtctcagccacctgtcttgtctacgagggtaancgccacctactcctgcaggccagtcagtagtgttacgactactaacttgtactcgggtaaccaactaacgaaccgtggaccaggctaccacggcctctcgatctatgacgtcgactacgcccgtacggacgggtccaaccgtcgggactacggtccccgtaacgtaccccgtaagggtttaccgaacgggtacggtccgtaaacggggtttcggggttaaccgtacgggggtaaaaccgtacggttaaacccgttttaccggtaaaccctttacccggttacccgtaaaaccccgttaaccgggtttaacccggaaccccggggtttaaccccggtttaaaaccgggtaacccccggtttaacgggttaaaaccgggtttaacggtttttaccggtaccggttttaaacgggtttttaaccggttttaacccgtttaacgggtttaccggttaacggttaaccggttaaacggttaccgggttaaccggtaacccggttacccggttaacccgttaccccgggggttacccccctttacccggttttaccccgtttacccggtttaaccccgggttttacccgggggtaaacccggggttaccgggttaaaaccccgggttaagggggtaacccgggttaacccgggtaacccgggtttaaacccgggtaaaaaccggtttaacccgggttaaccgggttaaccggggttaacccggttaacccgggtttaaccggtaacccgtttaacccgggttaaccggtttaaccggtttttaccccggtaacccgttttaacccccgggg

SEQ ID NO: 63030 - DNA, 513 bp, Homo sapiens
  misc_feature: GYAE6OF01DFASF.35.64.F09.1.454.CMB.1.raw
tcagtacagatcgtcacgaccggtgctcgatttagcgcgtatacaagggggagtcagacccagtcaggacacagcatggacatgagggtccccgctcagctcctggggctcctgctgctctggctcccaggtgccaaatgtgacatccagatgacccagtctccctccaccctgtctgcatctgtaggagacagagtcactattacttgtcgggcagtgagagtataagtagttggttggcctggtatcagcagaaaccagggaagcccctagactcctgatgtatagggcgtctgttctacaaatgggtcccacaaggttcagcggcagtggatcgtgggacagaatcactctcaccatcagtagcctgcagcctgatgactttgactaactattactgaccaacattacagtctactttatttctcgtttcggcgggaggacctaaggtggaacagtcagacgaactggtggctgacctaccattctagttccttctattccgttaccccg

SEQ ID NO: 63031 - DNA, 504 bp, Homo sapiens
  misc_feature: GYAE6OF01AXQ54.35.64.F09.1.454.CMB.1.raw
  modified_base (493)..(493): a, c, t, g, unknown or other
  misc_feature (493)..(493): n is a, c, g, or t
tcagtacagatcgtcacgaccggtgctcgatttagcgcgtatacaagggggagtcagacccagtcaggacacagcatggacatgagggtccccgctcagctcctggggctcctgctgctctggctcccaggtgccaaatgtgacatccagatgacccagtctccctccaccctgtctgcatctgtaggagacagagtcactattacttgtcgggccagtgagagtataagtagttggttggcctggtatcagcagaaaccagggaagcccctagactcctgatgtatagggcgtctgttctacaaagtggggtcccacaaggttcagcggcagtgatcgtgggacagattcactctcacatcagtagcctgcagcctgatgactttgactaacctattactcgaccaactattacagtctacttatttctcgtttcgggcggtaggtacaaggtgacatacagacgtaacgtgtgctgcaccatctgtcttcncttccgtcccg

SEQ ID NO: 63032 - DNA, 501 bp, Homo sapiens
  misc_feature: GYAE6OF01BZDOX.35.64.F09.1.454.CMB.1.raw
  modified_base (372)..(372): a, c, t, g, unknown or other
  misc_feature (372)..(372): n is a, c, g, or t
  modified_base (460)..(460): a, c, t, g, unknown or other
  misc_feature (460)..(460): n is a, c, g, or t
  modified_base (492)..(492): a, c, t, g, unknown or other
  misc_feature (492)..(492): n is a, c, g, or t
tcagtacagatcgtcacgaccggtgctcgatttagcgcgtatacaagggggagtcagacccagtcaggacacagcatggacatgagggtccccgctcagctcctggggctcctgctgctctggctcccaggtgccaaatgtgacatccagatgacccagtctccctccaccctgtctgcatctgtaggagacagagtcactattacttgtcgggccagtgagagtataagtagttggttggcctggtatcagcagaaaccagggaaagcccctagactcctgatgtatagggcgtctgttctacaaaatcggggtcccacaaggttcagcggcagtggatcgtgggacagaattcactctcaccatcagtancctgcagcctgatgactttgactaaccttattactgaccaacattacatctacttatttctcgtttcggcggaggaccaaggtggacntcagacaacgtgtggctgcacatctgtcttcnctctccccg

SEQ ID NO: 63033 - DNA, 512 bp, Homo sapiens
  misc_feature: GYAE6OF01C180C.35.64.F09.1.454.CMB.1.raw
  modified_base (502)..(502): a, c, t, g, unknown or other
  misc_feature (502)..(502): n is a, c, g, or t
tcagtacagatcgtcacgaccggtgctcgatttagcgcgtatacaagggggagtcagacccagtcaggacacagcatggacatgagggtccccgctcagctcctggggctcctgctgctctggctcccaggtgccaaatgtgacatccagatgacccagtctccctccaccctgtctgcatctgtaggagacagagtcactattacttgtcgggccagtgagagtataagtagttggttggctggtatcagcagaaaccagggaaagcccctagactcctgatgtatagggcgtctgttctacaaatgggtacccacaagttcagcgcagtgatcgtgggacagaattcactctcacatcagtagcctgcagcctgatgtactttgacaaccttattactcgaccaacatttacagtactactttaatttccttcgtttcgggcggagggacctaagggtgacatacagacgaacgtggtggactgacaccatctgtcttcnttcctacccg

SEQ ID NO: 63034 - DNA, 588 bp, Homo sapiens
  misc_feature: GYAE6OF01CZ12M.35.64.F09.1.454.CMB.1.raw
  modified_base (370)..(370): a, c, t, g, unknown or other
  misc_feature (370)..(370): n is a, c, g, or t
  modified_base (393)..(393): a, c, t, g, unknown or other
  misc_feature (393)..(393): n is a, c, g, or t
tcagtacagatcgtcacgaccggtgctcgatttagcgcgtatacaagggggagtcagacccagtcaggacacagcatggacatgagggtccccgctcagctcctggggctcctgctgctctggctcccaggtgccaaatgtgacatccagatgacccagtctccctccaccctgtctgcatctgtaggagacagagtcactattacttgtcgggccagtgagagtataagtagttggttggctggtatcagcagaaaccagggaaagccctagactcctgatgtatagggcgtctgttctacaaaatgggtacccacaagttcagcggcagtgatctgggacagattcactctcacatcagtagcctgcngcctgatgtactttgacaacctnttactgaccaactacttaacacgtactaacttttactttcctttccgttttcggggaccgggtaacggggtaacccgtaaggggttcgggaactaacgttaccgaaggtaccgtaaaccgttgggtacgggtcttacggaccctaacccaacgtttccttacggttcctttaccgtctttccccgttaccccccg

SEQ ID NO: 63035 - DNA, 570 bp, Homo sapiens
  misc_feature: GYAE6OF01DO3YV.35.64.F09.1.454.CMB.1.raw
  modified_base (266)..(266): a, c, t, g, unknown or other
  misc_feature (266)..(266): n is a, c, g, or t
  modified_base (277)..(277): a, c, t, g, unknown or other
  misc_feature (277)..(277): n is a, c, g, or t
  modified_base (537)..(537): a, c, t, g, unknown or other
  misc_feature (537)..(537): n is a, c, g, or t
tcagtacagatcgtcacgaccggtgctcgatttagcgcgtatacaagggggagtcagacccagtcaggacacagcatggacatgagggtccccgctcagctccgtggggctcctgctgctctggctcccaggtgccaaatgtgacatccagatcgacccagtcctccctccaccctgtctgcatctgtaggagacagagtcactattacgtgtcgggcagtgagagtatagtgtggttgctggtatcagcaagaaccgagggaacnccctagactcngatgtagtagggtctctgttactaacgaaagtcggggtacccaacgtaggttcaggcggactaggtggatcgtagggaacaagtaacttccgacttctacaacctatcgagtacgcctgcacgtcctagtatacgtactttacgactaaccttattactcgtaacccaatacttaacagtaccttaactttcgtttacctacggtttcgggacgggtaacggacgtaagggtagactagacgaacgacgtaacgtgtcgntcgacactatcgtcgtactctagtccctacccg

SEQ ID NO: 63036 - DNA, 575 bp, Homo sapiens
  misc_feature: GYAE6OF01BGDOM.35.64.F09.1.454.CMB.1.raw
tcagtacagatcgtcacgaccggtgctcgatttagcgcgtatacaagggggagtcagacccagtcaggacacagcatggacatgagggtccccgctcagctcctggggctcctgctgtctctggctcccaggtgccaaatgtgacatccagatgacccagtctccctccaccctgtctgcatctgtaggagacagagtcactattacttgtcgggccagtgagagtataagtagttggtggcctggtatcagcagaaaccagggaaagcccctagactcctgatgtagtagggcgtctgttctaacaaaagtcggggtcccacaaggttcagcggcagtggatctgggacagaattcactctcacatcagtagcctgcagcctgatgactttgacaaccttattactgaccaactactttacagtacctatttactttcttccgttttcgggacgggtaacgggaccctaaggggtcggaacgtattcgaacggtaaccgtaaacgtggttgggaccttggaccctaacccgtattaccgttgttacccgtttctacgtttccccgttacccccg

SEQ ID NO: 63037 - DNA, 599 bp, Homo sapiens
  misc_feature: GYAE6OF01EIT5J.35.64.F09.1.454.CMB.1.raw
tcagtacagatcgtcacgaccggtgctcgatttagcgcgtatacaagggggagtcagacccagtcaggacacagcatggacatgagggtccccgctcagctcctggggctcctgctgctctggctcccaggtgccaaatgtgacatccagatgacccagtctccctccaccctgtctgcatctgtaggagacagagtcactattacttgtcgggccagtgagagtataagtagttggttgcctggtatcagcagaaaccgagggaaacgccctagactcctgatgtatagggcgtctgttactaacaaaagtcggggtacccaacgtaaggttcaggcggcaggtggatcgtgggacagaattcactctcacctatcagtacgcctgcagcctgatgtactttgacctaaccttattactacgacctaactacttacagtcctaactttattttcctacgtttcgggacgggtaacgggtacccgtaagggtcgaacgagttacgaaaggtaacccgtaaagtttcgggtagggtccgttcggaccctaacccgtagttacccttaggttaccctttctaacgttccccgttacccccg

SEQ ID NO: 63038 - DNA, 553 bp, Homo sapiens
  misc_feature: GYAE6OF01E293S.35.64.F09.1.454.CMB.1.raw
  modified_base (384)..(384): a, c, t, g, unknown or other
  misc_feature (384)..(384): n is a, c, g, or t
tcagtacagatcgtcacgaccggtgctcgatttagcgcgtatacaagggggagtcagacccagtcaggacacagcatggacatgagggtccccgctcagctcctggggctcctgctgctctggctcccaggtgccaaatgtgacatccagatgacccagtcctccctccaccctgtctgcatctgtaggagacagagtcactattacttgtcgggccagtgagagtataagtagttggttggcctggtatcagcaagaaaccagggaaacgcccctagactcctgatgtatagggcgtctgttactaacaaaagtcggggtacccaccgaaggttcagcggcaggtggatcgtgggacagtaattcgactctcaccatcagtancctgcagcctgatgtactttgacctaaaccttattaacctcgacctaaactattacacgtctactttctttcttcgtttcgggacgggtaggaccgtaagggtgacagtcaacggactaacgtggtaggctcgcacctattcttgttacttcctattcccgttaccccg

SEQ ID NO: 63039 - DNA, 533 bp, Homo sapiens
  misc_feature: GYAE6OF01EHUMO.35.64.F09.1.454.CMB.1.raw
  modified_base (268)..(268): a, c, t, g, unknown or other
  misc_feature (268)..(268): n is a, c, g, or t
tcagtacagatcgtcacgaccggtgctcgatttagcgcgtatacaagggggagtcagacccagtcaggacacagcatggacatgagggtccccgctcagctcctggggctcctgctgctctggctcccaggtgccaaatgtgacatccagatgacccagtctccctccaccctgtctgcatctgtaggagacagagtcactattacttgtcgggccagtgagagtataagtagttggttggcctggtatcagcagaaaccagggaaancccctagactcctgatgtatagggcgtctgttctaacaaaagtcggggtaccccacaaggttcaagcggcagtggatcgtgggacagaattcactctcacatcagtacgcctgcagcctgatgactttgctaaccttattactgaccctaatacttaacacgtctactttattttcctcgtttcgggacggaggtaccaaggtcggactatcagacgtaacgtggtggctggcctaccgattctagttccttcacttcctccccg

SEQ ID NO: 63040 - DNA, 592 bp, Homo sapiens
  misc_feature: GYAE6OF01DPGVR.35.64.F09.1.454.CMB.1.raw
  modified_base (407)..(407): a, c, t, g, unknown or other
  misc_feature (407)..(407): n is a, c, g, or t
tcagtacagatcgtcacgaccggtgctcgatttagcgcgtatacaagggggagtcagacccagtcaggacacagcatggacatgagggtccccgctcagctcctggggctcctgctgctctggctcccaggtgccaaatgtgacatccagatgacccagtctccctccaccctgtctgcatctgtaggagacagagtcactattactcgtcggccagtgagagtataagtagttggttggcctggtatcagcagaaaccgagggaaacgcccctagactcctgatgtagtagggctctgttactaacgaaaagtcggggtaccccaacgtaaggttcaaggccggacgaggtggatcgtagggaacagtaattcactctacaccatacagtacgcctgcagcctagntagtacttgactaaccttatactgaccctaatacttaacagtctaactttactttctcgtttcgggacggtaacgggtacgtaaggtcggaactagtacgaacggtaacgtaaccgttggtacggtcgttcggacctaaccctagttccgttcgttacctttcctaacgttcccgtttacccccg

SEQ ID NO: 63041 - DNA, 588 bp, Homo sapiens
  misc_feature: GYAE6OF01EW5V5.35.64.F09.1.454.CMB.1.raw
  modified_base (267)..(267): a, c, t, g, unknown or other
  misc_feature (267)..(267): n is a, c, g, or t
tcagtacagatcgtcacgaccggtgctcgatttagcgcgtatacaaggggggagtcagacccagtcaggacacagcatggacatgagggtccccgctcagctcctgggggctcctgctgctctggctcccaggtgccaaatgtgacatccagatgacccagtctccctccaccctgtctgcatctgtaggagacagagtcactattacttgtcgggcagtgagagtatagtagttggtggcctggtatcagcagaaaccagggaaanccctagactcctgatgtagtagggcgtctgttctaacaaagtggggtacccacaaggttcagcggcagtggatctggggacagaattcactctcaacatcagtacgcctgcagcctgactgactttgactaaacctattactcgacctaaactattaaccgagtcaacttttactttacttccgtttacggggtacgggtaacgggaacccgtaaagggtcgggaacctagtacctaaacggaaccgtaaaccgttggtaggggtcctggacccaaacctacttccgttcgttacctttacgtaacttcccgttaccccgg

SEQ ID NO: 63042 - DNA, 571 bp, Homo sapiens
  misc_feature: GYAE6OF01AG7M8.35.64.F09.1.454.CMB.1.raw
tcagtacagatcgtcacgaccggtgctcgatttagcgcgtatacaaggggggagtcagacccagtcaggacacagcatggacatgagggtccccgctcagctcctggggctcctgctgctctggctcccaggtgccaaatgtgacatccagatgacccagtctccctccaccctgtctgcatctgtaggagacagagtcactattacttgtcgggccagtgagagtataagtagttggttggcctggtatcagcagaaaccgagggaacgccctagactcctgatgtatagggcgtctgttactacaaatgggtacccacgaaggttcagcggcagtggatcgtgggacagaattcactctcaccatcagtacgcctgcagcctgatcgtactttcgacctaaccttattacctacgaccctaaactacttaacagtaccttaacttttacttttccttcgtttaccgggacgggaacgggtaaccgtaagggttcggaactacgtacgaaggtacgtaacgtcggtggcctgccacctagttcctacgttaccttctacttccctccccg

SEQ ID NO: 63043 - DNA, 506 bp, Homo sapiens
  misc_feature: GYAE6OF01DE8IA.35.64.F09.1.454.CMB.1.raw
tcagtacagatcgtcacgaccggtgctcgatttagcgcgtatacaagggggagtcagacccagtcaggacacagcatggacatgagggtccccgctcagctcctggggctcctgctgctctggctcccaggtgccaaatgtgacatccagatgacccagtctccctccaccctgtctgcatctgtaggagacagagtcactattacttgtcggcagtgagagtataagtagttggttggcctggtatcagcaagaaaccagggaaagccctagactcctgatgtatagggcgtctgttactactaaaagtcgggtacccacaaggttcagcggcagtggatcgtggacagaattcactctcacatcagtacgctgcagcctgatgtactttgactaactattactgaccaactacttacagctaactttactttctcgtttacggcggtagggacaaggtgactatcagacgacgtgtgctgcacattctagtcttcatctacccg

SEQ ID NO: 63044 - DNA, 621 bp, Homo sapiens
  misc_feature: GYAE6OF01A1T56.35.64.F09.1.454.CMB.1.raw
tcagtacagatcgtcacgaccggtgctcgatttagcgcgtatacaagggggagtcagacccagtcaggacacagcatggacatgagggtccccgctcagctcctggggctcctgctgctctggctcccaggtgccaaatgtgacatccagatgacccagtctccctccaccctgtctgcatctgtaggagacagagtcactattacttgtcgggccagtgagagtataagtagttggttggcctggtatcagcaagaaaccgagggaaacgcccctagactcctgatgtagtagggcgtctgtttctaacaaaagtcggggtacccacgaaggttcagcggcaggtggatcgtgggacagaattcactctcaccatacagtacgcctgcagcctgatgtactttgacctaaccttattacctgaccctaaactacttaaccagtaccttaacttttactttccttacggtttaccggggacgggtaacggggtaacccgtaaggggtacggaacctagtaccgaaacggtaaccggtaacgttcgggtacgggaccgttcggaccctaaacccgtcgttcccgttacgttaccctttacctacgtttccccgttacccccg

SEQ ID NO: 63045 - DNA, 590 bp, Homo sapiens
  misc_feature: GYAE6OF01C62IS.35.64.F09.1.454.CMB.1.raw
  modified_base (296)..(296): a, c, t, g, unknown or other
  misc_feature (296)..(296): n is a, c, g, or t
tcagtacagatcgtcacgaccggtgctcgatttagcgcgtatacaagggggagtcagacccagtcaggacacagcatggacatgagggtccccgctcagctcctggggctcctgctgctctggctcccaggtgccaaatgtgacatccagatgacccagtctccctccaccctgtctgcatctgtaggagacagagtcactattacttgtcgggcagtgagagtataagtagttggttggctggtatcagcaagaaaccgagggaaacgcccctagactcctgatgtataggcgtntgtactacaaagtcgggtacccacaaggttcagcggcagtggatcgtagggacagtaaacttcactctacacactacagtacgcctgcacgtcctgaattcgtactttcgactaacccttattacgtacgaccaaactattacacgtactaactttattttaccgttcgttttacgggcgggtaacgggtaaccgtaagggttcggaactacgttaacgaacggtacgaacgttcgggtacgactcggaccaccgtacttaccttggttccttacctcgtttccccgttccccg

SEQ ID NO: 63046 - DNA, 560 bp, Homo sapiens
  misc_feature: GYAE6OF01D2CS8.35.64.F09.1.454.CMB.1.raw
  modified_base (273)..(273): a, c, t, g, unknown or other
  misc_feature (273)..(273): n is a, c, g, or t
tcagtacagatcgtcacgaccggtgctcgatttagcgcgtatacaaggggggagtcagacccagtcaggacacagcatggacatgagggtccccgctcagctcctggggctcctgctgctctggctcccaggtgccaaatgtgacatccagatgacccagtcctccctccaccctgtctgctatctgtaggagacagagtcatattacttgtcgggccagtgagtagtataagttagttggtggcctggtatcagacagaaaccgagggaacnccctagactcctagtatgtagtgggtcgtcttagttactaacgtaaaggtcggggtacccaacgtaacggttcaggcggactaggtgatcgtagggacagtaattcactctacacatacagtacgcctgcacgcctgtatcgtacttcgactaacccttattactcgacctaactattacacgtactactttactttcttcgttcgggacggtacggacgtaggtcgactatcgaagacgtagtggtcgactcgacctacacgtctcttactactccttcccgtccc

SEQ ID NO: 63047 - DNA, 623 bp, Homo sapiens
  misc_feature: GYAE6OF01A79PQ.35.64.F09.1.454.CMB.1.raw
  modified_base (589)..(589): a, c, t, g, unknown or other
  misc_feature (589)..(589): n is a, c, g, or t
tcagtacagatcgtcacgaccggtgctcgatttagcgcgtatacaagggggagtcagacccagtcaggacacagcatggacatgagggtccccgctcagctcctggggctcctgctgctctggctcccaggtgccaaatgtgacatccagatgacccagtcctccctccaccctgtctgcatctgtaggagacagagtcactattactgtcgggccagtgagagtataagtagttggttggctggtatcgagcaagaaaccgagggaacgccctagacctcctagatgtagtagggcgtctgttactaacaaaggtcgggtacccaacgtaggttcaggtcgactaggtcgatcgtagggacagtaatcactctacacatacagtacgcctgacacgtcctagacttgtacgtttagacctaaccttattacctacgaccgtaactaattacgaagtcccttaacgtttaccttttacccgttcggtttaccggggtaccgggtaaacgggtaaccccgtaaggggttacggaaacttacgtaacgtacggtaaaccgtaacggttggtacggcttacgcctaaccgtntcggttacttacctttacacgttcccgtaccccg

SEQ ID NO: 63048 - DNA, 674 bp, Homo sapiens
  misc_feature: GYAE6OF01DAXWE.35.64.F09.1.454.CMB.1.raw
  modified_base (216)..(216): a, c, t, g, unknown or other
  misc_feature (216)..(216): n is a, c, g, or t
  modified_base (665)..(665): a, c, t, g, unknown or other
  misc_feature (665)..(665): n is a, c, g, or t
tcagtacagatcgtcacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagcgtcaccatcacttgccggganaagtcagagcattggactagtttactttaagtggtaactacgaaacggaaaccgaggaaaccgaccctaactctagactctatgctgactacgttctacgttttagacgtaaacgggtccggggtacccggtacgtaaggttccgtaaggtcggacgtaaggtggtacgtacggtacggggaactaaggtaaactttccgtaaccgttaccttaccaacccgtctaaccgtacgtacgtaacggttcctaacgtaacccgtaaaccgtagttaaaacggttaccttttacggaacccttaaaccgtttacttaacgtttccgtaaactaacgtaacggttacgttaacgaccggttacccgaccgtgaactcgagtcccgttacggacccaaggacctagacgtacggaagtaaacttaacgaacgtggtagtcctagacctaaccgtntcgttaccg

SEQ ID NO: 63049 - DNA, 619 bp, Homo sapiens
  misc_feature: GYAE6OF01BR3BG.35.64.F09.1.454.CMB.1.raw
  modified_base (266)..(266): a, c, t, g, unknown or other
  misc_feature (266)..(266): n is a, c, g, or t
  modified_base (381)..(381): a, c, t, g, unknown or other
  misc_feature (381)..(381): n is a, c, g, or t
tcagtacagatcgtcacgaccggtgctcgatttagcgcgtatacaagggggagtcagacccagtcaggacacagcatggacatgagggtccccgctcagctcctggggctcctgctgctctggctcccaggtgccaaatgtgacatccagatgacccagtctccctccaccctgtctgcatctgtaggagacagagtcactattacttgtcgggcagtgagagtataagtagttggttgcctggtatcagcagaaaccagggaacnccctagactcctgatgtagtagggtcgtctgttactaacaaagtcggggtaccccacgtaaggttcagcggcaggtgatcgtagggacagtacttcactctacaccatcagtacncctgcacgcctagattcgtactttgactaaccttattactacgacctaaactacttaacacgtccttaactttactttccgttacgtttaccggggaccgggtaacggggtaaccgtaaggggtacggaacctaacgttaccgaaacggtaaaccgtaacgttcgggttacgggaccttcggaccctaaccctagttaccgtacgttacctttacctaccgtttccccgttacccccg

SEQ ID NO: 63050 - DNA, 649 bp, Homo sapiens
  misc_feature: GYAE6OF01ARADH.35.64.F09.1.454.CMB.1.raw
tcagtacagatcgtcacgaccggtgctcgatttagcgcgtatacaagggggagtcagacccagtcaggacacagcatggacatgagggtccccgctcagctcctggggctcctgctgctctggctcccaggtgccaaatgtgacatccagatgacccagtctccctccaccctgtctgcatctgtaggagacagagtcactattacttgtcgggccagtgagagtataagtaggttggttggcctggtatcagcagaaaccagggaaacgccctagactcctagatgtagtagggcgtctgttctaacgaaagtcggggtacccaccgtaagggttcaggcggcagtcggatcgtagggacagaacttcactctcactatcagtagctgcgagctgatgtactttcgactaacttacttactacgaccctaaacgtacttaacagtactaacgttttacttttaccgttaccggttttaccggggaccgggttaacggggtaacccgtaacgggggtacgtaaccgtaacgttaccggaaacggtaacccgtaacggttcggtaccggggtacttacgggtacccctaaacccgtacgttaccgttacgtttacctttacccgttaacgtttccccgtttaccccccgg

SEQ ID NO: 63051 - DNA, 535 bp, Homo sapiens
  misc_feature: GYAE6OF01CHFI1.35.64.F09.1.454.CMB.1.raw
  modified_base (250)..(251): a, c, t, g, unknown or other
  misc_feature (250)..(251): n is a, c, g, or t
  modified_base (253)..(253): a, c, t, g, unknown or other
  misc_feature (253)..(253): n is a, c, g, or t
  modified_base (374)..(374): a, c, t, g, unknown or other
  misc_feature (374)..(374): n is a, c, g, or t
  modified_base (510)..(510): a, c, t, g, unknown or other
  misc_feature (510)..(510): n is a, c, g, or t
  modified_base (522)..(522): a, c, t, g, unknown or other
  misc_feature (522)..(522): n is a, c, g, or t
tcagtacagatcgtcacgaccggtgctcgatttagcgcgtatacaaggggggagtcagacccagtcaggacacagcatggacatgagggtccccgctcagctcctggggctcctgctgctctggctcccaggtgccaaatgtgacatccagatcgacccagtcctcccctccaccctgtctgcatctggtaggagacagagtactacttattacgttgtcggcagtgagagtatagtagtggtgctgtanngnaagaaacgaggaacgccctagactctgagtgtagtagggtcgtctgtactaacgaaacgtcgggtaccaacgtaaggttcgaggcggagaggtggatcgtaggacagtactcactcacacntcagacgctgctagctagactctattcaactaacttactactcaacctaatacttacactacttaacttttctttcttcggttacgggcgggaaggtaccaggtgactagcgagacctagtcgtgactcactactnttctcgtcctcnccttccgtacccg

SEQ ID NO: 63052 - DNA, 606 bp, Homo sapiens
  misc_feature: GYAE6OF01B7CKN.35.64.F09.1.454.CMB.1.raw
  modified_base (265)..(265): a, c, t, g, unknown or other
  misc_feature (265)..(265): n is a, c, g, or t
  modified_base (440)..(440): a, c, t, g, unknown or other
  misc_feature (440)..(440): n is a, c, g, or t
  modified_base (446)..(446): a, c, t, g, unknown or other
  misc_feature (446)..(446): n is a, c, g, or t
tcagtacagatcgtcacgaccggtgctcgatttagcgcgtatacaagggggagtcagacccagtcaggacacagcatggacatgagggtccccgctcagctcctggggctcctgctgctctggctcccaggtgccaaatgtgacatccagatgacccagtctccctccacctgtctgcatctgtaggagacagagtcacttattacttgtcggcagtgagagtataagtgttggtgctggtatcagcaagaaaccgagggaaacnccctagactcctgatgtagtagggcttcgtagttactaacgaaagtcgggtacccaacgtaaggttcacggcggagtaggtggacttcggtacggggaactaggtaacttcgaacgtctacacctatcgagttacgcgtgctacgcctgtaactgttaactttgacctaaccttnttaacncgaacctacgtattacgacgtaccttactttctttaccgttcgttacgggaccggtaagggaaccgttaggtacgaacgtctacggacgtaaccgtagttggtacgaccgttgaccctacgtacgttaccttgttacccttactcggtttccctaccccg

SEQ ID NO: 63053 - DNA, 532 bp, Homo sapiens
  misc_feature: GYAE6OF01EVHXB.35.64.F09.1.454.CMB.1.raw
  modified_base (190)..(190): a, c, t, g, unknown or other
  misc_feature (190)..(190): n is a, c, g, or t
  modified_base (231)..(231): a, c, t, g, unknown or other
  misc_feature (231)..(231): n is a, c, g, or t
tcagtacagatcgtcacgaccggtgctcgatttagcgcgtatacaagggggagtcagacccagtcaggacacagcatggacatgagggtccccgctcagctcctggggctcctgctgctctggctcccaggtgccaagtgtgacatcgaaatgacccagtctccttccaccctgtctgcatctgtggganacagcgtcatcatcacttgcctggccagtcagacgattagngacgtggttggcctggtatcagcaacgaaaccacggaaccaaaaaccctaaactcctatattaagtaacgcttctagtttacaaagtggggtcccagcaaggttcggcggcagtggatctggggacagatttcactctcaccatcagcaacctgcagcctgaggactttgcactttatactgcaacagtactaatagttaccctactaactttcggacggtaagggaacaaggtagaacgaaccaaacggtactagtggactgaccaacatctcgtcttcacttcttacccgctatcgtag

SEQ ID NO: 63054 - DNA, 781 bp, Homo sapiens
  misc_feature: GYAE6OF01D7N69.35.64.F09.1.454.CMB.1.raw
tcagtacagatcgtcacgaccggtgctcgatttagcgcgtatacaaggggggagtcagacccagtcaggacacagcatggacatgagggtccccgctcagctcctggggctcctgctgctctggctcccaggtgccaaatgtgacatccagatgacccagtcctcccctccaccctgtctgcattctggtaggagacgagagtcacttattacgtgtcgggccagtgagagtataagttagttggttgccgtggtatcgagacaagaaaccgaagggaaacgacccctaaacgtcctagtaatttacgtaaggtccttacgttaaggtttaacgaaagggttcggggtacccaaggtacgtaacgggttcgggacgggtctagggtaggacttacggtaggaactaggttacgtttaccacttccgtacctaaccctattaccaacggtacctaacccgttggaccacggtaccttagggtacggttacgttttacgtaaccttaaacgtttaacttaaccgtacgaaccctaaagtaacggttaaatttaacgtttaaccgtttaaccccttaaccggttttaaccggtttacccgggggaacgggtaaccgggtaaacccgtaagggtaacggtaaacgtaaacccggtaaacgtaacgtcggtacggtaccttggaacccctaacgtaccgttaccgttaccggtttcctttacccgacttttccccccgtacccgtaccctaactttacccgtaacgggtaacgtacgtttacccgg

SEQ ID NO: 63055 - DNA, 507 bp, Homo sapiens
  misc_feature: GYAE6OF01BK5AX.35.64.F09.1.454.CMB.1.raw
  modified_base (496)..(496): a, c, t, g, unknown or other
  misc_feature (496)..(496): n is a, c, g, or t
tcagtacagatcgtcacgaccggtgctcgatttagcgcgtatacaaggggggagtcagacccagtcaggacacagcatggacatgagggtccccgctcagctcctggggctcctgctgctctggctcccaggtgccaaatgtgacatccagatgacccagtctccctccaccctgtctgcatctgtaggagacagagtcactattacttgtcgggccagtgagagtataagtagttggtggcctggtatcagcagaaaccagggaaagcccctagactcctgatgtatagggcgtctgttctacaaaatggggtcccacgaaggttcagcggcagtggatcgtgggacagaattcactctcacatcagtagcctgcagcctgatgactttgacaacctattactgccaacattacagtcactttatttctcgtttcgggcggaggtaccgaggtgactatcagacgactggtggctgcaactattctcgttcttcnttccttccccg

SEQ ID NO: 63056 - DNA, 648 bp, Homo sapiens
  misc_feature: GYAE6OF01AK7QN.35.64.F09.1.454.CMB.1.raw
  modified_base (251)..(252): a, c, t, g, unknown or other
  misc_feature (251)..(252): n is a, c, g, or t
  modified_base (269)..(269): a, c, t, g, unknown or other
  misc_feature (269)..(269): n is a, c, g, or t
tcagtacagatcgtcacgaccggtgctcgatttagcgcgtatacaagggggagtcagacccagtcaggacacagcatggacatgagggtccccgctcagctcctggggctcctgctgctctggctcccaggtgccaaatgtgacatccagatcgacccagtcctccctccaccctgtctgctatctggtaggagacagacgtacacttattacgtggtcgggcagtgagtagtatagtgttggtgctgtannagcaagaacgaggaacnccctagactctgatggtagtacggtctcgttcgttacgtaacgtaaacgtccgggtaccctaacgtaacggttacagggtccggacgtagggtacggagtcggtagggaactaagtaacttcgacttctacctactactcgacgtactacgtctacgacctaactaggtactacgttgttacgaccttaactttacgtacgttagtaaccaacgtaacgttaaccgttaccggacccggttcccttagttacccgtaccggtttacccggaccgtacggaccttacgacgtaaccgacgtaccgaaggtccgtaacgttcggacggttctaccgtccaagttcgttcgttaccttacctccttccgttccccgtacccg

SEQ ID NO: 63057 - DNA, 578 bp, Homo sapiens
  misc_feature: GYAE6OF01AXI1C.35.64.F09.1.454.CMB.1.raw
  modified_base (190)..(190): a, c, t, g, unknown or other
  misc_feature (190)..(190): n is a, c, g, or t
  modified_base (269)..(269): a, c, t, g, unknown or other
  misc_feature (269)..(269): n is a, c, g, or t
  modified_base (387)..(387): a, c, t, g, unknown or other
  misc_feature (387)..(387): n is a, c, g, or t
  modified_base (450)..(450): a, c, t, g, unknown or other
  misc_feature (450)..(450): n is a, c, g, or t
tcagtacagatcgtcacgaccggtgctcgatttagcgcgtatacaagggggagtcagacccagtcaggacacagcatggacatgagggtccccgctcagctcctggggctcctgctgctctggctcccaggtgccaaatgtgacatccagatgacccagtctccctccaccctgtctgcatctgtagganacagagtcactattacttgtcggccagtgagagtataagtagttggttggcctggtatcagcaagaaaccgagggaacnccctagactccgtgatgtagagggtctctgttactaacgtaaagtcgggtacccacgtaaggttcagcggcaggtgatcgtgggacagtaacttcactctacaccgtatccgagtacnccgtgctacgcctagtactcgtactttcgaaccttaacctacttacacgacccaagtacttanacgtacttactttcttcgttcgttacgggacggaggtaaccgaggtgaactagtacgagaccgtaacgtggtacgacgtcgacccgaacttagttaccttcgttacctccttacgttccccgttcccg

SEQ ID NO: 63058 - DNA, 624 bp, Homo sapiens
  misc_feature: GYAE6OF01EMCE7.35.64.F09.1.454.CMB.1.raw
tcagtacagatcgtcacgaccggtgctcgatttagcgcgtatacaagggggagtcagacccagtcaggacacagcatggacatgagggtccccgctcagctcctggggctcctgctgctctggctcccaggtgccaaatgtgacatccagatgacccagtctccctccaccctgtctgcatctgtaggagacagagtcactattacttgtcgggccagtgagagtataagtgttggtgctggtatcagcagaaaccagggaaacgccctagactcctagatagtagtagggtcgttcttgtttactaacaaaagttcggggtaccccaacgtaaggttcaggcggacagtggatcgtaggacagtaattcactctacaccgatcagtacgcctgcacgcctagattgacttgactaaccttattactcgaccctaactacttacagtaccttaactttacttttaccgttcgtttccggggacgggtaacgggtaaccgaagggttacgtaaccacgttacgaacgggtaaccgtaaacggttcggttacggtacttcggaccctaaccttaacgtttccgttacggttacccctttacgtaccgtttccccgtttacccccgg

SEQ ID NO: 63059 - DNA, 662 bp, Homo sapiens
  misc_feature: GYAE6OF01C22ZN.35.64.F09.1.454.CMB.1.raw
  modified_base (200)..(200): a, c, t, g, unknown or other
  misc_feature (200)..(200): n is a, c, g, or t
tcagtacagatcgtcacgaccggtgctcgatttagcgcgtatacaagggggagtcagacccagtcaggacacagcatggacatgagggtccccgctcagctcctggggctcctgctgctctggctcccaggtcgaccaaatgtgacatccaagactacgacccagtcctccctccacctgtctgctatcgtggtaagganacagtacgtacacttacttacgttggccggacagtgagtagtatagtgttggtcgctggtatcagacaagaacgaggaacctcctagacctctagataggtagtaggcttcgtacgttacgtaacgtaaacgtccgggtacctaacgtacggtcaggcggataggtacggtactacggtaggactagtaactcgtactcgtaccactatacgtagtacgccgtcgactagtccgtagtacttacgtaccttacgtaacctaacttcttaaccgcgaacctaatacgttaacacgttacttaacgttttacgttccgttcgggttaaccggggacggtaaaccgggtaacgtaacgggtactaacgtaccgttaacggaccgttaaccggtaacgtcggtacgtaccgtccgtaaccaccgtttatacccgttcgttaccttaccgtccttcccccggttacc

SEQ ID NO: 63060 - DNA, 839 bp, Homo sapiens
  misc_feature: GYAE6OF01DFNCQ.35.64.F09.1.454.CMB.1.raw
  modified_base (181)..(181): a, c, t, g, unknown or other
  misc_feature (181)..(181): n is a, c, g, or t
  modified_base (187)..(187): a, c, t, g, unknown or other
  misc_feature (187)..(187): n is a, c, g, or t
tcagtacagatcgtcacgaccggtgctcgatttagcgcgtatacaaggggggagtcagacccagtcaggacacagcatggacatgagggtccccgctcagctccgtggggctcctgctgctctggctcccagggtcgaccaaatgtgacatccagatgacccagtctccctccacctgtcngcatcngtaggagacagatcacttatacttgcggcagtgagatagtaagtcggttggttcggcctggtatcgacggacaacggaaaaccgaagggaaaccgccccgtaaggaccttccgtaggtaacttagggtaagtaagggggtccgttaccgttaggtttaacctaaaccggtaaaaggttccgggggaccccctaaacggtaaacgggttcaacgggccggtacagggttaggtaacttccgggtagggaacgtaaggttaaacttcctaaccttaccttaccaaacccgtaattacccggtaagtaacgtcccgttacggaccaaacgggtcccttaggggttaactttacggttaaacttttccggtaaaccgttaaaaccctttaacgtttaaccgtacccggtaaaccctaaacttaaacgtttaacccctaaaggttcccttaaacgttttttaaccgtttacccgtttacccggtttttacgggggaacccggggttaacggggtaaacccggtaagggttacgggtaaacctaacggtaacgtaaggggtaaacccgtaaacggttcgggtaaacgggttctacccggacggtaaccctagttcccttaacggtttccctaccgtttacgttccccgttaaccccgg

SEQ ID NO: 63061 - DNA, 904 bp, Homo sapiens
  misc_feature: GYAE6OF01A4963.35.64.F09.1.454.CMB.1.raw
  modified_base (139)..(139): a, c, t, g, unknown or other
  misc_feature (139)..(139): n is a, c, g, or t
  modified_base (611)..(611): a, c, t, g, unknown or other
  misc_feature (611)..(611): n is a, c, g, or t
tcagtacagatcgtcacgaccggtgctcgatttagcgcgtatacaaggggggagtcagacccagtcaggacacagcatggacatgagggtccccgctcagctccgtggggctcctgctgctctcggcgtcccagggtcnccaaagtgtagaccatccgagtaacgtccggaccctagtccctcccctaccctaccccgttgttccgagtcctaacgtcgttaggtagggaacgaaccgagggtactaccaaccctaactccgtaccgttcgggacccgggggactaaacggtcgaagggtacgtactacggtttcggacggttaactttaccggttttaaattcgggttacgaaccggaaaaccgggtaaaccgggtaaaccgggtaaacccggtaaccccttaaccgtaccggttacggtaactttcgtaacgtaccggttccgtaactaccgtacgtttaaccgtaggtttttacgaaccgggtaaaccggggttcgggggttacccggtaaccgtaacgggtttacgaggttacgggcggtaaggggttacggtaacggttaccgggttaggggaaccctttaagggttaaccctaccggtttaaccnctttaaacccgacccgttaaggccgttaaaccgcgggtttaacccaccgggttactaccccggtaaacgtttgtaacggttttaacgtttacccgtacctaaccgtttaacgttacgttaacgtacgtaactaggtactaacccggtagtacccgaccgtaccgtatcccggttaagctaaccggggacaacggtacccggagtaaacggcggttaaaggtaaacttaacgggtgtaaaccggttcgccggtaacttaaccggactaagggtttccttaccgtgttaaacccc

SEQ ID NO: 63062 - DNA, 703 bp, Homo sapiens
  misc_feature: GYAE6OF01CF2XP.35.64.F09.1.454.CMB.1.raw
  modified_base (251)..(251): a, c, t, g, unknown or other
  misc_feature (251)..(251): n is a, c, g, or t
  modified_base (288)..(288): a, c, t, g, unknown or other
  misc_feature (288)..(288): n is a, c, g, or t
  modified_base (531)..(531): a, c, t, g, unknown or other
  misc_feature (531)..(531): n is a, c, g, or t
tcagtacagatcgtcacgaccggtgctcgatttagcgcgtatacaagggggagtcagacccagtcaggacacagcatggacatgagggtccccgctcagctcctggggctcctgctgctctggctcccaggtgaccaaatgtgacatccagatcgacccagtcctccctccaccctgtctgcatcgtagaggagacagacgtcactattacgttggcggcagtgagagtatagtaggttggtcgctggtancgagacaagaaaccgaggaaccgccctaggacctcgngtactggtacgtagggtcctcgttacgttactaacgtaaacggttccgggaccctaacgtaggttaccgacggcggacgtaaggtcggaacgttcggagggaactaagtacttactaccgtactaaccaccgtaattaccgagggttaccgccctaggaccgtacgtaccggtagtaacttcggttacctttacggaaccttaacctttacgtactaccgtaaacccaattaccggttaaacncgttacctttacctttaacgtttcccgttacgggttaccggggaccgggttaacgggtaaccgtaacgggttaccggaactaacgggtacgtaaacggtaaccgtaagggttcgtcggtaggacccgtacgtaccttacggtcttacgtttcgtccctcgttcccgttcccc

SEQ ID NO: 63063 - DNA, 822 bp, Homo sapiens
  misc_feature: GYAE6OF01AQ001.35.64.F09.1.454.CMB.1.raw
  modified_base (139)..(139): a, c, t, g, unknown or other
  misc_feature (139)..(139): n is a, c, g, or t
  modified_base (150)..(150): a, c, t, g, unknown or other
  misc_feature (150)..(150): n is a, c, g, or t
tcagtacagatcgtcacgaccggtgctcgatttagcgcgtatacaaggggggagtcacgacccagtcaggacacagcatggacatggagggtccccgctcagctccgtggggctcctgctgctctggctcccgaggtcnccaaatggtanacatccagtatcgacccagtcctaccctccaccctgtctgctactcgtcggtaggacacgagtacgtactacttagtttacgttcgggtccgggcaaggttcggaagtaacgttagttaacgggtttagggttttcggggttacggccgttagggttaactaccgaaggtaaccggaaacggtaaaacccggaagggtaaacccgtccccgttaagacccgttaccgtagtaagttgggtaacggtacggggtacgttcttacggtttacgaaacgtaacgggttccgggtaacccctaacggtaaggttccgacggtccggaggtacggtacggtacgtacgggtacgggaactaaggtacctttcgaccttcgacctaacacgttacgacggtaccgtccgtcgtaaccgtacgtccgtagtacgttacgtaacgtttaccgaaccttaacttaccttacgaccgtaacctaacgtacctaacgtacgttacctttacttttacgtttaccggttccggttacggggtaaccgggtacgggttaaccgtaagggtacgtaactaccgggtaagtaccggtaacgtaacggtccgggtacggttacgccgtaacccgttacccgttcgttcccgttagtttaccccttccttcccgttcccgtaaccccgg

SEQ ID NO: 63064 - DNA, 821 bp, Homo sapiens
  misc_feature: GYAE6OF01APXNH.35.64.F09.1.454.CMB.1.raw
tcagtacagatcgtcacgaccggtgctcgatttagcgcgtatacaaggggagtcgagggacccagtcacggacacagcatggacatgaggtccccgctcagctcctggggctacctgctgctctggctcccgaggtgccaagtgtgactactccgagtatcgtacccagtccttcccttccgtacctgtctcgctagttcgtaggtcgggagacgaggtccgtcgtatactactccggtacgttcgaccgtcgaccgtcgttaccgagtaacgtagttacggtcgtacggttcggttacggtaccgttaggtaccttaccgacgtaccgaacgtaaaccgtacggaaacccgtaaaacccgtacggtccgtacggtaacgtttacgaacggtccgttacgttaaggttaacggaacgggttcgggtacccgtacgtacggttaagggttccggtacggtacggtacgttacggtaccttacggtaacggtaacttacgttaacgtttaccgtaacgttaccgtacccgtaacgtacgtacggtaaccgttacctaaccgtacgtaccgtaccgtaccgtaaggtaaccggttactttacggaaacctttaaaccttcgtaacccgttaccgtaacccgtaagttaaccgttaaacgtttaaccgtaacccgtttaacccgttacgtaaccgggttaccggaacgtaaccggtaagtaacggtacgaactaacgtacgaccgttgtacgtaccgacttacctacgtcttaccgttacttacgtacccgtttacgttaccccgtaacgtccgtacggttaccg

SEQ ID NO: 63065 - DNA, 639 bp, Homo sapiens
  misc_feature: GYAE6OF01D3PV2.35.64.F09.1.454.CMB.1.raw
  modified_base (195)..(195): a, c, t, g, unknown or other
  misc_feature (195)..(195): n is a, c, g, or t
  modified_base (302)..(302): a, c, t, g, unknown or other
  misc_feature (302)..(302): n is a, c, g, or t
  modified_base (386)..(386): a, c, t, g, unknown or other
  misc_feature (386)..(386): n is a, c, g, or t
  modified_base (424)..(424): a, c, t, g, unknown or other
  misc_feature (424)..(424): n is a, c, g, or t
  modified_base (585)..(585): a, c, t, g, unknown or other
  misc_feature (585)..(585): n is a, c, g, or t
  modified_base (629)..(629): a, c, t, g, unknown or other
  misc_feature (629)..(629): n is a, c, g, or t
tcagtacagatcgtcacgaccggtgctcgatttagcgcgtatacaaggggggagtcagacccagtcaggacacagcatggacatgagggtccccgctcagctccgtggggctcctgctgctctggctcccaggtgccaaatgtgacatccagactgacccagtcctccctccaccctgtctgcatctggtagganacagagtacacttaattacgttcggtcgggaccaggtgagtagttaagtaaggttaggtttggttggccgttggtatcgagaccaacggaaaaccgaagggaaaccnccccgtagacctcctagtatagtagtcgggcgttcttgttactaaacgtaaacgtccgggtacccaacgtaaggttcaaggcgnaggtgagtcgtagggacagtacttcactctacacctanacagtcagttcacgactaacgtagtacgttatttacgacctaacttcttaattacgtacaacgtagtacgtaacgaccggtaccgcccgtaagactaccgcgtacccgttaccggacgtaacgggacctaacggacggtaggtaaataaacgttaaacggngttagggcgtaccacgtacccacggttcttactgttaccttccncgttaccccg

SEQ ID NO: 63066 - DNA, 697 bp, Homo sapiens
  misc_feature: GYAE6OF01E5IX1.35.64.F09.1.454.CMB.1.raw
  modified_base (95)..(95): a, c, t, g, unknown or other
  misc_feature (95)..(95): n is a, c, g, or t
tcagtacagatcgtcacgaccggtgctcgatttagcgcgtatacaagggggagtcagacccagtcaggacacagcatggacatgagggtccccgntcagctcctggggctcctgctgctctggctcccgaggtcgaccaaatgtgacatccagactcgacccagtcctccctccacctgtctgcatcgtgtaggagacagtacgtctactattacgtggtccggctagtgaagtagttaagtaagttggttggtcggcgttgatcgagacaacggaaaccgagggaaacctccctaggtacctacgtagtacgtaggtacgtacgggtcttctagttaccaaacgtaacggtccggtacccaacgtaggtcaggccgagtaggtaggtactcggagggactaagttacctccgtaacttccaaccaccgtagtaccgtacggtacctaccgtggacccgtaacgtccgttaaggtacgtttaccggtaactttaccggaaccttaaaccttcgttaccgtaccgaacctaacgttacttaacgacgttacctttacgtttagtttcccggttacggttaccgggggaaggtaaccggaccgtttaagggctacctaaggtccggaaacggtaaccggttagtcgtagaccgttccgacttacggtactccggttactacgtccttcgtcccctaccg

SEQ ID NO: 63067 - DNA, 808 bp, Homo sapiens
  misc_feature: GYAE6OF01DN7KT.35.64.F09.1.454.CMB.1.raw
tcagtacagatcgtcacgaccggtgctcgatttagcgcgtatacaagggggagtcagacccagtcaggacacagcatggacatggacgggtccccgctcagctccgtggggctcctgctgctctgcctcccaggtcgaccaaatgtagacactccagactacgaccctagtccctccctccacctgtctgctatcgtggtaaggagacagacgtctaacttacgttacgttacggtccgggactaggtacgaagtagttaaaggttaacggttaggtttcggttcggacgttaggtactacgaacgaacgaaacggtaaaaaccggaacgggtaaaccgcccgtacgtactccgtagtagtacggtacggttacgggtcctttacgttacgttaaccgtaacggtaaaacggtttcccgggtaacccgtaacgttaaacgggtccgacgggtacggagtaacggtggtacgttacgtacgggtaactacgttaacgttccgacttacaccctaaacacgttactacggtactcgtacgacgtcgaccgttagtaccgttacgttacttacgtaaccttaacccgttacttactacccgtaactaaacttaccgtttaacacccggttaactttacgtttaccttttaccggttacggttaaccggggtacgggtaacggtaaccggttaacggtacgtaaccgtaccgtacgtaaccggtaacggttacgtcgggtaccggttatacccggtacttaacccgttagttcccgttactttcccgttcctaacccgttccccggtaaccc

SEQ ID NO: 63068 - DNA, 625 bp, Homo sapiens
  misc_feature: GYAE6OF01C0XUW.35.64.F09.1.454.CMB.1.raw
  modified_base (352)..(352): a, c, t, g, unknown or other
  misc_feature (352)..(352): n is a, c, g, or t
  modified_base (606)..(606): a, c, t, g, unknown or other
  misc_feature (606)..(606): n is a, c, g, or t
tcagtacagatcgtcacgaccggtgctcgatttagcgcgtatacaagggggagtcagacccagtcaggacacagcatggacatgagggtccccgctcagctcctggggctcctgctgctctggctcccaggtgccaaatgtgacatccagatgacccagtcctccctccacctgtctgcatctgtaggagacagagtcacttattacgttggtaccgggccagtgagtagtataaggtaggttggttcggctggtatcagcaagaaaccgaaggaacgccctagactcctgatagtagtagggctctagttactaacgaaacggtcgggtacccacgtaaggtcgacgcggnaggtggtatcgtaggaactagtaacttcgacttcacacctatcgaagtacgtctagcacgtcctagacttcggtactttacgaacctaacttataccgtcaacctaactatacacgtccttaactttacttcgttccgtttagggacggtaacggtacgtacggtacgaatacgttaacgacggtaacgtacggttcggtaggtaccgtacggaccctaacgttaaccgtttcgttaccgtttcctttaacccngtttccccctttaacccgg

SEQ ID NO: 63069 - DNA, 585 bp, Homo sapiens
  misc_feature: GYAE6OF01BB374.35.64.F09.1.454.CMB.1.raw
  modified_base (338)..(338): a, c, t, g, unknown or other
  misc_feature (338)..(338): n is a, c, g, or t
  modified_base (360)..(360): a, c, t, g, unknown or other
  misc_feature (360)..(360): n is a, c, g, or t
  modified_base (440)..(440): a, c, t, g, unknown or other
  misc_feature (440)..(440): n is a, c, g, or t
  modified_base (447)..(447): a, c, t, g, unknown or other
  misc_feature (447)..(447): n is a, c, g, or t
  modified_base (559)..(559): a, c, t, g, unknown or other
  misc_feature (559)..(559): n is a, c, g, or t
tcagtacagatcgtcacgaccggtgctcgatttagcgcgtatacaaggggggagtcagacccagtcaggacacagcatggacatgagggtccccgctcagctccgtggggctcctgctgctctggctcccaggtgccaaatgtgacatccagatgacccagtcctccctccaccctgtctgcatctggtaggagacagagtcactattacttcggtcggccagtgagtagtataagtaggttggttggcctggtactcagcgaagaaccgaagggaacgccctagcctctgatggtagtaggtcgtctgtctaacgaagtcgggtcccacgtaggtcncggcgcaggtggatcggagganagtacttcgacgtctacacctatcgagtacgccgtgcgtaacgccgtaggtactcggtaactttacgaccttaaccgttnttaaccncgtaacctaactacttaaccgattccttaattttcttaccgttcgggttcgggacggaacggtacgtagggtcaactcgacggtacgacgtcgtaggtcgactcgactaccngttcctgtccctatccctcggtaccc

SEQ ID NO: 63070 - DNA, 645 bp, Homo sapiens
  misc_feature: GYAE6OF01DT9J0.35.64.F09.1.454.CMB.1.raw
  modified_base (194)..(194): a, c, t, g, unknown or other
  misc_feature (194)..(194): n is a, c, g, or t
  modified_base (250)..(251): a, c, t, g, unknown or other
  misc_feature (250)..(251): n is a, c, g, or t
  modified_base (286)..(286): a, c, t, g, unknown or other
  misc_feature (286)..(286): n is a, c, g, or t
  modified_base (393)..(393): a, c, t, g, unknown or other
  misc_feature (393)..(393): n is a, c, g, or t
tcagtacagatcgtcacgaccggtgctcgatttagcgcgtatacaagggggagtcagacccagtcaggacacagcatggacatgagggtccccgctcagctcctggggctcctgctgctctggctcccaggtgccaaatgtgacatccagatcgacccagtcctccctccaccctgtcctgctatctgtagganacagagtcatattacttggtccggccagtgagagtatagtagttggttgcgtgtannagacaagaacgaggaacgcccgtagactcctagtntagtaggtagggtcgtcgtgttactaacgtaaagtccgggtacccaacgtaacggttcgacgcggcgtaggtggtacgtcggtagggacgaagtacttcgactaccnctaacctagtactacgtaacggtcctacgacgacgtccgtagtagtacgttacttacgaacctaccgttactactcgtaactactaactacgtactacgtactttactttcgttccggttcggggtaccggtaacgggtaccgtagggtacaacgtacgttaaccggacgtaacgtacggttacggtacggtcggttacgacccgtaactccttaggtacccctttaccgtcttcccgttccctacccccgg

SEQ ID NO: 63071 - DNA, 653 bp, Homo sapiens
  misc_feature: GYAE6OF01BQQX0.35.64.F09.1.454.CMB.1.raw
tcagtacagatcgtcacgaccggtgctcgatttagcgcgtatacaagggggagtcagacccagtcaggacacagcatggacatgagggtccccgctcagctcctggggctcctgctgctctggctcccaggtgccaaatgtgacatccagatgacccagtcctccctccaccctgtctgcatctgtaggagacagagtcacttattacttggtcgggccagtgagagtaataaggttaggttggttcggcctggtatcgagcaagaaaccgagggaacgtccccgtagacctcctagtatggtagtacgggtcgtcgttaggttactaacgtaaacggtcgggtaccccaacgtaacggttcgaggccggataggtacgacgtacgtacgggactaagtacttcactctacactatcgacgtacgccgtagcacgtctagtagttcgtacgtttacgaccttaaccttacttaccgtacgacctaaacgtacttacgaacttacctttaattttacctttccggttaccggtttacggggaccgggtaacgggtaccgtaagggtacgaccgtagtaccgaacggtaccgtaacgtggtacgtacgtaccgactaccgtacttccgttcttaccttctcgttcccctacccgg

SEQ ID NO: 63072 - DNA, 844 bp, Homo sapiens
  misc_feature: GYAE6OF01BBIXT.35.64.F09.1.454.CMB.1.raw
tcagtacagatcgtcacgaccggtgctcgatttagcgcgtatacaaggggggagtcagacccagtcaggacacagcatggacatgagggtccccgctcagctcctggggctcctgctgctcgtcggctcccgaggtcgacctaaagtgtgacatccgagacgtacgaccctacgttccctacccctccctacccgtcgttccgtcgtactacgttacgttgggtaacggacggtaacgaggtacgttacctaacgtttacgtttacggttccggtaccgggtcctagggtaggaacggttaaggttaaagttaacgggttacgggttttcggggttaccggttccggttaggttaacgtaccggtaacggtaaccgtaaaaccgggtaaaaccgggtaaacgggaaacccgtccccgtaagttacccgttaccgtagtagttaacgggtacggttaccgggtccgttacgttacggttaaacgtaaaccggtaacgggttaccccggacctaacggttaacggtccgaagtcggagtacggtagcgtacggaggactagtaccttacgacgttccgactaccgtataccgtagtacccgtcgtaccgtaccacgtcgtaacgtcgtacggttacgttaccgtaccttacgttaacctacgtaaccgtaactaaccgtactaacgtctacctttaacgttcgttaccgtcggtaccgggtacggtacggaagtacgggtacaacgtaggtccgtacgtaggttccgaggtttccgacgttccgaaccgttacccgtaagttttccgtaacccgttttactacctttccccggttcccttaacccg

SEQ ID NO: 63073 - DNA, 926 bp, Homo sapiens
  misc_feature: GYAE6OF01BSF0A.35.64.F09.1.454.CMB.1.raw
tcagtacagatcgtcacgaccggtgctcgatttagcgcgtatacaagggggagtcagacccagtcaggacacagcatggacatgagggtccccgctcagctcctggggctcctgctgctctggctcccaggtgccaaatggtgacactccagatcgacccagtcctcccctcccacccttgtctcgacacttcgtaggtaggagaacagacgtactaaccttaagtttaccgtttggtccgggacctaggtaggtaaggtaaggttaaattaaagggtttaggtttcggggtttacgggtaccgtttagggttaactccgaacggaccgtaaaacgggaaaaacccgtaaacgggggaaaacccgtcccccgttaaacgtacccttcccgtaaggtacgttagtttaacggtacggggtccgtttacgtttacggtttacctaaaacgtaaacgggttcccgggggtaacccctaaacccgggttaaggttaccgaacgggtccgggtacgtacgggttacgggaactttccgggtaggggtaaaccgtaattaaaccgttttcccgaaccgtttacccgtaacccgtaacgtaaccgtaccggtaaacggttacccgtccggtttaccgaccgtaaccgggttaccctaggggtaaaccttttccggttaacttttacccggaaacccgtttaaacccgtttaccttaccgttaaccgtaacccctaaaagtttaccttaacccgagtttaaccccgtttaacgttttcccgtttttaccgttcgggtttaccggggacgggtaaacgggtaccgtaagggacgtacttaacggtcgtaacggtaacgtacggttcggtaacgtcttacgaacccttacgattcccgttacgttacccgttcttaccccgttcccgttaaccccg

SEQ ID NO: 63074 - DNA, 710 bp, Homo sapiens
  misc_feature: GYAE6OF01D1NYT.35.64.F09.1.454.CMB.1.raw
  modified_base (565)..(565): a, c, t, g, unknown or other
  misc_feature (565)..(565): n is a, c, g, or t
  modified_base (590)..(590): a, c, t, g, unknown or other
  misc_feature (590)..(590): n is a, c, g, or t
  modified_base (641)..(641): a, c, t, g, unknown or other
  misc_feature (641)..(641): n is a, c, g, or t
  modified_base (683)..(683): a, c, t, g, unknown or other
  misc_feature (683)..(683): n is a, c, g, or t
tcagtacagatcgtcacgaccggtgctcgatttagcgcgtatacaagggggagtcagacccagtcaggacacagcatggacatggacgggtccccgctcagcctcctggggctcctgctgctcgcggctcccaggtcgacctaaatgtgacatccagatcgaccctagtcctccctccacctgtcctgctactcgtaggaaggagacgagtacgtacctactttaacgttacgttcggaccggtaccaggtagtacgtaagttaattagggttaggtttggttacggaccgttaggtatacgaacgacgaaacggaaacccgtacgggtaaccgccccgtaaggttaccgtaccgtagtaacggttaggtacggtacggtcgtttacctaggttaaccctaaaggtaaccggtccgggtaaccccaagggtacgttacaacgggtacggtacgtagggacgtacggtacggtacggactaagtactaccgtactacctacgtactaatcgaagtccgctacgcgtaccgacgtagtcttacgtacttacgactaacttacgtacncgtacaatacgtacctagtaccttnttaccggtttactccccgggtagaaccgggttagaacgagtacaacggtanccaaaggtaacgtcgaggtccgagtcccaagttcctacgttnttaccctagttcctccgttcccgtacc

SEQ ID NO: 63075 - DNA, 957 bp, Homo sapiens
  misc_feature: GYAE6OF01BF4IW.35.64.F09.1.454.CMB.1.raw
tcagtacagatcgtcacgaccggtgctcgatttagcgcgtatacaaggggggagtcagacccagtcaggacacagcatggacatggacgggtccccgctcagctcctggggctcctgctgctctggctcccaggtcgccaaatgtgacatccagatcgacccagtcctcccctccgacctgtctgctatcgtagtaggagactagacgtacacttattacgttcggtcgggccaggtgagtaagttataagggttaggtttgggttaggccgttagggttaactacgaacggtaccaaacggaaaaccggtaacggggaaaaccgtcccccgttaaacggaaccttacccggttagtaagttcggtaaagttaccggggtccgtttccggtttacggtttaaccgtaaaaccggtaaaaacgggtttcccggggggtaaccccctaaaaccgggtaacgggttttaccgaacgggtaccggggtaacgtaaggggttacgggtaaccgttacgggtaacggggtaaaccgtaaggtttaaacgtttaccgtaaccctttacccgtaaccccgtaaacctaacgttaccggtaaacggtaaccggtccgttaaccgggtacctacgggtacccgttaggttaaccgttacggtttaaccgttttccggtaaaacccttaaaccgttttaaccttaacggtacccgtaaacccttaaaaccgtttaaccgtaaccgttaaccgttacccttttaaaccgttttacgtttttaccccgtttcggggtttacccgggggttaaccggggtaaccggggtttaacccgggaaaggttaccgggtaacctaaacggtaccgtaaaccggtaaccggttaacggtcgggttaccgtcgtacccgaaccgttaacccgttaacgttcctttacgggtacctttccttaccgtccccgttaccccg

SEQ ID NO: 63076 - DNA, 789 bp, Homo sapiens
  misc_feature: GYAE6OF01CERSR.35.64.F09.1.454.CMB.1.raw
  modified_base (506)..(506): a, c, t, g, unknown or other
  misc_feature (506)..(506): n is a, c, g, or t
  modified_base (526)..(526): a, c, t, g, unknown or other
  misc_feature (526)..(526): n is a, c, g, or t
  modified_base (759)..(759): a, c, t, g, unknown or other
  misc_feature (759)..(759): n is a, c, g, or t
tcagtacagatcgtcacgaccggtgctcgatttagcgcgtatacaagggggagtcacgacccagtcaggacacagcatggacatgacggtccccgctcagctccgtgggctccgtgctgctctggcctccaggtcgacctaaatgtacgactacgtccgagtacgtcgaccctacgtccctccccgtaccgacccttgtctcgccgtatcgttaggtaacggacgaacgtacggtacgttacctaacgtttaacgttaacggtttcgggaccggtaccgtagggttaaccggtaaggttaaaggtttaacggttaaaggttacggggttttcgggttaacggtccggtttaggtaaccgttacgaacggaacgtaaaccggtaaaaccggaacgggaaacccgtacccgtaacgtccgtaccgtagtaccgtaggtacgtacgggtccttcgttacgtacgtaaaccggtaacggtccggtaccgtacgtacgtacgcggtaccgngtacgtagtctcggtagganaacgtaacgtctaccgttacgacctacgtacgtacgtacgttccgactcgacgacctcgttagattacgttaacgtccgtaaaccttagttaactccgaacgtaacctaacgtacgttaactccgttaatttaaccgtttcgtttccgacgggttaccggtacggtacggtaaccgtaagttacgagttacgtacgaacgtacgtcggtacgacgtccgacgtacttacccgngttacctcgttcttccgtacctcccgttac

SEQ ID NO: 63077 - DNA, 511 bp, Homo sapiens
  misc_feature: GYAE6OF02HX2AT.35.64.F09.1.454.CMB.1.raw
  modified_base (402)..(402): a, c, t, g, unknown or other
  misc_feature (402)..(402): n is a, c, g, or t
tcagtacagatcgtcacgaccggtgctcgatttagcgcgtatacaagggggaggtcagacccagtcaggacacagcatggacatgagggtccccgctcagctcctggggctcctgctgctctggctcccaggtgccaaatgtgacatccagatgacccagtctccctccacctgtctgcatctgtaggagacagagtcactattacttgtcgggccagtgagagtataagtagttggttggcctggtatcagcagaaaccagggaaagcccctagactcctgatgtatagggcgtctgtctacaaatggggtcccacaaggttcagcggcagtggatctgggacagaattcactctcaccatcagtagcctgcagcctgatgtactttgactaactattacngtaccaacattacagctaacttactttcgtactttacgggcggtagggaccaagggtggacagtcaggacgaacgtgtcggctgcacatctgtctttcattcttacccg

SEQ ID NO: 63078 - DNA, 502 bp, Homo sapiens
  misc_feature: GYAE6OF02HA54M.35.64.F09.1.454.CMB.1.raw
tcagtacagatcgtcacgaccggtgctcgatttagcgcgtatacaagggggagtcagacccagtcaggacacagcatggacatgagggtccccgctcagctcctggggctcctgctgctctggctcccaggtgccaaatgtgacatccagatgacccagtctccctccaccctgtctgcatctgtaggagacagagtcactattacttgtcgggccagtgagagtataagtagttggttggcctggtatcagcagaaaccagggaaagcccctagactcctgatgtatagggcgtctgttctacaaaatggggtcccacaaggttcagcggcagtggatctgggacagaattcactctcaccatcagtagcctgcagcctgatgactttgcctaacctattactgcccaacattacagtcactttatttctctttcggcggtaggaccaaggtgacatcagacgaactggtcgctgcaccgattctgtcttcatccttcccg

SEQ ID NO: 63079 - DNA, 505 bp, Homo sapiens
  misc_feature: GYAE6OF02HNSVO.35.64.F09.1.454.CMB.1.raw
  modified_base (479)..(479): a, c, t, g, unknown or other
  misc_feature (479)..(479): n is a, c, g, or t
tcagtacagatcgtcacgaccggtgctcgatttagcgcgtatacaagggggagtcagacccagtcaggacacagcatggacatgagggtccccgctcagctcctggggctcctgctgctctggctcccaggtgccaaatgtgacatccagatgacccagtctccctccaccctgtctgcatctgtaggagacagagtcactattacttgtcgggccagtgagagtataagtagttggttggcctggtatcagcagaaaccagggaaagcccctagactcctgatgtatagggcgtctgttctacaaaatggggtcccaccaaggttcagcggcagtggatctgggacagaattcactctcaccatcagtagcctgcagcctgatgactttgctaaacctattactgacccaacattacagtctacttatttcctctttcgggcggtagggaccaagggtgaactatcagacgaacgtgnggctgcacatctgtctcatcctcccg

SEQ ID NO: 63080 - DNA, 492 bp, Homo sapiens
  misc_feature: GYAE6OF02F69WA.35.64.F09.1.454.CMB.1.raw
tcagtacagatcgtcacgaccggtgctcgatttagcgcgtatacaagggggagtcagacccagtcaggacacagcatggacatgagggtccccgctcagctcctggggctcctgctgctctggctcccaggtgccaaatgtgacatccagatgacccagtctccctccaccctgtctgcatctgtaggagacagagtcactattacttgtcgggccagtgagagtataagtagttggttggcctggtatcagcagaaaccagggaaagcccctagactcctgatgtatagggcgtctgttctacaaaatggggtccacaaggttcagcggcagtggatctgggacagaattcactctcaccatcagtagcctgcagcctgatgactttgcaactattactgccaacattacagtcactttattctctttcggcggagggaccaaggtggacatcagacgaactgtgctgcacgatctgtcttcatcttcccg

SEQ ID NO: 63081 - DNA, 508 bp, Homo sapiens
  misc_feature: GYAE6OF02IXSXI.35.64.F09.1.454.CMB.1.raw
  modified_base (412)..(412): a, c, t, g, unknown or other
  misc_feature (412)..(412): n is a, c, g, or t
tcagtacagatcgtcacgaccggtgctcgatttagcgcgtatacaagggggagtcagacccagtcaggacacagcatggacatgagggtccccgctcagctcctggggctcctgctgctctggctcccaggtgccaaatgtgacatccagatgacccagtctccctccaccctgtctgcatctgtaggagacagagtcactattacttgtcgggccagtgagagtataagtagttggttggcctggtatcagcagaaaccagggaaagcccctagactcctgatgtatagggcgtctgttctacaaaatggggtacccaccaaggttcagcggcagtggatctgggacagaattcactctcaccatcagtacgctgcagcctgatgactttgcaacctattactgcccaaanattaacagctactttattccttctttcggcggtaggaccaagggtggacagtcagacgaacgtgtcggctgcaccatctgtcttcacttcctcccg

SEQ ID NO: 63082 - DNA, 562 bp, Homo sapiens
  misc_feature: GYAE6OF02GT3WR.35.64.F09.1.454.CMB.1.raw
tcagtacagatcgtcacgaccggtgctcgatttagcgcgtatacaagggggagtcagacccagtcaggacacagcatggacatgagggtccccgctcagctcctggggctcctgctgctctggctcccaggtgccaaatgtgacatccagatgacccagtctccctccaccctgtctgcatctgtaggagacagagtcactattacttgtcgggccagtgagagtataagtagttggttggcctggtatcagcagaaaccagggaaagcccctagactcctgatgtatagggcgtctgttctacaaaatcggggtcccacaaggttcagcggcagtgatctgggacagaattcactctcaccatcagtacgctgcagcctgatgactttgacctaacctattaactcgaccctaaactacttaacacgactaactttattttccttcgttttccgggcggtaacgggtaaccgaaggggttggaactagtaccaggaacgtaacgtggtacggtctacggcctaccgtacttccttgttcctttactacttccttacccccg

SEQ ID NO: 63083 - DNA, 496 bp, Homo sapiens
  misc_feature: GYAE6OF02JHN8V.35.64.F09.1.454.CMB.1.raw
  modified_base (413)..(413): a, c, t, g, unknown or other
  misc_feature (413)..(413): n is a, c, g, or t
  modified_base (457)..(457): a, c, t, g, unknown or other
  misc_feature (457)..(457): n is a, c, g, or t
tcagtacagatcgtcacgaccggtgctcgatttagcgcgtatacaagggggagtcagacccagtcaggacacagcatggacatgagggtccccgctcagctcctggggctcctgctgctctggctcccaggtgccaaatgtgacatccagatgacccagtctccctccaccctgtctgcatctgtaggagacagagtcactattacttgtcgggccaggtgagagtataagtagttggttggcctgggtatcagcagaaaccagggaaagcccctagactcctgatgtatagggcgtctgttctacaaaatggggtacccaccaaggttcagcggcagtggatctgggacagaattcactctcaccatcagtagcctgcagcctgatgactttgcaacctattactgccaatnttacagcacttatttctctttcggcgtagggacctaaggtgacntcagacgactggtgctgcaccatctgtcttcatctcccg

SEQ ID NO: 63084 - DNA, 559 bp, Homo sapiens
  misc_feature: GYAE6OF02F542E.35.64.F09.1.454.CMB.1.raw
tcagtacagatcgtcacgaccggtgctcgatttagcgcgtatacaagggggagtcagacccagtcaggacacagcatggacatgagggtccccgctcagctcctggggctcctgctgctctggctcccaggtgccaaatgtgacatccagatcgacccagtcctccctccaccctgtctgcatctgtaggagacagagtcactattacttgtcggccagtgagagtataagtagttggtgctggtatcagcagaacgaggaacgccctagactcctgatgtagtagggcgtctgttactaacaaagtcgggtacccacgtaaggttcagcgcgagtggatcgtggacagtaatcactctcaccatcagtacgctgacacgtcctagatgtactttcgacctaaccttattaccgtcgaccctaactacttacgacgtacttaactttatttccttcggtttccgggacgggtaacggtaccgtaagggtcgaactagtacgacgaacgtagtggtacgctcgacctacacttcttacgtccttactacttccctacccg

SEQ ID NO: 63085 - DNA, 525 bp, Homo sapiens
  misc_feature: GYAE6OF02I5FDR.35.64.F09.1.454.CMB.1.raw
  modified_base (380)..(380): a, c, t, g, unknown or other
  misc_feature (380)..(380): n is a, c, g, or t
  modified_base (499)..(499): a, c, t, g, unknown or other
  misc_feature (499)..(499): n is a, c, g, or t
tcagtacagatcgtcacgaccggtgctcgatttagcgcgtatacaagggggagtcagacccgagttcaggacacagcatggacatgacgggtccccgctcagctcctggggctcctgctgctctggctcccaggtgccaaatgtgacagtccagatgacccagtctccctcaccctgtctgcatctgtaggtagacagagtcactattacttgtcgggccagtgagagtataagtagttggttggcctggtatcagcagaaaccagggaaagcccctagactcctgatgtatagggcgtctggttctacaaaatcggggtcccaccaaggttcaaggcggcagtggatcgtgggacagaattcactctcaccatcagtancctgcagcctgatgactttgctaacctattactcgaccaactattaacagactacttatttccttctttcgggcgtagggtacctaaggtcgacatcagacgaatggtacgctgctacncgtctcgtctttcacttcttaccccg

SEQ ID NO: 63086 - DNA, 539 bp, Homo sapiens
  misc_feature: GYAE6OF02HUFFC.35.64.F09.1.454.CMB.1.raw
tcagtacagatcgtcacgaccggtgctcgatttagcgcgtatacaagggggagtcagacccagtcaggacacagcatggacatgagggtccccgctcagctcctggggctcctgctgctctggctcccaggtgccaaatgtgacatccagatgacccagtctccctccaccctgtctgcatctgtaggagacagagtcactattacttgtcgggcagtgagagtataagtagttggttggctggtatcagcagaaaccgagggaaagcccctagactcctgatgtatagggcgtctgttctacaaatcggggtccaccgtaaggttcagcggcagtggatcgtgggacagaattcactctcaccatcagtacgcctgcagcctgattgactttgctaacctattaacctcgaccaaactacttaacagtaccttactttacttttctcgtttcgggacggtagggaacctaagggtgacaagtcgagacgtaacgtggtcggctgacaccgtagtcctgttctttctacttccctcccg

SEQ ID NO: 63087 - DNA, 526 bp, Homo sapiens
  misc_feature: GYAE6OF02GMQT4.35.64.F09.1.454.CMB.1.raw
tcagtacagatcgtcacgaccggtgctcgatttagcgcgtatacaagggggagtcagacccagtcaggacacagcatggacatgagggtccccgctcagctcctggggctcctgctgctctggctcccaggtgccaaatgtgacatccagatgacccagtctccctccaccctgtctgcatctgtaggagacagagtcactattacttgtcgggccagtgagagtataagtagttggttggcctggtatcagcagaaaccagggaaagcccctagactcctgatgtatagggcgtctgttctacaaatggggtcccacaaggttcagcggcaggtggatctgggacagaattcactctcaccatcagtagcctgcagcctgatgactttgcaacctattactgaccaactattacagtactactttatttctcgtttcgggcggtagggaccaagggttcggaacatcaggacgaacgtggtcggtctcgactacccatccgttgtcttactacttccgttccccg

SEQ ID NO: 63088 - DNA, 552 bp, Homo sapiens
  misc_feature: GYAE6OF02GA6O6.35.64.F09.1.454.CMB.1.raw
tcagtacagatcgtcacgaccggtgctcgatttagcgcgtatacaagggggagtcagacccagtcaggacacagcatggacatgagggtccccgctcagctcctggggctcctgctgctctggctcccaggtgccaaatgtgacatccagatgacccagtctccctccaccctgtctgcatctgtaggagacagagtcactattacttgtcgggccagtgagagtataagtagttggttggcctggtatcagcagaaaccagggaaagcccctagactcctgatgtatagggcgtctgttctacaaaatggggtccaccaaggttcagcggcagtggatctgggacagaattcactctcacatcagtacgctgcagcctgatgactttgaccaacctattactgaccaactattacagtcctaactttactttctccgttttcgggaccgggtaagggaccctaaagggtcggaactatccgagacgaacgtggtcggacttggacctaaccgacttcgttcgttcctttaccgtacttccgttacccccgg

SEQ ID NO: 63089 - DNA, 547 bp, Homo sapiens
  misc_feature: GYAE6OF02GDSOA.35.64.F09.1.454.CMB.1.raw
  modified_base (267)..(267): a, c, t, g, unknown or other
  misc_feature (267)..(267): n is a, c, g, or t
  modified_base (332)..(332): a, c, t, g, unknown or other
  misc_feature (332)..(332): n is a, c, g, or t
  modified_base (374)..(374): a, c, t, g, unknown or other
  misc_feature (374)..(374): n is a, c, g, or t
tcagtacagatcgtcacgaccggtgctcgatttagcgcgtatacaaggggggagtcagacccagtcaggacacagcatggacatgagggtccccgctcagctcctggggctcctgctgctctggctcccaggtgccaaatgtgacatccagatgacccagtctccctccaccctgtctgcatctgtaggagacagagtcactattacttgtcgggccagtgagagtataagtagttggttggcctggtatcagcagaaacagggaanccctagactcctgatgtatagggcgtctgttctacaaagtcgggtacccacgaaggttcagcggnagtggatcgtgggacagtaattcactctacaccatcagtacnctgcagcctgatgtactttgacctaactattactcgaccaactattacagtactactttactttccttacgtttcgggacggtacgggtaccgtaagggtcggaactatacgagaccggtacgtggtcgtactcgacctacgtattcctgttccttactacttccctaccccg

SEQ ID NO: 63090 - DNA, 581 bp, Homo sapiens
  misc_feature: GYAE6OF02FM2AL.35.64.F09.1.454.CMB.1.raw
  modified_base (341)..(341): a, c, t, g, unknown or other
  misc_feature (341)..(341): n is a, c, g, or t
tcagtacagatcgtcacgaccggtgctcgatttagcgcgtatacaaggggggagtcagacccagtcaggacacagcatggacatgagggtccccgctcagctcctggggctcctgctgctctggctcccaggtgccaaatgtgacatccagatgacccagtctccctccaccctgtctgcatctgtaggagacagagtcactattacttgtcgggccagtgagagtataagtagttggttggcctggtatcagcagaaaccagggaaacgcccctagactcctgatgtatagggcgtctgttctaacaaaagtcggggtacccacgtaaggttcaggcggnagtggatcgtgggacagaatcactctcacatcagtgcctgcagcctgatgactttgacctaacctattaactcgacccaaactattaacagtaccttaactttactttcttccgttttacgggaccgggtaacgggtacccaaagggttcggaactagttccaaggtaaccgtaacgttggtacgggctacggaccctacctacgttccgttcggttaccttcctacttcccgttccccg

SEQ ID NO: 63091 - DNA, 673 bp, Homo sapiens
  misc_feature: GYAE6OF02G7SNB.35.64.F09.1.454.CMB.1.raw
  modified_base (133)..(133): a, c, t, g, unknown or other
  misc_feature (133)..(133): n is a, c, g, or t
  modified_base (620)..(620): a, c, t, g, unknown or other
  misc_feature (620)..(620): n is a, c, g, or t
tcagtacagatcgtcacgaccggtgctcgatttagcgcgtatacaaggggagtcagaccagtcaggacacagcatggacatgagggtcccgctcagcctcctggggctcctgctgctcgtggctcccaggtcnccaaagtgtgacatccagatgacccagtctccctccaccctgtctgccatctgtaggagacaggactcacttaattacgttcgcgggcctagtgagaagttagtaagtaggttggttcggcctaggttagtcaggtactaggaaaccagggaaacgcccgtagaccgtacctaggactagtagtacggcgttacgtgttctaactaaaggtcggggttacccaacgtaaggttaccgacgtacggacaaggtcgagtccgtagggactaggtattaccacgtctaccacacgtccaaccgcgtacctacgccacggtacctcggactacgttatttacgactaacgttacttaacgttacgtaccctaaagtaacgtagttaggcgttaacggttcccttacgtacccgtttttaccgggaccccgtttagggaaccctaaacgggttacgaacttagtaacccgaacgtaacgtggttaacccggngttacgacctacctagtccgttactaccgtttaccgtacttcccgtacctacg

SEQ ID NO: 63092 - DNA, 622 bp, Homo sapiens
  misc_feature: GYAE6OF02I5HHU.35.64.F09.1.454.CMB.1.raw
  modified_base (268)..(268): a, c, t, g, unknown or other
  misc_feature (268)..(268): n is a, c, g, or t
  modified_base (445)..(445): a, c, t, g, unknown or other
  misc_feature (445)..(445): n is a, c, g, or t
tcagtacagatcgtcacgaccggtgctcgatttagcgcgtatacaagggggagtcagacccagtcaggacacagcatggacatgagggtccccgctcagctcctggggctcctgctgctctggctcccaggtgccaaatgtgacatccagatgacccagtctccctccaccctgtctgcatctgtaggagacagagtcactattacttgtcgggccagtgagagtataagtagttggttggcctggtatcagcaagaaaccagggaancccctagactcctgatgtatagggcgtctgttactacaaagtcggggtacccacctaaggttcaggcggcacggtggatcgtagggacagaattcactctcaccatcgtagtacgcctgaccagcctgtactcgtactttgacctaacctattaccgtgaccctaaactacttaacngtaccttaactttacttttcctcgttttaccgggacgggtaacggggtaaccctaaaggggttacggaacctaagttacgaacggtaaccggtaaacgtgggttaccggcgttacggaccctaacccgtacgttcgttacggttaccctttacgttaaccgttccccttacccccgg

SEQ ID NO: 63093 - DNA, 639 bp, Homo sapiens
  misc_feature: GYAE6OF02HAAZK.35.64.F09.1.454.CMB.1.raw
tcagtacagatcgtcacgaccggtgctcgatttagcgcgtatacaaggggggagtcagacccagtcaggacacagcatggacatgagggtccccgctcagctcctggggctcctgctgctctggctcccaggtgccaaatgtgacatccagatgacccagtctccctccaccctgtctgcatctgtaggagacagagtcactattacttgtcgggccagtgagagtatagtagttggtggctggtatcagcagaaaccagggaaacgcccctagacctcctgatgtatagggcgtcttgttctaacaaaagtcggggtacccaaccgtaaggttcaggcggcaggtggatcgtgggacagaattcactctacacatcagtacgcctgcacgcctgatgtactttgacctaaacctattactacgaccctaaactactttaccagtacctaacttttaacttttccgttaccgttttcggggacgggtaacgggtaacccgtaaaggggttcggaaacctacgttaccgacgggtaaccgtaaacggttcggttacggtaccgttcggaaccccgtaaccgtacgtttaccggtttacggttacccttttaccgttaccctttaccccgtttacccccgg

SEQ ID NO: 63094 - DNA, 541 bp, Homo sapiens
  misc_feature: GYAE6OF02IRT7J.35.64.F09.1.454.CMB.1.raw
  modified_base (269)..(269): a, c, t, g, unknown or other
  misc_feature (269)..(269): n is a, c, g, or t
  modified_base (382)..(382): a, c, t, g, unknown or other
  misc_feature (382)..(382): n is a, c, g, or t
tcagtacagatcgtcacgaccggtgctcgatttagcgcgtatacaagggggagtcagacccagtcaggacacagcatggacatgagggtccccgctcagctcctggggctcctgctgctctggctcccaggtgccaaatgtgacatccagatgacccagtctccctccaccctgtctgcatctgtaggagacagagtcactattacttgtcgggccagtgagagtataagtagttggttggcctggtatcagcagaaaccagggaaacncccctagactcctgatgtatagggcgtctgttctacaaagtggggtcccacaaggttcagcggcagtgatctgggacagaattcactctcaccatcagtcgcctgcacgcctnatgtactttgactaacttatacctgaccaactattacagacctactttatttcgttacgtttcgggacggtacgggacctaagggtcggactatccgagacgtaacgtggtcggtactcggccacctattctacgttcctttacaccttccttaccccg

SEQ ID NO: 63095 - DNA, 593 bp, Homo sapiens
  misc_feature: GYAE6OF02I5YXN.35.64.F09.1.454.CMB.1.raw
  modified_base (345)..(345): a, c, t, g, unknown or other
  misc_feature (345)..(345): n is a, c, g, or t
  modified_base (426)..(426): a, c, t, g, unknown or other
  misc_feature (426)..(426): n is a, c, g, or t
  modified_base (516)..(516): a, c, t, g, unknown or other
  misc_feature (516)..(516): n is a, c, g, or t
tcagtacagatcgtcacgaccggtgctcgatttagcgcgtatacaagggggagtcagacccagtcaggacacagcatggacatgagggtccccgctcagctcctggggctcctgctgctctggctcccaggtgccaaatgtgacatccagatgacccagtctccctccaccctgtctgcatctgtaggagacagagtcactattactgtcgggccagtgagagtataagtagttggtggctggtatcagcaagaaaccagggaaacgcccctagactcctgatgtatacgggcgttcgtgttactaacaaaagttcggggtaccccaaccgtaaggttcagcggnaggtggatcgtgggacagtaactcactctacacatacagtgcctgcacgcctgattgtactttcgacctaaccgtattacncgtacccaaactattaaccagtaccttaacttttactttccttccggttttacgggacgggtaacgggtaacccgtagggtacggaaacngttacgacggtaacgtaacggtcgtaggcctcgacctaaccgtattccgtcgttaccttcctacgttcccttcccgg

SEQ ID NO: 63096 - DNA, 502 bp, Homo sapiens
  misc_feature: GYAE6OF02FGF9E.35.64.F09.1.454.CMB.1.raw
  modified_base (405)..(405): a, c, t, g, unknown or other
  misc_feature (405)..(405): n is a, c, g, or t
  modified_base (420)..(420): a, c, t, g, unknown or other
  misc_feature (420)..(420): n is a, c, g, or t
tcagtacagatcgtcacgaccggtgctcgatttagcgcgtatacaagggggagtcagacccagtcaggacacagcatggacatgagggtccccgctcagctcctggggctcctgctgctctggctcccaggtgccaaatgtgacatccagatgacccagtcctccctccaccctgtctgcatctgtaggagacagagtcactattacttgtcgggccagtgagagtataagtagttggttggcctggtatcagcagaaaccagggaaagcccctagactcctgatgtatagggcgtctgttctacaaaatggggtcccacaaggttcagcggcagtggatctgggacagaattcactctcaccatcaccagcctgcagctgatgattttgactaacctattactnaccaacagtatggtnattccgtctactttcggccctgggaccaagtggatatacaacgactggtggctgctacatctgtcttcactccttcccgtcc

SEQ ID NO: 63097 - DNA, 551 bp, Homo sapiens
  misc_feature: GYAE6OF02GGMTH.35.64.F09.1.454.CMB.1.raw
tcagtacagatcgtcacgaccggtgctcgatttagcgcgtatacaagggggagtcagacccagtcaggacacagcatggacatgagggtccccgctcagctcctggggctcctgctgctctggctcccaggtgccaaatgtgacatccagatgacccagtctccctccaccctgtctgcatctgtaggagacagagtcactattacttgtcgggccagtgagagtataagtagttggttggcctggtatcagcaagaaaccagggaaagcccctagactcctgatgtagtagggcgtctgttactaacaaaagtcggggtacccaaccgtaaggttcaggccggctaggtggatcgtgggacagattcactctacaccatcagtacgcctcgcacgcctgtatcgtactttacgactaacctacttactacgacctaactattacacgtactacttagggtttcttcgtttcggtcggtacgggaccgtaaggtgacgatacagacgaacgtgtaggtcgtcgacacactctcgtcttactactcttcccg

SEQ ID NO: 63098 - DNA, 833 bp, Homo sapiens
  misc_feature: GYAE6OF02HA4P0.35.64.F09.1.454.CMB.1.raw
  modified_base (190)..(190): a, c, t, g, unknown or other
  misc_feature (190)..(190): n is a, c, g, or t
tcagtacagatcgtcacgaccggtgctcgatttagcgcgtatacaagggggagtcagacccagtcaggacacagcatggacatgagggtccccgctcagctcctggggctcctgctgctctggctcccaggtgccaaatgtgacatccagatgacccagtctccctccaccctgtctgcatctgtagganacagagtcacttattacttgtcgggccagtgagagtataagtagttggtgcctggtatcagcaagaaaccgaggggaaaacgccccctaaggaaccttcccgtaggtaacgttgttaaggtaacggggtccgttccttacggtttaccttaaacgtaaaaacggttccggggggttacccccaaacccgttaaaggggtttaccaacgggtaccgggacgtacggttacgggtaacttccgggttaggggaacctaacgggtaaattttacccgaactttccgtaccctaacccgtaagttacccgtaagggtaaccggtaccccgttggacccgtaacgggtacccctttagggaactttcggtaacctttttacgggaaccctaaaaccgtttaaccttttaaccgttaccggtaaccccctaaaactttaacgtttaaacccgtaacggttacccttaaacctttttttaacgttttacccttttaacccggtttttcggggaacccgggtaacgggtaaacccgtaaaggggtttacgaaccgttacgttaccgaacggtaccggtaacgttcggtacgggccttaagggaccctaacgtagttccttaggttccctttactaccttacccgtcccccg

SEQ ID NO: 63099 - DNA, 745 bp, Homo sapiens
  misc_feature: GYAE6OF02HPNIE.35.64.F09.1.454.CMB.1.raw
  modified_base (274)..(274): a, c, t, g, unknown or other
  misc_feature (274)..(274): n is a, c, g, or t
tcagtacagatcgtcacgaccggtgctcgatttagcgcgtatacaagggggagtcagacccagtcaggacacagcatggacatgagggtccccgctcagctcctggggctcctgctgctctggctcccaggtgccaaatgtgacatccagatgacccagtctccctccaccctgtctgcatctgtaggagacagagtcactattacttggtcgggcctaggtagagagtataaggtagttggttggcctggtatcagcaagaaacagggaaacncccctaagactcctgatgtataggtcgtctgttactacaaaagtcgggtacccacgaaggttcaggcgcagtggactcgtgggacaggtaaattcgacctcttacaaccactcgtaacgtaacgtcccgtagctaacgcccgtagacttacggtaacttttcggaccctaaaacctttgtttaaaccgtacggtaccccaaaaacgtttaacgttaaacccaaccggtttaactaaacccgttttttatttttaaccccgttacggttttttacccggggaaccggggtaaacggggtaaacccttaaaagggggttacgtaaacccgtaaagttcccggaaacggggttaacccgttaaaacgggttcgggttacccgggtacgttaaccggtaacccgtaaccgttaccgtttaaccggttacccggtttaccctttaacggttacccccgtttccccgtaacccccgg

SEQ ID NO: 63100 - DNA, 549 bp, Homo sapiens
  misc_feature: GYAE6OF02IDOJ6.35.64.F09.1.454.CMB.1.raw
  modified_base (341)..(341): a, c, t, g, unknown or other
  misc_feature (341)..(341): n is a, c, g, or t
  modified_base (423)..(423): a, c, t, g, unknown or other
  misc_feature (423)..(423): n is a, c, g, or t
tcagtacagatcgtcacgaccggtgctcgatttagcgcgtatacaagggggagtcagacccagtcaggacacagcatggacatgagggtccccgctcagctcctggggctcctgctgctctggctcccaggtgccaaatgtgacatccagatgacccagtctccctccaccctgtctgcatctgtaggagacagagtcactattacttgtcgggccagtgagagtataagtagttggttgcctggtatcagcagaaacaggaacgcccctagactcctgatgtagtaggtcgtctgttctaacgaaagtcgggtccaacaaggttcagcggcagtgatcgnggacagtaatcactctcactatcagtacgcctgcagtccgtagatgtactttagactaacttatactgaccaatacttaacngtactaatttctttcgtcgttacgggacggtaacggaacctaagggtcgaactagtacgaacgacgtaacgtggtacgcgtcgacctaccgtacttcgtacgttcttacctactcccgttaccccg

SEQ ID NO: 63101 - DNA, 579 bp, Homo sapiens
  misc_feature: GYAE6OF02GG4W0.35.64.F09.1.454.CMB.1.raw
  modified_base (190)..(190): a, c, t, g, unknown or other
  misc_feature (190)..(190): n is a, c, g, or t
  modified_base (267)..(267): a, c, t, g, unknown or other
  misc_feature (267)..(267): n is a, c, g, or t
  modified_base (427)..(427): a, c, t, g, unknown or other
  misc_feature (427)..(427): n is a, c, g, or t
tcagtacagatcgtcacgaccggtgctcgatttagcgcgtatacaagggggagtcagacccagtcaggacacagcatggacatgagggtccccgctcagctcctggggctcctgctgctctggctcccaggtgccaaatgtgacatccagatgacccagtctccctccaccctgtctgcatctgtagganacagagtcactattacttgtcggcagtgagagtataagtagttggttggcctggtatcagcaagaaaccagggaacncccctagactcctgatgtagtagggcgtctgttactaacaaaagttcgggggtacccaaccgtaaggttcacggcggacaggtggatcgtgggacagtaattcactctacactatacagtacgcctgcacgctagatgtactttcgactaacctattacngacctaactacttacacgtacctaactttactttcctcgtttacgggcgggtaacgggtaccgtaagggtcgaactagtacgacgaaccgaacgttggtacggtctacggacctactacgttcgttcgttacttcgtacttcccttaccccg

SEQ ID NO: 63102 - DNA, 575 bp, Homo sapiens
  misc_feature: GYAE6OF02FY5V7.35.64.F09.1.454.CMB.1.raw
tcagtacagatcgtcacgaccggtgctcgatttagcgcgtatacaagggggagtcagacccagtcaggacacagcatggacatgagggtccccgctcagctcctggggctcctgctgctctggctcccaggtgccaaatgtgacatccagatgacccagtctccctccaccctgtctgcatctgtagagacagagtcactattacttgtcgggccagtgagagtataagtagttggttggcctggtatcagcagaaaccagggaaacgcccctagactcctgatgtatagggcgtctgttctaacaaagtcggggtcccacgaaggttcagcgcagtggatcgtgggacagaattcactctcaccatcagtacgcctgcagcctgatgtactttgcctaaccttattacctcgaccaactacttaacagtcctaacttttactttccttcgtttccggacgggacgggtaccgtaagggtacggactacgtaccacggaaccgtaacgttcggtacgggtactcggacctacccgtattccttagttaccctttctacctttcccgttacccccg

SEQ ID NO: 63103 - DNA, 497 bp, Homo sapiens
  misc_feature: GYAE6OF02GBAT5.35.64.F09.1.454.CMB.1.raw
  modified_base (492)..(492): a, c, t, g, unknown or other
  misc_feature (492)..(492): n is a, c, g, or t
tcagtacagatcgtcacgaccggtgctcgatttagcgcgtatacaagggggagtcagacccagtcaggacacagcatggacatgaggctccccgctcagctcctggggctcctgctactctggctccgaggtgccagatgtgacatccagatgacccagtctccggcctccctgtctggtgctgtcggagacagactgaccatcacttgccgggcaagtcagaccgttcgcgtctatttaaattggtatcagcagaaaccagggaacgcccctcagctgctgctctatactgtatctagtttccatcttggggtcccatcaaggttcagtggcagtggttctgggacagatttcacttctcactatcagcagtctgcaacctgaagatgttgcaaacttactactgtacaacagacttacaggccccattctactttcggccctgggacccacagtacgaatccgagcaactgtcggctcgcaccatctgtnttacc

SEQ ID NO: 63104 - DNA, 624 bp, Homo sapiens
  misc_feature: GYAE6OF02F35ZV.35.64.F09.1.454.CMB.1.raw
  modified_base (399)..(399): a, c, t, g, unknown or other
  misc_feature (399)..(399): n is a, c, g, or t
  modified_base (404)..(404): a, c, t, g, unknown or other
  misc_feature (404)..(404): n is a, c, g, or t
tcagtacagatcgtcacgaccggtgctcgatttagcgcgtatacaagggggagtcagacccagtcaggacacagcatggacatgagggtccccgctcagctcctggggctcctgctgctctggctcccaggtgccaaatgtgacatccagatgacccagtctccctccaccctgtctgcatctgtaggagacagagtcactattacttgtcgggccagtgagagtataagtagttggttggcctggtatcagcaagaaaccagggaaacgcccctaagacctcctgatggtagtacggggcttcgtgttacctaacgaaaagtcggggtacccaacgtaagggttcaggccggcaggtcggatcgtagggacagtaattcactcctcacactcagtacnccgtncagccttagagttggtacttttcggacctaaaccgttatttaaccgtcgaccctaactacgtttaacgacgtactaacttttacttttaccgttcggttttaccgggacgggtaacgggaaccgtaaggtcggtaacacgttacgaacggtacgaacgttcggaggtccgtacgacctaacgtacgtttcgtagtttccctactaccttccgttaccccg

SEQ ID NO: 63105 - DNA, 530 bp, Homo sapiens
  misc_feature: GYAE6OF02HWAJV.35.64.F09.1.454.CMB.1.raw
  modified_base (435)..(435): a, c, t, g, unknown or other
  misc_feature (435)..(435): n is a, c, g, or t
  modified_base (496)..(496): a, c, t, g, unknown or other
  misc_feature (496)..(496): n is a, c, g, or t
tcagtacagatcgtcacgaccggtgctcgatttagcgcgtatacaaggggggagtcagacccagtcaggacacagcatggacatgagggtccccgctcagctcctgggggctcctgctgctctggctcccaggtgccaaatgtgacatccagatgacccagtctccctccaccctgtctgcatctgtaggagacagagtcactattacttgtcgggcagtgagagtataagtagttggttggctggtatcagcagaaacgagggaacgccctagctctgatgtataggtcgtctgttactaacaaaagtcggggtacccaacgtaaggttcaggtcggcgaggtggatcgtagggacagtaattcactctacacatcagtacgcctgcagcctagatgtactttcgacctaacctatacgtcaccaactatacanactacttattcttcgttcggcggacggactagggtacgacatcgacgacgtacgtggtcgntcgcactgtctcgttacttctacttccttacccg

SEQ ID NO: 63106 - DNA, 735 bp, Homo sapiens
  misc_feature: GYAE6OF02JZEM8.35.64.F09.1.454.CMB.1.raw
  modified_base (190)..(190): a, c, t, g, unknown or other
  misc_feature (190)..(190): n is a, c, g, or t
tcagtacagatcgtcacgaccggtgctcgatttagcgcgtatacaagggggagtcagacccagtcaggacacagcatggacatgagggtcccgctcagctcctggggctcctgctgctctggctcccaggtgccaaatgtgacatccagatgacccagtctccctccaccctgtctgacatctgtagganacagagtcactattacgttgtcgggacctagtcggagtacgtaataaggtaggtttggtggaccttgggtattcaggacctaggaaaccgaggggaaacctccccgttaggaacctccgtacgtagttaggtagtacgggtcttacgttgttactaacgtaaaaggttccggggtacccaacgtaagggttaccaaggtccggtacgtacggtaggtaccttacggacgggtactaacggtaacttacacgttccgtaaccgacctaacgttcgaacgttctaccgtcggacaccgtcgtacgtacgtacgttaccgttcgtaaccgtaaccgttacttaccgtacgtacctacacgttaacgacggtacttaacgttacgtttaccgttaccggtttacgggtaacggtaacgggtactaacggggttacgtaaccgttacgtaccggtaggaaccgtttacggcggttaagggtccttaaccggaccttaccgttaacttaccgttacgttcccgttaactttaccgttcccgtttaacccgg

SEQ ID NO: 63107 - DNA, 598 bp, Homo sapiens
  misc_feature: GYAE6OF02G0CCG.35.64.F09.1.454.CMB.1.raw
tcagtacagatcgtcacgaccggtgctcgatttagcgcgtatacaaggggggagtcagacccagtcaggacacagcatggacatgagggtccccgctcagctcctggggctcctgctgctctggctcccaggtgccaaatgtgacatccagatgacccagtctccctccaccctgtctgcatctgtaggagacagagtcactattacttgtcgggcagtgagagtataagtagtggtgctggtatcagcagaaccaggaagccctagactcctgatcttaaggcgtctacttagagagtcgggtccatcgaaggttcagcggcaggtggagtcgtgggacagtacttcactctcaccatccaccacgccgtgctacgcctgattgtattttcgacctaaccttattacctcgtaccctaactagtacgttggtacggtactttcccggtacttaccgtttaccgggtccccgttacgggaacccgtaaaggttacggaacttacgtaaccgtaacggaacgttacgggtacggaccgttacgaccgtacccgtagttaccgttcgttaccttccgtaactttcccgttaccccgtacc

SEQ ID NO: 63108 - DNA, 634 bp, Homo sapiens
  misc_feature: GYAE6OF02G2362.35.64.F09.1.454.CMB.1.raw
  modified_base (277)..(277): a, c, t, g, unknown or other
  misc_feature (277)..(277): n is a, c, g, or t
  modified_base (403)..(403): a, c, t, g, unknown or other
  misc_feature (403)..(403): n is a, c, g, or t
tcagtacagatcgtcacgaccggtgctcgatttagcgcgtatacaagggggagtcagacccagtcaggacacagcatggacatgagggtccccgctcagctcctggggctcctgctgctctggctcccaggtgccaaatgtgacatccagatgacccagtcctccctccaccctgtctgcatctgtaggagacagagtcactattacttggtcgggcctagtgagagtataaggtagttggttggcctggtatcagacaagaaaccgaagggaaacnccccgtagactcctgatgtagtagggcttctgttctaacaaagtcgggtacccaccgtaaggtcagcggcagtggactcgtagggacaagtacttcactctacacctatccgtaagtcgcctgacncgtcctgtatcgtactttcgactaacccttattacctacgaaccctaaatacttacacgtacctaactttacttttccttacggtttccggggacggtaacgggtaccgtaaggtacggaatacgtacgaacggtaaccgtaacggttcgggtacgtacccgtacgtaccccgtaaccgtaagtttcccgttaggtttaccctttacccgttaccttccccgttacccccg

SEQ ID NO: 63109 - DNA, 609 bp, Homo sapiens
  misc_feature: GYAE6OF02GBCSB.35.64.F09.1.454.CMB.1.raw
  modified_base (299)..(299): a, c, t, g, unknown or other
  misc_feature (299)..(299): n is a, c, g, or t
tcagtacagatcgtcacgaccggtgctcgatttagcgcgtatacaagggggagtcagacccagtcaggacacagcatggacatgagggtccccgctcagctcctggggctcctgctgctctggctcccaggtgccaaatgtgacatccagatgacccagtcctccctccaccctgtctgcatctgtaggagacagagtcactattacttgtcggccagtgagagtataagtagttggtggctggtatcagcagaacagggaagcccctagactcctgatgtagtaggcgtctgttctanaaagtcgggtccacgaagttcagcgcgagtggactcgtgggacagtaattcgactctacacctatacgagtacgcctcgactacgcctgattcgactttacgactaaccctagttacctcgaccctaaactactttaacacgtacctaactttttacttacccgtttacgttttaccgggtacggggtaaccgggtaaccgttaaagggtcggaaacctagttacgaacggaaccgtacggtggtaccggcgttacgtaccaaccgttattaccgtctttaccgtttacctacgttacccgttacccccg

SEQ ID NO: 63110 - DNA, 591 bp, Homo sapiens
  misc_feature: GYAE6OF02GX6GQ.35.64.F09.1.454.CMB.1.raw
tcagtacagatcgtcacgaccggtgctcgatttagcgcgtatacaaggggggagtcagacccagtcaggacacagcatggacatgagggtccccgctcagctcctggggctcctgctgctctggctcccaggtgccaaatgtgacatccagatgacccagtctccctccaccctgtctgcatctgtaggagacagagtcactattacttgtcgggccagtgagagtataagtagttggtggcctggtatcagcaagaaaccagggaaacgcccctagacctcctgatgtatagggcgtctgttctaacaaaagtcggggtacccaaccgtaaggttcaggcggcaggtggatcgtgggacagaattcactctacacatcagtagcctgcagcctgactgtactttgacctaacctattactcgacctaaactacttaacagtacttaactttatttccttacgtttcgggacggtaacgggaccgtaaagggtcgaactacgtacgaagtaaccgtaacgttgggtacggtaccgttgacctaacccgtagttaccttcggttacctttactacgtttacccttaccccgg

SEQ ID NO: 63111 - DNA, 579 bp, Homo sapiens
  misc_feature: GYAE6OF02HDBHM.35.64.F09.1.454.CMB.1.raw
  modified_base (267)..(267): a, c, t, g, unknown or other
  misc_feature (267)..(267): n is a, c, g, or t
  modified_base (435)..(435): a, c, t, g, unknown or other
  misc_feature (435)..(435): n is a, c, g, or t
tcagtacagatcgtcacgaccggtgctcgatttagcgcgtatacaagggggagtcagacccagtcaggacacagcatggacatgagggtccccgctcagctcctggggctcctgctgctctggctcccaggtgccaaatgtgacatccagatgacccagtctccctccaccctgtctgcatctgtaggagacagagtcacttattacttggtcgggcagtgagagtataagtagttggtgcctggtatcgagcagaaccagggaacncccctagactcctgatgtatacgggcgtctcgttctacgtaaaagtcggggtcccaaccgtaacggttcaggacggcaggtcggtagtcgtggggaacaggtacttcgactctacacctatacagtacgcctagcagctgactgtacttcgactaacctattaccgtnacctaacactacacgtctactttacttcttcgttcggacggtacggaccgtaggtcgacgtagtacacggtacgtacgtcggtaggtccgtacgaccgtacctacgttcgttaccgttaccgttctaccgttcccgttaccccg

SEQ ID NO: 63112 - DNA, 644 bp, Homo sapiens
  misc_feature: GYAE6OF02I2YM9.35.64.F09.1.454.CMB.1.raw
  modified_base (260)..(260): a, c, t, g, unknown or other
  misc_feature (260)..(260): n is a, c, g, or t
  modified_base (276)..(276): a, c, t, g, unknown or other
  misc_feature (276)..(276): n is a, c, g, or t
  modified_base (498)..(498): a, c, t, g, unknown or other
  misc_feature (498)..(498): n is a, c, g, or t
tcagtacagatcgtcacgaccggtgctcgatttagcgcgtatacaagggggagtcagacccagtcaggacacagcatggacatgagggtccccgctcagctcctggggctcctgctgctctggctcccaggtgccaaatgtgacatccagatgacccagtctccctccaccctgtctgcatctggtaggagacagacgtcaattattacttcgtcgggcctaggtgagtacgtataagtggttggtcgccttgtatcagnaagaaaccgaggaacnccctagactcctgactgtagtaggtcgtctacgttactaacaaacgttcgggtaccctaaccgtaaggtttaccaggtaccggctacgggtggaagttcgtacgggactaaaggtaacttcgacctacgtcaaccctagtacgtaacgtacgcctcggacagccgtagtgttaccgtacttcggaacctaaccgttattacgttacgccctaaatacttacnctacgttacctttagtttcctaccgtttacggacgggtaacggtacgtaaggtcgaacgtacgttacgacgtaacgtacgtcggtacgtacgtactacgaacccggttattccgtacgttacccttcgttaccgtcccgttacccg

SEQ ID NO: 63113 - DNA, 585 bp, Homo sapiens
  misc_feature: GYAE6OF02HCXJN.35.64.F09.1.454.CMB.1.raw
  modified_base (374)..(374): a, c, t, g, unknown or other
  misc_feature (374)..(374): n is a, c, g, or t
  modified_base (381)..(381): a, c, t, g, unknown or other
  misc_feature (381)..(381): n is a, c, g, or t
tcagtacagatcgtcacgaccggtgctcgatttagcgcgtatacaaggggggagtcagacccagtcaggacacagcatggacatgagggtccccgctcagctcctggggctcctgctgctctggctcccaggtgccaaatgtgacatccagatgacccagtctccctccaccctgtctgcatctgtaggagacagagtcactattacttgtcgggccagtgagagtataagtagttggttgcctggtatcagcagaaaccagggaaacgcccctagactcctgatgtagtagggcgtctgttactaacgaaaagtcggggtacccaccgaaggttcaggcggcagtggatcgtgggacagaattcactctcacntcagtancctgcagcctgtactgtactttcgacctaaccttattaacctcgtaccaaactactttaacacgtacttactttacttttaccttcgtttcggggacggtaacgggaaccgtaagggtcgaactagtaccgacggaacgtaacgttggtcggtacgtagaccctacgtacttcgttgttcctttactacgttccccttaccccg

SEQ ID NO: 63114 - DNA, 592 bp, Homo sapiens
  misc_feature: GYAE6OF02JVEZT.35.64.F09.1.454.CMB.1.raw
  modified_base (190)..(190): a, c, t, g, unknown or other
  misc_feature (190)..(190): n is a, c, g, or t
tcagtacagatcgtcacgaccggtgctcgatttagcgcgtatacaagggggagtcagacccagtcaggacacagcatggacatgagggtccccgctcagctcctggggctcctgctgctctggctcccaggtgccaaatgtgacatccagatgacccagtctccctccaccctgtctgcatctgtagganacgagagtcactattacttgtcggccagtgagatagtaagtagttggttggcctggtatcagcagaaacgaggaaacgccctaagactccgtgatgtaagtaggcgtctgttactaactaaagtcgggtacccacgtaaggttcaggcgacgagtggatcgtaggacagtaacgttcactctacacatgagtacgcctgaccacgtctaggatagtacttcggactaaccttattacgtacgtaaccaactacttacgacgtaccttactttactttccttccgtttacggccggtacggaaccgtaagggttacgaacgtacgtacgacgttacgaaccgtggttcgtacgtccgtaccgtaccgttactcgtcgtttactccgtacctttccgtaccccg

SEQ ID NO: 63115 - DNA, 595 bp, Homo sapiens
  misc_feature: GYAE6OF02IRZ5N.35.64.F09.1.454.CMB.1.raw
  modified_base (387)..(387): a, c, t, g, unknown or other
  misc_feature (387)..(387): n is a, c, g, or t
  modified_base (436)..(436): a, c, t, g, unknown or other
  misc_feature (436)..(436): n is a, c, g, or t
tcagtacagatcgtcacgaccggtgctcgatttagcgcgtatacaagggggagtcagacccagtcaggacacagcatggacatgagggtccccgctcagctcctggggctcctgctgctctggctcccaggtgccaaatgtgacatccagatgacccagtctccctccaccctgtctgcatctgtaggagacagagtcactattacttgtcgggcagtgagagtataagtagttggttgctggtatcagcagaaaccagggaaacgccctaagactcctagatgtatagggcgttctgttactaacgtaaagtcggggtaccccaacgtaaggttcaggcggcgaggtcggatcgtgggacagtaattcactctacaccatcagtcnctgcagcctgatgtacttgacctaacttatactcgaccaactattaacnacttactttatttccttacggtttcgggaccgggtaacggtaaccgtaagggtcgaacgtagtaccgaacggtacgtaaccggtgggtaccggtacctacggaccctaccgtattcccggttagttacccgtttaccctacctttccccgttacccccg

SEQ ID NO: 63116 - DNA, 608 bp, Homo sapiens
  misc_feature: GYAE6OF02H7DA0.35.64.F09.1.454.CMB.1.raw
  modified_base (253)..(253): a, c, t, g, unknown or other
  misc_feature (253)..(253): n is a, c, g, or t
  modified_base (299)..(299): a, c, t, g, unknown or other
  misc_feature (299)..(299): n is a, c, g, or t
tcagtacagatcgtcacgaccggtgctcgatttagcgcgtatacaaggggggagtcagacccagtcaggacacagcatggacatgagggtccccgctcagctcctgggggctcctgctgctctggctcccaggtgccaaatgtgacatccagatgacccagtcctcccctccaccctgtctgcatctgtaggagacagagtcactattacttgtcgggccagtgagagtatagtagttggttgccgtggtatnagcagaaccgagggaacgccctagactcctagatgtagtaggcgtntgttctaactaaagtcgggtacccacgaggttcaggcggcagtgagtcgtaggacagtaattctactctacacctatactagtacgcctacgcgacgtccgtgtacgtagtactttacgtacctaaccgttacttaaccttacgtacctaactaacttactacgtactactttactttaccttcgtttcgggtacgggtacgggtaaccggtaacgggtaggaacgtacgtacgtacgtaacgtaacgtcggtacggtcgtccgtaccactacgtacttcggggggttccttcttaccttccttccccg

SEQ ID NO: 63117 - DNA, 633 bp, Homo sapiens
  misc_feature: GYAE6OF02HSUZP.35.64.F09.1.454.CMB.1.raw
  modified_base (260)..(260): a, c, t, g, unknown or other
  misc_feature (260)..(260): n is a, c, g, or t
  modified_base (319)..(319): a, c, t, g, unknown or other
  misc_feature (319)..(319): n is a, c, g, or t
  modified_base (330)..(330): a, c, t, g, unknown or other
  misc_feature (330)..(330): n is a, c, g, or t
  modified_base (367)..(367): a, c, t, g, unknown or other
  misc_feature (367)..(367): n is a, c, g, or t
  modified_base (471)..(471): a, c, t, g, unknown or other
  misc_feature (471)..(471): n is a, c, g, or t
  modified_base (477)..(477): a, c, t, g, unknown or other
  misc_feature (477)..(477): n is a, c, g, or t
  modified_base (551)..(551): a, c, t, g, unknown or other
  misc_feature (551)..(551): n is a, c, g, or t
  modified_base (584)..(584): a, c, t, g, unknown or other
  misc_feature (584)..(584): n is a, c, g, or t
  modified_base (597)..(597): a, c, t, g, unknown or other
  misc_feature (597)..(597): n is a, c, g, or t
tcagtacagatcgtcacgaccggtgctcgatttagcgcgtatacaaggggagtcagacccagtcaggacacagcatggacatgaggtccccgctcagctccgtggggctcctgctgctctggctcccgaggtcgccaaatgtgacatccagatgacccagtcctccctccacccgtgtcctgacatctgtaggagacaggctcacttattacttggtccgggcagtgagagtataagtagttcggttagcgttaggtatnagcaagaaaccgagggaaaccgacccctagaacttcctagacttaggacgtagggcttntagttactaanaaagttccgggtcaacccgtaaggttcaacgtcgganacggtagctacgtgggacagtaacttcgaactcgactacacgtacaggttaccaccgtcgacctacggccttagacttgttacttcgaacctaaccgttatacnccgtanaaccgttattaccgatacgtaacttttcgtttacctcgtttaccggaggtaacgggtaaccgtaggaccgtaanaccgtagaccgtaacgtaacgtcgtggttccgngaccctaacggtnttcccgtaatttccgtacttacgtccttaaccccgg

SEQ ID NO: 63118 - DNA, 624 bp, Homo sapiens
  misc_feature: GYAE6OF02F10PK.35.64.F09.1.454.CMB.1.raw
  modified_base (192)..(192): a, c, t, g, unknown or other
  misc_feature (192)..(192): n is a, c, g, or t
  modified_base (268)..(268): a, c, t, g, unknown or other
  misc_feature (268)..(268): n is a, c, g, or t
tcagtacagatcgtcacgaccggtgctcgatttagcgcgtatacaaggggggagtcagacccagtcaggacacagcatggacatgagggtccccgctcagctcctggggctcctgctgctctggctcccaggtgccaaatgtgacatccagatgacccagtcctccctccaccctgtctgcatctgtagganacagatcactattacttgtcgggccagtgagagtataagtagttggttgctggtatcagcagaaaccgagggaacncccctagactcctgatgtagtagggcgtctgtactaacaaagtcgggacccacgtaacggttcagcggcagtggtatcgtacgggacagtatcactctcactatcgagtacgcctacgacacgtccgtagtacgttagttaccgttttacgacctaaacccttatttaacctcgtaacccgtaaactaacgttaaccgacgtaccttacttttactttacgttaccgtttacgggtaccgggtaacgggtaaccgtacgggtacggtaactagtaccgtagtaaccggtaaggtcggtggtaccgtcgtaccgaacctacgttcgttaccgttcttacctaccgttcccttacccg

SEQ ID NO: 63119 - DNA, 661 bp, Homo sapiens
  misc_feature: GYAE6OF02IDDJV.35.64.F09.1.454.CMB.1.raw
  modified_base (615)..(615): a, c, t, g, unknown or other
  misc_feature (615)..(615): n is a, c, g, or t
tcagtacagatcgtcacgaccggtgctcgatttagcgcgtatacaagggggagtcagacccagtcaggacacagcatggacatgagggtccccgctcagctcctggggctcctgctgctctggctcccaggtgccaaatgtgacatccagatgacccagtcctccctccacctgctgcatctgtaggagacagagtcaacttattacgttggtaccggccagtagagtagtagtaagttaggttggttgtccgtggtactcgagacgaacgaaaccgaagggaaaccgtccccgtagtaccttcctagtatggtaagtcgggtcgttcgtcgtttactaacgtaaacggtccggggtacccaacgtaacggttacaggcggacgtaggtcggtacgtcgtacgggaacaacgtacttaccgacttccgtacacctataccgtagttaacgccgtagccgtacgtccgtagtaactcggttactttacggaacctaacgttacttacgtaccgtacctaaactactactaacgtacttactttactttccgttcgttacgggaccgggtaggaaccgttaaggacggatacgtacacgtacgtacgtggtacgtcncgaccacgtacttacgttccttacgtacttaccgtcccttacccgg

SEQ ID NO: 63120 - DNA, 622 bp, Homo sapiens
  misc_feature: GYAE6OF02G00QI.35.64.F09.1.454.CMB.1.raw
  modified_base (134)..(134): a, c, t, g, unknown or other
  misc_feature (134)..(134): n is a, c, g, or t
  modified_base (192)..(192): a, c, t, g, unknown or other
  misc_feature (192)..(192): n is a, c, g, or t
tcagtacagatcgtcacgaccggtgctcgatttagcgcgtatacaaggggggagtcagacccagtcaggacacagcatggacatgagggtccccgctcagctcctggggctcctgctgctctggctcccaggtnccaaatgtgacatccagatgacccagtcctccctccaccctgtctgcatctgtagganacagagtcactattactggtcggccagtgagagtataagtagttggttggccgtggtatcagacaagaaaccgaggggaaacgccccgtagacctctagattagtaagtacgggtcgttcgttcgttactaactaaacggtcggggtacccaaccgtaaggttcaggtacggacaggtacggtatacggtagggacaagtatcgactctcacatacgagtacgcctgacacgctagtatcgtactttcgactaactacttactagacctaactacttaacacgtactaactttactttccttcgtttacggggtaccggtaacgggtacctaagggtcgtaacgtagtacgaacgtacggtaacgttggtacggctacggccctaaccgtacgttacgtccgtttacttctaccgttcccttaacccccg

SEQ ID NO: 63121 - DNA, 605 bp, Homo sapiens
  misc_feature: GYAE6OF02JYGYL.35.64.F09.1.454.CMB.1.raw
  modified_base (408)..(408): a, c, t, g, unknown or other
  misc_feature (408)..(408): n is a, c, g, or t
  modified_base (455)..(455): a, c, t, g, unknown or other
  misc_feature (455)..(455): n is a, c, g, or t
tcagtacagatcgtcacgaccggtgctcgatttagcgcgtatacaagggggagtcagacccagtcaggacacagcatggacatgagggtccccgctcagctcctggggctcctgctgctctcggctcccaggtgccaaatgtgacatccagatgacccagtcctccctccaccctgtcctgcactctgtacggagacaggacgtcactattactcgcgggtccagtgagagtataggtagttggtggcctggtatcagcagaaaccgaggaacgcccctagacctcgtgactgtagtaggtctcgtgttcctaacgtaaaggtcggggtacccaccgtaaggttacgaggcggactaggtggacgtcgtagggaccagtaattcgactctacacatacgagtacgccngcacgcgtagatcgtacttgaactactatactcgaccatacttacanccttaatttctttccgttgttaccgggacggttaacggaccgttaaacgggtgtaaccgtagtaccgaacgtacggtaacgtcgggtacgtcgtaccggtaccgacctaacggttccgtacggttccttaccgtaccttcccgttacccg

SEQ ID NO: 63122 - DNA, 886 bp, Homo sapiens
  misc_feature: GYAE6OF02IZYR4.35.64.F09.1.454.CMB.1.raw
  modified_base (193)..(193): a, c, t, g, unknown or other
  misc_feature (193)..(193): n is a, c, g, or t
tcagtacagatcgtcacgaccggtgctcgatttagcgcgtatacaagggggagtcagacccagtcaggacacagcatggacatgagggtccccgctcagctcctggggctcctgctgctctggctcccaggtgaccaaatgtgacatcccagatcgaccagtcctccctccaccctgtctgcatcgtgtaganacagagtcactattcgtcgtcgggcagtgagagtataagtaggttggtgtccgtagtatcgagacagaaaccgaggaaccgacccctaaactccgtagacgttaccgttaagggaccttacgttaacgtttaaggacgtacgggttacgggtacccctagtaacgttaaggggttaccgaacggtcggtaaccgaaggggttaggtaccgttacgggtaaggggtaacccaacggttaccgtttaccacgtccccgtacaaacccgtcttaaccccgacgtttaccgccgttacggaccgtaaccgtaccgttacgggtaacgtttacggtttacgtttaccggtaaacccgtttaaaacctttacgtttaaaccgttaacccgggtaacccttaaaaccggttaacgggtttaaccggttaacggggttaaaccttttccccgggttttacccggttaacccggttttaaccccggtttaaccccgggtttaacccggggaaacccggtttaaaacccggggtaaagtttcccgggttaaactaaaccggtttaaacccgaaaacggttaccgtttacgggttaaacggtcccggttaacggttacccgtaaaacccgtttcggttaaccgttttaccgttacctttacccgtttaaaccgtaccccgtttcccggtaaccctttaacccgg

SEQ ID NO: 63123 - DNA, 1037 bp, Homo sapiens
  misc_feature: GYAE6OF02HBN4N.35.64.F09.1.454.CMB.1.raw
  modified_base (939)..(939): a, c, t, g, unknown or other
  misc_feature (939)..(939): n is a, c, g, or t
tcagtacagatcgtcacgaccggtgctcgatttagcgcgtatacaagggggagtcagacccagtcaggacacagcatggacatgagggtccccgctcagcctcctggggctcctgctgcctctcggcctcccgaggtcgacctaaagtcgtgaacctatcccaagtactcggaacccctagtccctcccctacccgtacccctggttacctcgcctacttcggtaggtaacggacgaaccgtaggaacgttcccaattttactttaccgtttcgggaccgggcctagggtacgtaagggtaagttaataagggttttagggtttaccgggttacggtccgttacggttaacttacggaaccgaaccgtaacgggaaaacccggaacggggtaaacccctccccggtaaaaccgccgttaccgtaacggtacgttacgggttaagggtaccggtcctttaccgttaaccggtttaaccgtaaaacggtaaccggtttaccccggggaaccctaaccgggttacggttaccgacggggacccggtaaggttaccgggggtaacgtaaccggttcgggtaaacgggggtaacctaacgggttaaccttaccccgtaaccgtttaccacctaaaccccgttaggtaccgtaaccgtttaccgcgttcggacccgttaccgtacgtcggtttaaccttacgttaacggtttaccgtaaccgtttaccctaacggtttacctaacgtaaacccgttaaccgttaaccgtttaaccgaaccgttttaccttttaaacccgttttacggtttaacccgttttacccgggtacccgggggttaaaaccgtaaccggggttaaccggtttaaaaccggggtacctaacccggttaacgtaaacccggtaacggtttacccgggtaaacggtttaccccgggggtttaancccggggtttaacccgaacccgtttaccggtttaacccggtagttttttccccccggttaaactccggtttttaccccccggtacccgttaacccccg

SEQ ID NO: 63124 - DNA, 876 bp, Homo sapiens
  misc_feature: GYAE6OF02JK7OM.35.64.F09.1.454.CMB.1.raw
tcagtacagatcgtcacgaccggtgctcgatttagcgcgtatacaagggggagtcgagacccagtcaggacacagcagtggacatgacgggtccccgctcagcctcctggggcctcctgctgcctcgtcgcctcccaggtcgaccaaagtgtagactagtaccagtactacgaccctacgtccctacccctaccccgtaccccttgttccctgacctacttacgagggttaacggaacggaaccgtaacggtacgttacctaaccgtttaacgtttaaccggttcgggttaacccgggaccttaaggggtacgtaaggtaagtttaaacggttaacgggtttagggttcgggtttaccggtaccgttagggttaacctacgaacggaaccgaaaacggaaaacccggtaaacggggaaccctaccccggttaacgtaaccgttcctaaggtacgtaagggttacggtacggtacctttccgttacgttaacctaaacggaaaccggtttaccggggtaacccctaaacggtaaccggttacaacggggtcgacgtaggtacggtacgtaccgtaacggggtaaataccggtaaacttaccgtactaccgtactaaccgactaacgtacgtaaccgtcgtcgtacactcggtagtacgtcgtacgtttactaaccgttaacctacgttaactccgtaacctaacttactaaccgtataccgtttactttacgttacgttccggttaagggtaccgggtaaccgggtaacgttaacgggtcgaaccgtacctacggacgtaactacggttcggacggtacgtaaccgtcgaacccgttgttaccggtccttaactacgtttaccttacccggttaccg

SEQ ID NO: 63125 - DNA, 623 bp, Homo sapiens
  misc_feature: GYAE6OF02GRO1G.35.64.F09.1.454.CMB.1.raw
  modified_base (197)..(197): a, c, t, g, unknown or other
  misc_feature (197)..(197): n is a, c, g, or t
tcagtacagatcgtcacgaccggtgctcgatttagcgcgtatacaagggggagtcagacccagtcaggacacagcatggacatgagggtccccgctcagctcctggggctcctgctgctctggctcccaggtgccaaatgtgacatccagatgacccagtcctccctccaccctgtctgcatctgtaggagacagancactattacttgtcggccagtgagagtatagtagttggttgctgtatcagacaagaaccgaaggaacgaccccgtagacctcctagatagtagtaggtcgtcgtgttactaactaaacgtacgggtacccaccgtaacggttacgacgcggcaggtggactcgtaggacacggtaacttcgactcgtacacatacacgtacgcctgactcggacctagacttagtacttagacctaccgtattaccgtcaaccctaataccgttacacgttaccttactttacgtttaccttacggtaccgggccggtaacggtaacccggtaagggtacgactacgtacgtacggacgtaaccgtgggtaccgtaccgtcgtacctacgtactttccgttacgttacccttacgttcccttacccgttacccccg

SEQ ID NO: 63126 - DNA, 679 bp, Homo sapiens
  misc_feature: GYAE6OF02I7MRD.35.64.F09.1.454.CMB.1.raw
  modified_base (394)..(394): a, c, t, g, unknown or other
  misc_feature (394)..(394): n is a, c, g, or t
tcagtacagatcgtcacgaccggtgctcgatttagcgcgtatacaagggggagtcagacccagtcaggacacagcatggacatgagggtccccgctcagctcctggggctcctgctgctctggctcccaggtgccaaatgtgacatccagatcgacccagtcctccctccaccctgtctgcatctgtacggagacagagtcatattacttgtccggcagtgagagtatagtagttggtgctgtatcgagcaagaaccgagggaacgccctagctctgatgtagtaggcttctgttactaacgaaacgtcgggtacccaaccgtaaggttcacggacggcgtaggtggtacgtcggtagggaactaacggtacttcgtaaccttcacctaacccntacgaacggtcgccgtggtaccgacgtccgtaggtacgttagttaaccgtttcgaccttaaaccctttacttaaccgttccgaaaccctaaagttaacgtttaaacttaaacgtttaccgtttaaacccgttaaccgtttaccggtttaccggggaacggggtaccggtaaaccgtaaggggtaaacaaccgtaaaccgaaacggttacgtgggtccggtactacggacctacttagttccgttcggttacttccgactttccccggttaccgacttagtacccg

SEQ ID NO: 63127 - DNA, 765 bp, Homo sapiens
  misc_feature: GYAE6OF02HE05Q.35.64.F09.1.454.CMB.1.raw
  modified_base (468)..(468): a, c, t, g, unknown or other
  misc_feature (468)..(468): n is a, c, g, or t
tcagtacagatcgtcacgaccggtgctcgatttagcgcgtatacaagggggagtcagacccagtcaggacacagcatggacgatgagggtccccgctcagctcctggggctccgtgcctgctctggctcccgaggtgaccaaagtgtgacactccagatcgacccagtcctccctcccaccgtcgtactgacctacttcgtacggtaggacgacacgtacgtcctaacttatttacggtttcggtccgggacctaaggttcgagtaagttaataaggttaggttgggttcggtccgtggttactcgacggactaaacggaaaccggaaggaacctccccgtagtaccctccgtagtacgttgtaacggtcggtccgttcgttcgttaactaaacgtaacgggtcccgggtaacctaaccggttaacggttccgaaggtccggaccgtaggtagatcgggtacggtaanagtaaccttccgacttcctaccgaccctgtaacctacgtacgaccgtcgacccagtcgtagacgttagttaccttacggtactaaccgttacttccgtaactaacccgaattaccgttaacaccgttaccttaactttcctttaccgtttaccggtacggtacgggtaaccggtaacgtaggggacctacgaacgttaccgaggttaacgtaccggttcggtacccggtcgaaccgtacccgtacttaccgttggtttaccttacctaccccggtttaccttacccgttaccccccg

SEQ ID NO: 63128 - DNA, 510 bp, Homo sapiens
  misc_feature: GYAE6OF01ADN6S.31.78.H01.1.454.CMB.1.raw
  modified_base (508)..(508): a, c, t, g, unknown or other
  misc_feature (508)..(508): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgtttattggccccacaataacaactacttagcttggtaccagcagaaagtaggacagcctcctaaactcctgatttactgggcttctacccgggcatccggggttcctaaccgattcattggcagcgggtctgggaccgatttcactctcaccatcagcagcctgcaggctgaagatgtgctagtttatactgtcagcaacattatacttctttcgtctactttcggcggaggaccaaggtggagatacgaaacgatgtggctgcaccatctgtctnac

SEQ ID NO: 63129 - DNA, 907 bp, Homo sapiens
  misc_feature: GYAE6OF01EAZAW.31.78.H01.1.454.CMB.1.raw
  modified_base (510)..(510): a, c, t, g, unknown or other
  misc_feature (510)..(510): n is a, c, g, or t
tcagcagtagacgtcacgaccggtgctcgatttagtgtgagtagttggttggggtaggctacaacaggccaggcagggcagctaagatcggtgttgcagacccaggtcttcgatttctcctgttgcgtctggactcgtctggtacgtccgtacggggacagtcggtcgatgagccaagttccagactccctggacctgtgtcctcgtggacgcggtacggtccgaccgtaagttccgaaactcgacgtaacgttcccgaaggccgaaggtacgttggttttacgttcggaccccgtaaccgtaataaccgaaccccgttaggttaacggtcccgtttaggggtaacccgtagggtacccttaaggtaaaaccggttaccgggacctaaacggttcccgtttaaccggtaaaaacttcccggttaaggtaacgttttaaccggtacggggtacctttacccggtaacccggggtctaaacgtttcccggggtttaccctaaaaaccgggtntttcccgtaaacgtttccggacgttaaccggtacccgggttaacgttaccggggtaaccccgttaaactttaaccgaacgttcccgtaccgtaaacccgtaagtttaccgaacgtacccgtaaggtcccgttaggaccccgtaaggtccgtaaacgaacggtaaccgttcggtaacggtacctttaacggtttacgttaaccgacggttaccaaccggtactaaaccgttaacgttaacccgtaccttaccgttacggtaaccgtaaccgtttcggaaccgtacggtaccgtaaacgggtcgtaaaccgggacttaaccgggtaaaccgttcgtacggtacccgtcgttaccgaccgtaaccgtaccgttaccgtacggtaaccgttcccgtaacgg

SEQ ID NO: 63130 - DNA, 528 bp, Homo sapiens
  misc_feature: GYAE6OF01DRD4J.31.78.H01.1.454.CMB.1.raw
  modified_base (521)..(521): a, c, t, g, unknown or other
  misc_feature (521)..(521): n is a, c, g, or t
tcagcagtagacgtcacgaccggtgctcgatttagtgtgagtagtttgggtttggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgtttattggccccacaataacaactacttagcttggtaccagcaagaaagtaggacagcctacctaaactcctagtatttactgggcttccgacccgggcacgttcccggggttacctaaccgattcattggcagcgggtctgggacctatttcactctcacatcagcagcctgcaggctagaagatgtggctagtttattactgtcagacaactattatacttctttcgtctacgtttcggcggtagggaccaaggtggagatacgaaacgatggtgctgctaccatctntctctac

SEQ ID NO: 63131 - DNA, 584 bp, Homo sapiens
  misc_feature: GYAE6OF01DF5SV.31.78.H01.1.454.CMB.1.raw
  modified_base (317)..(317): a, c, t, g, unknown or other
  misc_feature (317)..(317): n is a, c, g, or t
tcagcagtagacgtcacgaccggtgctcgatttagtgtgagtagtttgggtttgggggaggctacaacaggcaggcaggggcagcaagatggtgttcgcagacccaggtcttcgatttctctgttgctctggatctctggtgcctacggggacatcgtgatgagccagtttccagactccctggctgtgtctcgtgggcgagagggccaccatcaactgcaagtccagccagagtgtttattcggccctaacaataacaactacttagcttggtaccagcagaaagtaggacagcctcctaaactcctgactttacngggtcttctaacccgggctactccggggttacctaaccggattcgagttcggcaggcgggtctggggaccgtatttcactctcacatcagcagcctgcaggctagaagtatgtggactagtttatactgtacagtcaactatttactaacttctttacgtactaccgtttgggacggtaagggacctaagggttggacgtactaccgtaaaacgtacttggtcggtcctacggacctaccgtaacttccgttgttccttcgtaaccg

SEQ ID NO: 63132 - DNA, 753 bp, Homo sapiens
  misc_feature: GYAE6OF01ELX0Q.31.78.H01.1.454.CMB.1.raw
tcagcagtagacgtcacgaccggtgctcgatttagtgtgagtagttgggtttggggaggctacaacaggcaggcaggggcagacaaggatggtgtgcagaccaggtcttcattctctgttgctctggatctctgtgcctacgggcatcgtgatgagcgtagtttccgacgactccctggctgtgtctctgggccgacgagggccaccatcggaacctggccaaagtccgagcccaagtacgtcgttttattcggaccccaccgaaataacaactacttacgacttggtaccgagactagaaagtaggacagcctcgtaaactctgactttactagggcttcgtacccgggcctacgttcccggggttcctaaccgtagttaccgaacttacggactacgggccgggttctacgggggtacccctaaggtttccaacgtttcctcctaaccgactttaccgaacggtccctaacggcccttacggaccgtaacggggtcccttacggaaacggtaacgttcggttacgggtaccgttaacgggttttaacctttaaccgtacggttaccctaagggtaaccgtaacgtaagtttaacgttaacctttaccgttttacggtttaccttaccgttttacgggaccgggtaacgggttaaccctaaaggggttcggaagtaacgttaccgaaaacggtaacgttggtacgtcgtacggtactaccgttaacgtccgttacggttcgtacgtaacccg

SEQ ID NO: 63133 - DNA, 512 bp, Homo sapiens
  misc_feature: GYAE6OF01B639H.31.78.H01.1.454.CMB.1.raw
tcagcagtagacgtcacgaccggtgctcgatttagtgtgagtagtttgggtttggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttactgggcttctacccgggcatccgggttctaaccgattcattggcagcgggtctgggaccatttcactctcaccatcagcagcctgcaggctgaagatgtggctagtttattactgtcagcaacattatacttcttcgtcactttcggcggaggaccaaggtggagtatacgaaacgtatgtggctgctaccatctgtcttctac

SEQ ID NO: 63134 - DNA, 509 bp, Homo sapiens
  misc_feature: GYAE6OF01BXXC5.31.78.H01.1.454.CMB.1.raw
  modified_base (326)..(326): a, c, t, g, unknown or other
  misc_feature (326)..(326): n is a, c, g, or t
  modified_base (344)..(344): a, c, t, g, unknown or other
  misc_feature (344)..(344): n is a, c, g, or t
tcagcagtagacgtcacgaccggtgctcgatttagtgtgagtagtttgggtttggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgtttattggccccacaataacaactacttagcttggtaccagcagaaagtaggacagcctacctaaactcctgatttactgggcttctacccgggnatccgggttcctaaccgnttcattggcagcgggtctgggaccgatttcactctcacatcagcagcctgcaggctgaagatgtggctagtttattactgtcagcaacattatacttctttcgtctactttcggcggtaggaccaaggtgagatacgaaacgatgtgctgcacatctgtctctac

SEQ ID NO: 63135 - DNA, 510 bp, Homo sapiens
  misc_feature: GYAE6OF01EGI43.31.78.H01.1.454.CMB.1.raw
  modified_base (508)..(508): a, c, t, g, unknown or other
  misc_feature (508)..(508): n is a, c, g, or t
tcagcagtagacgtcacgaccggtgctcgatttagtgtgagtagtttgggtttggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgtttattggccccacaataacaactacttagcttggtaccagcagaaagtaggacagcctcctaaactcctgatttactgggcttctacccgggcatccggggttcctaaccgattcattggcagcgggtctgggaccatttcactctcaccatcagcagcctgcaggctgaagatgtgctagtttattactgtcagcaacattatacttctttcgttcactttcggcggaggaccaagggtgagatacgaaacgatggtggctgcacatctgtcttnac

SEQ ID NO: 63136 - DNA, 518 bp, Homo sapiens
  misc_feature: GYAE6OF01ASNS7.31.78.H01.1.454.CMB.1.raw
  modified_base (406)..(406): a, c, t, g, unknown or other
  misc_feature (406)..(406): n is a, c, g, or t
  modified_base (515)..(515): a, c, t, g, unknown or other
  misc_feature (515)..(515): n is a, c, g, or t
tcagcagtagacgtcacgaccggtgctcgatttagtgtgagtagtttgggtttggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgtttattggccccacaataacaactacttagcttggtaccagcagaaagtaggacagcctcctaaactcctgatttactgggcttctacccgggcagtccgggttcctaaccgattcattggcagcgggtctgggaccgatttcactctcaccatcagcagcctgcaggctgaagntgtggctagtttatactgtcagcaactattatacttcttcgtctacgtttcggcggtaggaccaaggtcggagatacgaaacgactggtggctgctaccatctgtcttntac

SEQ ID NO: 63137 - DNA, 512 bp, Homo sapiens
  misc_feature: GYAE6OF01C58QX.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccaccaataacaactacttagcttggtaccagcagaaagtaggacagcctcctaaactcctgatttactgggcttctacccgggcatccggggttcctaaccgattcattggcagcgggtctgggaccatttcactctcaccatcagcagcctgcaggctgaagatgtggcagtttatactgtcagcaacattatactttcttcgtctactttcggcggaggaccaaggtggagatcaaacgactggtggctgcaccatctgtctctac

SEQ ID NO: 63138 - DNA, 521 bp, Homo sapiens
  misc_feature: GYAE6OF01CBSWH.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttactgggcttctacccgggcagtccgggttcctaaccgattcattggcagcgggtctgggaccgtatttcactctcaccatcagcagcctgcaggctgaagatgtggcagtttatactgtcagcaacattatacttctttcgtctacttttcggcggaggaccaagggtggagatacgaaacgaactggtcggctgcaccatctagtcttctac

SEQ ID NO: 63139 - DNA, 527 bp, Homo sapiens
  misc_feature: GYAE6OF01DLYZ2.31.78.H01.1.454.CMB.1.raw
  modified_base (406)..(406): a, c, t, g, unknown or other
  misc_feature (406)..(406): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttactgggcttctaccgggcagtccgggttcctaaccgattcattggcagcgggtctgggaccatttcactctcaccatcagcagcctgcaggctgaagntgtggctagttttatactgtcagcaactattatacttctttcgtctacgtttcggcggtagggaccaagggtcggagattacgaaacgtacgtggtggcctagcaaccatctgtcttctac

SEQ ID NO: 63140 - DNA, 509 bp, Homo sapiens
  misc_feature: GYAE6OF01A0I4X.31.78.H01.1.454.CMB.1.raw
  modified_base (409)..(409): a, c, t, g, unknown or other
  misc_feature (409)..(409): n is a, c, g, or t
  modified_base (501)..(501): a, c, t, g, unknown or other
  misc_feature (501)..(501): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgtttattggccccacaataacaactacttagcttggtaccagcagaaagtaggacagcctcctaaactcctgatttactgggcttctacccgggcacgtccggggttcctaaccgattcattggcagcgggtctgggaccgatttcactctcaccatcagcagcctgcaggctgaagntgtggctagtttatactgtcagcaactattatacttcttcgtctactttcggcggagggaccaggtgagatacaaacgatgtgctgcacatntgtctcac

SEQ ID NO: 63141 - DNA, 535 bp, Homo sapiens
  misc_feature: GYAE6OF01CTONZ.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgtttattggccccacaataacaactacttagcttggaccagcaagaaagtaggacagcctacctaaactcctagatttactgggtcttcgtacccgggcaacgttcccggggttacctaaccggattcattcggcaggcggggtctcggggaccgtagtttcacttctcaccatcagcacgcctgcaggctagaagatgtgctagtttatactgtacagcaactattatacttcttacgtctacgtttcggacggaggaccaaggtggagtatacaaacgatgtgctgacacatctgtctctac

SEQ ID NO: 63142 - DNA, 519 bp, Homo sapiens
  misc_feature: GYAE6OF01BMWFI.31.78.H01.1.454.CMB.1.raw
  modified_base (346)..(346): a, c, t, g, unknown or other
  misc_feature (346)..(346): n is a, c, g, or t
tcagcagtagacgtcacgaccggtgctcgatttagtgtgagtagtttgggtttggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgtttattggccccacaataacaactacttagcttggtaccagcagaaagtaggacagcctcctaaactcctgatttactgggcttctacccgggcagtcccggggttcctaaccgnttcattggcagcgggtctgggaccgtatttcactctcaccatcagcagcctgcaggctgaagatgtggctagtttatactgtcagcaactattatacttctttcgtctactttcggcggagggaccaggtggagatacgaaacgtatggtggctgcaccatctgttcttctac

SEQ ID NO: 63143 - DNA, 542 bp, Homo sapiens
  misc_feature: GYAE6OF01C1EI7.31.78.H01.1.454.CMB.1.raw
  modified_base (362)..(362): a, c, t, g, unknown or other
  misc_feature (362)..(362): n is a, c, g, or t
  modified_base (537)..(537): a, c, t, g, unknown or other
  misc_feature (537)..(537): n is a, c, g, or t
tcagcagtagacgtcacgaccggtgctcgatttagtgtgagtagtttgggtttggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttactgggcttctacccgggcatccgggttcctaaccgattcattggcagcgggtcngggaccgtattcactctcaccatcagcacgcctgcaggctagaagatgtggctaagtttatactgtacagacaactattaatactttctttcgtacttacgtttcggacggaggaaccaaggtggaagaatacgaaaacgtactggtacggcgtgacctaaccatcctgttcctntaccg

SEQ ID NO: 63144 - DNA, 561 bp, Homo sapiens
  misc_feature: GYAE6OF01BJLEX.31.78.H01.1.454.CMB.1.raw
  modified_base (435)..(435): a, c, t, g, unknown or other
  misc_feature (435)..(435): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccacatcaactgcaagtccagccagagtgtttattggccccacaataacaactacttagcttgtaccagcagaaagtaggacagccctacctaaactcctagactttacgtgggtccttccgtaacccgggctaacgttcccggggttacctaaaccggtattcacgttggactaggcggggtctgggaccgtatttcgacttctcaccatcagcagcctgcaggctagaagngtgtggactagtttatactgtcagactaactattactacttcttcgtactacgttcggacggacggaccgtaggtacgagtactacgaaacgtactggtcgctgactacattacctgttctcgtac

SEQ ID NO: 63145 - DNA, 529 bp, Homo sapiens
  misc_feature: GYAE6OF01DDY4H.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccaccaataacaactacttagcttggtaccagcagaaagtaggacagcctcctaaactcctgatttactgggcttctacccgggcacgtccgggttacctaacgattcattggcagcgggtctgggaccgtattcactctcaccatcagcacgcctgcaggctagaagagtgtggctagtttatactgtcagacaactattactacttctttcgtctacgtttcggcggtaggacctaggtgagatacgaaacgtagtgtgacgtgacctacatctcgtctctac

SEQ ID NO: 63146 - DNA, 522 bp, Homo sapiens
  misc_feature: GYAE6OF01A38RR.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttactgggcttcgtacccgggcagtcccggggttcctaaccgattcattggcagcgggtctgggaccgatttcactctcaccatcagcagcctgcaggctgaagatgtggctagtttattactgtcagcaactattatacttctttcgtctactttcggcggtagggaccaaggtggagatacgaaacgatggtggctgcaccatctgtcttctac

SEQ ID NO: 63147 - DNA, 531 bp, Homo sapiens
  misc_feature: GYAE6OF01EUUIR.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccacatcaactgcaagtccagccagagtgttttattcggccccacaataacaactacttagcttggtaccagcaagaaagtaggacagcctcctaaactcctagactttactgggccttcgtacccgggcacgtcccggggttcctaaccgattcattggcagcgggtctgggacctatttcactctcaccatcagcagcctgcaggctagaagatgtgctagtttatactgtcagacaactattatacttctttcgtactacgtttcggacggtacggaccaaggtgagatacgaaacgtactggtcgctgacacatctgtctcgtac

SEQ ID NO: 63148 - DNA, 515 bp, Homo sapiens
  misc_feature: GYAE6OF01C08CN.31.78.H01.1.454.CMB.1.raw
  modified_base (414)..(414): a, c, t, g, unknown or other
  misc_feature (414)..(414): n is a, c, g, or t
  modified_base (493)..(493): a, c, t, g, unknown or other
  misc_feature (493)..(493): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgtttattcggcccacaataacaactacttagcttggtaccagcagaaagtaggacagcctacctaaactcctgatttactgggcttcgtacccgggcacgtccggggttcctaaccgattcattggctagcgggtctgggaccatttcactctcaccatcagcagcctgcaggctgaagatgnggctagtttatactgtcagcaacattatacttcttcgtcactttcggcgtaggaccaaggtgagatacgaaacgactgngctgccacatctgtcttcgtac

SEQ ID NO: 63149 - DNA, 660 bp, Homo sapiens
  misc_feature: GYAE6OF01D0QM0.31.78.H01.1.454.CMB.1.raw
  modified_base (361)..(361): a, c, t, g, unknown or other
  misc_feature (361)..(361): n is a, c, g, or t
  modified_base (472)..(472): a, c, t, g, unknown or other
  misc_feature (472)..(472): n is a, c, g, or t
tcagcagtagacgtcacgaccggtgctcgatttagtgtgagtagtttgggtttggggagctacaacaggcaggcaggggcagcaagatggtgttgcagacccaggtcttcatttctctgttgctctggatctctggtgcctacggggacatcgtgatgacgcctagttccagacctcccgtggctgtgtctcgtgggcgaggacggcccaaccataccaactgacaacgtccacgccaagtagttgttttagttccggccccaacaaataaccaacttacttagtcttacggtaaccagacaagaaagtaggacacgccctacctaaactcctagtatttacgtggtcttccgtacccggntacggttcccgggttacctaaccgtattctagttcggacacgggtcggtcgtacgggaaccgttatttccactctaccaacctatcagcacgtcctgcgaggctagaagtntggtcggcttaagttttactacgtgtacgagacctaaactatttaacttaccttttccgtttacgttaccttaccgtttccggggacgggtacggggtaaccctaaggggtggaaacgtaacttaaccggaaaacgtacgttgggtcggctacgaccctaaccgtattccgttacgttccttctaccg

SEQ ID NO: 63150 - DNA, 548 bp, Homo sapiens
  misc_feature: GYAE6OF01EI5YW.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactcctggctgtgtctcgtgggcgagagggccaccatcaactgcaagtccagccagagtgtttattcggccccacaataacaactacttagcttggtaccagcaagaaagtaggacagcctacctaaactcctgtactttactgggcttccgtacccgggctaacgttcccggggttcctaaaccggtattccagttcggcacggcgggtctcggggacctatttcacttctcaccatcagcagcctgcagctagaagatgtaggctagtttatacgtgtcagcaactattatacttcttcgtctacgtttcggacggtacggaccgaaggtcggagactacgaaacgtatggtgctagcctacatctgtctctac

SEQ ID NO: 63151 - DNA, 595 bp, Homo sapiens
  misc_feature: GYAE6OF01DIZC7.31.78.H01.1.454.CMB.1.raw
  modified_base (318)..(318): a, c, t, g, unknown or other
  misc_feature (318)..(318): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagttgttttattcggccccacaataacaactacttagcttggtaccagcaagaaagtaggacagccctacctaaactcctgatttacgngggcctttccgtacccgggctaacgttcccggggttaccctaaaccggtattccagttcggcaggtccggggtctcggggaacccgtatttccactcctcaccatcagcacgcctgcaggctagaagatggtggctagtttactactgtacagacaactatttactactttctttcgtactacgtttcgggacggtacgggtaaccaagggtggagtaacgtacgaaaacggtacgtaggtcggctagacctaacctattcctcgttccttcgtacc

SEQ ID NO: 63152 - DNA, 531 bp, Homo sapiens
  misc_feature: GYAE6OF01D4L9G.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctacctaaactcctgtatttacgtgggcttcgtacccgggcacgttcccggggttcctaaccgtattcattggcagcgggtctgggacctatttcactctcacatcagcagcctgcaggctagaagatgtggctagtttatacgtgtcagacaactattatacttctttcgtctacgtttcggcggtaggacgtaggtgagatacgaaacgtatggtcgctgaccactatcttgtctctac

SEQ ID NO: 63153 - DNA, 523 bp, Homo sapiens
  misc_feature: GYAE6OF01ADBUK.31.78.H01.1.454.CMB.1.raw
  modified_base (412)..(412): a, c, t, g, unknown or other
  misc_feature (412)..(412): n is a, c, g, or t
  modified_base (502)..(502): a, c, t, g, unknown or other
  misc_feature (502)..(502): n is a, c, g, or t
  modified_base (516)..(516): a, c, t, g, unknown or other
  misc_feature (516)..(516): n is a, c, g, or t
  modified_base (520)..(520): a, c, t, g, unknown or other
  misc_feature (520)..(520): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagccctcctaaactcctgatttactgggcttcgtacccgggcagtcccggggttacctaaccgattcattggcagcgggtctgggaccatttcactctcacatcagcagcctgcaggctagaagntgtggctagtttattacgtgtcagactaactattatacttctttcgtctactttcggcggtaggaccaaggtgagatacgaaacgatggngctgctaccatctntctntac

SEQ ID NO: 63154 - DNA, 509 bp, Homo sapiens
  misc_feature: GYAE6OF01BB6TI.31.78.H01.1.454.CMB.1.raw
  modified_base (507)..(507): a, c, t, g, unknown or other
  misc_feature (507)..(507): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttactgggcttctacccgggcatccggggttcctaaccgattcattggcagcgggtctgggaccgatttcactctcaccatcagcagcctgcaggctgaagatgtggctagtttatactgtcagcaactattatacttcttcgtctactttcggcggaggaccaggtgagatacgaaacgatggtgctgcacatctgtctnac

SEQ ID NO: 63155 - DNA, 568 bp, Homo sapiens
  misc_feature: GYAE6OF01CTFA8.31.78.H01.1.454.CMB.1.raw
  modified_base (315)..(315): a, c, t, g, unknown or other
  misc_feature (315)..(315): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagactccctggctgtgtctcgtgggcgagagggccaccatcaactgcaagtccagccagagtgtttattcggcccaacaataacaactacttagcttaggtaccagcaagaaagtaggacagcctactaaactcctgatttacngggtcttctacccgggctacgtcccggggttacctaaccggtattcgattggacaggtccggggtctcggggaccgtatttccacttctccacatcagcagcctgcaggctagaagatgtgctagtttatacgtgtcagcaactattaactactttctttcgtactacgtttcggacggacgggaaccgtaagggtggagtactacgaaaacgtagtggtacggctcgactacctatactcgttcgtctaccg

SEQ ID NO: 63156 - DNA, 647 bp, Homo sapiens
  misc_feature: GYAE6OF01B1OFQ.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttatcggccccacaataacaactactagcttggtaccagcagaaagtaggacagcctacctaaactcctgactttactgggcttcgacccgggctacgtcccgggtacgtaaccgtactctactaggtcgacgtcgggtcgtggaccggtacttactactcctcacctactactacgcacgacctgtcgaggcgtacgtaaggaagtaggtggtacgtaagttttaagttaacttgtacgtagaacgtaactaatttaacttaacgttttccgtttacgtttaccgtaacgttttccggggttaccgggacgggtaacccgtaagggtacggtacggaaacgtaacgtaaaccggtaacgtacggttgggaccgtacggacctaccgaacttacgttcttccgttctacccg

SEQ ID NO: 63157 - DNA, 537 bp, Homo sapiens
  misc_feature: GYAE6OF01ELP2C.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgaggagggccaccatcaactgcaagtccagccagagtgttttattggccccacaataacaactacttagcttggtaccagcaagaaagtaggacagcctcctaaactcctgatttactgggcttccgtacccgggcacgttccggggttacctaaccgattcattggcagcgggtctgggaccgtatttcactctcaccatcagcagcctgcaggctagaagatggtggctagtttattacgtgtcagtcaatattactacttctttcgtctacgtttcggcggtacggaccgtaaggtgagatacgaaacgtagtggtggctgactaccatctgtctctac

SEQ ID NO: 63158 - DNA, 517 bp, Homo sapiens
  misc_feature: GYAE6OF01BT33N.31.78.H01.1.454.CMB.1.raw
tcagcagtagacgtcacgaccggtgctcgatttagtgtgagtagtttgggtttggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttactgggcttctacccgggcagtccggggttcctaaccgattcattggcagcgggtctgggacctatttcactctcaccatcagcagcctgcaggctgaagatgtggctagtttattactgtcagcaactattatacttctttcgtctactttcggcggtagggaccaaggtgagatacgaaacgactgtggctgcacatctgtcttctac

SEQ ID NO: 63159 - DNA, 514 bp, Homo sapiens
  misc_feature: GYAE6OF01ACMGY.31.78.H01.1.454.CMB.1.raw
  modified_base (511)..(511): a, c, t, g, unknown or other
  misc_feature (511)..(511): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaaactcctgatttactgggcttctacccgggcatccggggttcctaaccgattcattggcagcgggtctgggaccgatttcactctcaccatcagcagcctgcaggctgaagatgtgctagtttatactgtcagcaacattatacttctttcgtctactttcggcggtaggaccaaggtgagatcgaaacgaatgtggctgcaccatctgtcttntac

SEQ ID NO: 63160 - DNA, 518 bp, Homo sapiens
  misc_feature: GYAE6OF01E2OME.31.78.H01.1.454.CMB.1.raw
  modified_base (409)..(409): a, c, t, g, unknown or other
  misc_feature (409)..(409): n is a, c, g, or t
  modified_base (516)..(516): a, c, t, g, unknown or other
  misc_feature (516)..(516): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcccagtttccagactccctggctgtgtctctgggcgagagggccaccatcaactgcaagtccagccagagtgtttattggccccacaataacaactacttagcttggtaccagcagaaagtggacagcctcctaaactcctgatttactgggcttctaacccgggcatccggggttcctaaccgattcattggcagcgggtctggggaccatttcactctcaccatcagcagcctgcaggctgaagtntgtggctagtttatactgtcaagcaacatttatacttctttcgctactttacggcgagggaccaagggtgagatcgaaacgtatgtggctgaccacctatctgtctnac

SEQ ID NO: 63161 - DNA, 528 bp, Homo sapiens
  misc_feature: GYAE6OF01CHU4Z.31.78.H01.1.454.CMB.1.raw
  modified_base (525)..(525): a, c, t, g, unknown or other
  misc_feature (525)..(525): n is a, c, g, or t
tcagcagtagacgtcacgaccggtgctcgatttagtgtgagtagtttgggtttggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacaactacttagcttggtaccagcagaaagtaggacagcctacctaaactcctgatttactgggtcttcgtacccgggcacgtccggggttacctaaccgattcattcggcagcgggtctgggacgattcactctcaccatcagcagcctgcaggctgaagatgtggctagtttattactgtcagacaactattataacttctttcgtctacgtttcggacggtaggacctaagggtgagatacgaaacgactggtgactgcacatctgtcttntac

SEQ ID NO: 63162 - DNA, 514 bp, Homo sapiens
  misc_feature: GYAE6OF01A8K73.31.78.H01.1.454.CMB.1.raw
  modified_base (347)..(347): a, c, t, g, unknown or other
  misc_feature (347)..(347): n is a, c, g, or t
  modified_base (409)..(409): a, c, t, g, unknown or other
  misc_feature (409)..(409): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttactgggcttctacccgggcatcccggggttcctaaccgnttcattggcagcgggtctgggaccgatttcactctcaccatcagcagcctgcaggctgaagntgtggctagtttatactgtcagcaactattatactttctttcgtctactttcggacggtaggaccaggtgagatacgaacgatgtggctgcacatctgtctctac

SEQ ID NO: 63163 - DNA, 513 bp, Homo sapiens
  misc_feature: GYAE6OF01AY3OR.31.78.H01.1.454.CMB.1.raw
  modified_base (327)..(327): a, c, t, g, unknown or other
  misc_feature (327)..(327): n is a, c, g, or t
  modified_base (511)..(511): a, c, t, g, unknown or other
  misc_feature (511)..(511): n is a, c, g, or t
tcagcagtagacgtcacgaccggtgctcgatttagtgtgagtagtttgggtttggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaaactcctgatttactgggcttctacccgggnatccggggttcctaaccgattcattggcagcgggtctgggaccgatttcactctcaccatcagcagcctgcaggctgaagatgtggctagtttatactgtcagcaactattactacttctttcgtctacgtttcggcggtaggaccaaggtgagatacgaaacgatgtgctgcacatctgtctnac

SEQ ID NO: 63164 - DNA, 513 bp, Homo sapiens
  misc_feature: GYAE6OF01CN3VU.31.78.H01.1.454.CMB.1.raw
  modified_base (311)..(311): a, c, t, g, unknown or other
  misc_feature (311)..(311): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttacngggcttctacccgggcatccgggttcctaaccgattcattggcagcgggtctgggactattcactctcaccatcagcagcctgcaggctgaagatgtgcagtttatactgtcagcaacatttactacttctttcgtctactttcggcggtaggaccaagggtgagatcgaaaacgatgtggctgactacatctgtcttctac

SEQ ID NO: 63165 - DNA, 569 bp, Homo sapiens
  misc_feature: GYAE6OF01EU4DT.31.78.H01.1.454.CMB.1.raw
  modified_base (415)..(415): a, c, t, g, unknown or other
  misc_feature (415)..(415): n is a, c, g, or t
tcagcagtagacgtcacgaccggtgctcgatttagtgtgagtagtttgggtttgggggagctacgaacaggcaggcagggctagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccaccaataacaactacttagcttggtaccagcagaaagtaggacagcctcctaaactcctgatttactgggcttctacccgggcacgtccggggttcctaaccgattcattggcagcgggtctgggaccgatttcactctcaccatcagcagcctgcaggctgaagatgnggcagttttatacttgcagcaactattacgttaactttcctttcgtcttaccgttttcgggcgggtaggacccgaagggtggtaagataacgaaaacgtaaacgttggtcgggccttaggaccctaccgtaattccttaggttccttcgtaacc

SEQ ID NO: 63166 - DNA, 566 bp, Homo sapiens
  misc_feature: GYAE6OF01DBCAB.31.78.H01.1.454.CMB.1.raw
  modified_base (441)..(441): a, c, t, g, unknown or other
  misc_feature (441)..(441): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagttgtttattcggcccacaataacaactactagcttggtaccagcaagaaagtaggacagcctacctaaactcctagtatttacgtgggtcctttccgtaccccgggctacgttcccggggttaccctaaccggtacttcagtttcggcagggtccgggtcgtcggggaccgtatttcactctcaccatcagcagcctgcaggctagaagntgtggctagtttatacgtgtacagcaactattacttactttctttcgtactacgtttcggacggtacggaccgtaaggtgagatacgaaacgtagtggtcggactgacctactatctctctctcc

SEQ ID NO: 63167 - DNA, 530 bp, Homo sapiens
  misc_feature: GYAE6OF01B0WA3.31.78.H01.1.454.CMB.1.raw
  modified_base (345)..(345): a, c, t, g, unknown or other
  misc_feature (345)..(345): n is a, c, g, or t
  modified_base (380)..(380): a, c, t, g, unknown or other
  misc_feature (380)..(380): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgtttattggccccacaataacaactacttagcttggtaccagcagaaagtaggacagcctacctaaactcctgatttactgggcttctacccgggcatccggggttctaaccgnttcattggcagcgggtctgggaccgatttcactcncaccatcagcagcctgctagctagaagatgtggctagtttattactgtcagcaactattattacttctttcgtctacgtttcggcggtacggaccgtaaggtggagagtacgaaacgtacgtgtggactagccactatctcgtcttctac

SEQ ID NO: 63168 - DNA, 579 bp, Homo sapiens
  misc_feature: GYAE6OF01EJ39O.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacaactacttagcttggtaccagcaagaaagtaggacagcctacctaaactcctgatttacgtgggtcttccgtacccgggcacgtccggggttacctaaccgattccattcggctaggcgggtcgtgggaccgtatttcactctcaccatcagcacgcctgcaggctagaagatgtggctagtttatacgtgtcagacaactattatactttcttcgttactacgtttcggacggtacgggaccgtaagggtcggtaagaacgtacgaaaacgtaacgttggtacggtcctcgacctacctagttaccttcggttccttcgtaccg

SEQ ID NO: 63169 - DNA, 518 bp, Homo sapiens
  misc_feature: GYAE6OF01CTVIS.31.78.H01.1.454.CMB.1.raw
  modified_base (232)..(232): a, c, t, g, unknown or other
  misc_feature (232)..(232): n is a, c, g, or t
  modified_base (311)..(311): a, c, t, g, unknown or other
  misc_feature (311)..(311): n is a, c, g, or t
  modified_base (509)..(509): a, c, t, g, unknown or other
  misc_feature (509)..(509): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtnttttattggcccacaataacaactacttagcttggtaccagcagaaagtaggacagcctacctaaactcctgatttacngggcttctaccgggcatccgggttcctaacgattcattggcagcggtctgggaccgatttcactctcaccatccagcagcctgcaggctgaagatgtggctagtttatactgtcagcaaacatttactactttctttcgtctacgtttcggacggaggacctaaggtggagatcaaacgactgtggcctagctacatntgtcttgac

SEQ ID NO: 63170 - DNA, 528 bp, Homo sapiens
  misc_feature: GYAE6OF01BWNBW.31.78.H01.1.454.CMB.1.raw
  modified_base (413)..(413): a, c, t, g, unknown or other
  misc_feature (413)..(413): n is a, c, g, or t
  modified_base (525)..(525): a, c, t, g, unknown or other
  misc_feature (525)..(525): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttactgggcttcgtacccgggcacgtccggggttcctaaccgattcattggcagcgggtctgggaccgtatttccactctcaccatcagcagcctgcaggctgaagntgtggctagtttattactgtcagcaactattatactttctttcgtcctactttcggcggtaggacctaaggtggagatacgaaacgatggtcggctgaccacatctgtcttntac

SEQ ID NO: 63171 - DNA, 514 bp, Homo sapiens
  misc_feature: GYAE6OF01AXCZQ.31.78.H01.1.454.CMB.1.raw
  modified_base (477)..(477): a, c, t, g, unknown or other
  misc_feature (477)..(477): n is a, c, g, or t
tcagcagtagacgtcacgaccggtgctcgatttagtgtgagtagtttgggtttggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaaactcctgatttactgggcttctacccgggcatccgggttcctaaccgattcattggcagcgggtctgggaccgatttcactctcaccatcagcagcctgcaggctgaagatgtggcagtttatactgtcagcaacattatacttctttcgtctactttcggcggagggaccaaggtgganatcgaaacgactgtggctgctaccatctgtcttctac

SEQ ID NO: 63172 - DNA, 516 bp, Homo sapiens
  misc_feature: GYAE6OF01D8T0S.31.78.H01.1.454.CMB.1.raw
  modified_base (411)..(411): a, c, t, g, unknown or other
  misc_feature (411)..(411): n is a, c, g, or t
  modified_base (482)..(482): a, c, t, g, unknown or other
  misc_feature (482)..(482): n is a, c, g, or t
  modified_base (514)..(514): a, c, t, g, unknown or other
  misc_feature (514)..(514): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttactgggcttctacccgggcatccggggttcctaaccgattcattggcagcgggtctgggaccgatttcactctcaccatcagcagcctgcaggctgaagatgnggctagtttattactgtcagcaacattatactttctttcgtctaactttcggcggagggaccaaggtgganatcgaaacgatggtgctgcaccatctgtcttnac

SEQ ID NO: 63173 - DNA, 522 bp, Homo sapiens
  misc_feature: GYAE6OF01AO7MJ.31.78.H01.1.454.CMB.1.raw
  modified_base (328)..(328): a, c, t, g, unknown or other
  misc_feature (328)..(328): n is a, c, g, or t
  modified_base (518)..(518): a, c, t, g, unknown or other
  misc_feature (518)..(518): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaaactcctgatttactgggcttctacccgggnatccggggttcctaacgattcattggcagcgggtctgggaccgatttcactctcaccatcagcagcctgcaggctgaagatgtggctagtttattactgtcagcaacattatacttctttcgttcactttcggcggtagggaccctaaggtggagattaccgaaacgatgtggctgcaccatctgtcttntacg

SEQ ID NO: 63174 - DNA, 527 bp, Homo sapiens
  misc_feature: GYAE6OF01CQ5Q0.31.78.H01.1.454.CMB.1.raw
  modified_base (309)..(309): a, c, t, g, unknown or other
  misc_feature (309)..(309): n is a, c, g, or t
  modified_base (505)..(505): a, c, t, g, unknown or other
  misc_feature (505)..(505): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgtttatggcccacaataacaactacttagcttaggtaccagcagaaagtaggacagcctacctaaactctgatttacnggcttcacccgggcagtccgggttcctaacgattcattggcagcgggtctgggacctatttcactctcaccatcagcagccctgcaggctgaagatgtggactagtttaatactgtccagctaaactattacttactttctttcgtctacgtttcgggacggtagggtacctaagggtgagatacaaagtactggnggctgcaccatctgtcttctac

SEQ ID NO: 63175 - DNA, 518 bp, Homo sapiens
  misc_feature: GYAE6OF01EEMEL.31.78.H01.1.454.CMB.1.raw
  modified_base (511)..(511): a, c, t, g, unknown or other
  misc_feature (511)..(511): n is a, c, g, or t
  modified_base (515)..(515): a, c, t, g, unknown or other
  misc_feature (515)..(515): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttacgtgggcttctacccgggcagtccggggttcctaaccgattcattggcagcgggtctgggaccgatttcactctcaccatcagcagcctgcaggctgaagatgtggctagtttattactgtcagcaacattatacttctttcgtctacgtttcggcggagggaccaaggtggagatcgaaacgatggtggctgcaccatctntctntac

SEQ ID NO: 63176 - DNA, 568 bp, Homo sapiens
  misc_feature: GYAE6OF01DZG4U.31.78.H01.1.454.CMB.1.raw
  modified_base (366)..(366): a, c, t, g, unknown or other
  misc_feature (366)..(366): n is a, c, g, or t
  modified_base (437)..(437): a, c, t, g, unknown or other
  misc_feature (437)..(437): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagacgggccaccatcaactgcaagtccagccagagtgtttattcggccccaacaataacaactacttagcttggtaccagcaagaaagtaggacagcctactaaactcctagtactttacgtgggacttccgtaacccgggctaacgttcccggggttacctaaaccggnttcgaagttcggctaggcgggtctagggaccgtatttcactctacacatcagcagcctgccaggctagaanagtgtggctagtttatacgtgtcagacaacgtattaatacttctttcgtactacgtttcggacggtagggaccaaggtggagactacgaaacgtacgtggtcggactgactacctattctcgtcttcgtac

SEQ ID NO: 63177 - DNA, 574 bp, Homo sapiens
  misc_feature: GYAE6OF01AE5OQ.31.78.H01.1.454.CMB.1.raw
  modified_base (447)..(447): a, c, t, g, unknown or other
  misc_feature (447)..(447): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacaactacttagcttggtaccagcagaaagtaggacagcctacctaaactcctagactttactgggtcttccgtaaccccgggctacgttcccgggggttaccctaaaccggtattccgatttcggctaggccggggtccgtggggacccgtatttccacgtcctacaaccatcagcagcctgcaggctagaagntgtggctagtttatactgtcagcaactattatactttctttcgtctacgtttcggacggtacggacctagggtggagtatacgaaacgtacgtggtggtctagacctacactctcgttcttctaccg

SEQ ID NO: 63178 - DNA, 523 bp, Homo sapiens
  misc_feature: GYAE6OF01BN9ZQ.31.78.H01.1.454.CMB.1.raw
  modified_base (408)..(408): a, c, t, g, unknown or other
  misc_feature (408)..(408): n is a, c, g, or t
tcagcagtagacgtcacgaccggtgctcgatttagtgtgagtagtttgggtttggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttactgggcttctacccgggcatccggggttcctaaccgattcattggcagcgggtctgggaccgatttcactctcaccatcagcagcctgcaggctgaaagntgtggctagtttatactgtcagcaacatttactactttctttcgttctacgtttcggacggagggaccaagggtggagatacgaaacgtatggtggctgcacatctgtcttctac

SEQ ID NO: 63179 - DNA, 516 bp, Homo sapiens
  misc_feature: GYAE6OF01B8OD7.31.78.H01.1.454.CMB.1.raw
  modified_base (505)..(505): a, c, t, g, unknown or other
  misc_feature (505)..(505): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttactgggcttctacccgggcagtccggggttcctaacgattcattggcagcgggtctgggaccattcactctcacatcagcagcctgcaggctgaagatgtggctagtttattactgtcagcaactattatacttctttcgtctacgtttcggcggtaggaccaagggtggagatcgaaacgtatggtggctgcaccntctgtctctac

SEQ ID NO: 63180 - DNA, 583 bp, Homo sapiens
  misc_feature: GYAE6OF01CWIKV.31.78.H01.1.454.CMB.1.raw
  modified_base (449)..(449): a, c, t, g, unknown or other
  misc_feature (449)..(449): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagtagtgttttattcggccccacaataacaactacttagcttggtaccagacagaaagtaggacagcctacctaaactcctagtactttacgtgggtactttccgtaccccgggctacgttcccggggttaccctaaaccggtattcacgtttcggccaggtccggggtctggggaaccctatttccacttctaccaccatcagcagcctgcagctagaagntgtgctagtttatactgtcagactaactatttatactttcctttacgtctacgtttcggacggtaggaaccgtagggtggacgtactacgaaacgtactggtcggactgacctaccattccgtgttcttctacg

SEQ ID NO: 63181 - DNA, 628 bp, Homo sapiens
  misc_feature: GYAE6OF01CNAG7.31.78.H01.1.454.CMB.1.raw
  modified_base (318)..(318): a, c, t, g, unknown or other
  misc_feature (318)..(318): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctcgtgggcgagagggccaccatcaactgcaagtccagccagagttgtttatcggcccacaataacaactacttagcttaggtaccagacaagaaagtaggacagcctacctaaactcctgactttacgngggtccttccgtacccgggctaacgttcccggggtttaccctaaaccggtatttccgaagtttcggacagggtccggggtcgtagggggaacccgtatttccgaacttcctaccacctattccgagtccaacgtccctagccgaggtctacggaaagtagtgtggtactaagttttatacgtgtacacgtacaaactatttaactacctttcgtttacgtctacgtttcgggacggtaggaccgtaaggtgacgtactacgaaacgtacgtggtacggctcgacctaactactcgttcgtcttcgtaccg

SEQ ID NO: 63182 - DNA, 527 bp, Homo sapiens
  misc_feature: GYAE6OF01C0S21.31.78.H01.1.454.CMB.1.raw
  modified_base (490)..(490): a, c, t, g, unknown or other
  misc_feature (490)..(490): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggccccacaataacaactacttagcttggtaccagcagaaagtaggacagcctacctaaactcctgatttactgggcttctacccggcactccggggttcctaaccgattcattggcagcgggtctgggaccgattcactctcaccatcagcagcctgcaggctgaagatgtggctagtttatactgtcagacaactatttatactttctttccgttcacgtttcggacggagggaccaagggtgaganacgaaacgactggtgctgacctacatctgtctcgtac

SEQ ID NO: 63183 - DNA, 535 bp, Homo sapiens
  misc_feature: GYAE6OF01DTWWY.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctacctaaactcctagatttactgggcttccgtacccgggctacgtccggggttcctaaccgattcattggcaggcggtctgggaccgatttcactctcaccatcagcagcctgcaggctgaagatgtggctagtttatactgtcagcaactattaatacttctttcgtctactttcggacggagggactaagggtggagtatacgaaaacgtacgtgtcggactgacctacatctgtcttctac

SEQ ID NO: 63184 - DNA, 510 bp, Homo sapiens
  misc_feature: GYAE6OF01BXFX5.31.78.H01.1.454.CMB.1.raw
  modified_base (346)..(346): a, c, t, g, unknown or other
  misc_feature (346)..(346): n is a, c, g, or t
tcagcagtagacgtcacgaccggtgctcgatttagtgtgagtagtttgggtttgggggagctacaacaggcaggcaggggcagcaagatggtgttgcagactcaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttactgggcttctacccgggcatccggggttcctaaccgnttcattggcagcgggtctgggaccgatttcactctcaccatcagcagcctgcaggctgaagatgtggctagtttattactgtcagcaactattatacttctttcgtctactttcggcggaggaccaaggtgagatcgaaagactgtggctcgcacatctgtctc

SEQ ID NO: 63185 - DNA, 529 bp, Homo sapiens
  misc_feature: GYAE6OF01BZL0K.31.78.H01.1.454.CMB.1.raw
  modified_base (521)..(521): a, c, t, g, unknown or other
  misc_feature (521)..(521): n is a, c, g, or t
  modified_base (526)..(526): a, c, t, g, unknown or other
  misc_feature (526)..(526): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttactgggcttctaccgggcagtccggggttcctaaccgattcattggcagcgggtctgggaccgtatttcactctcaccatcagcagcctgcaggctgaagagtgtggctagtttatactgtcagtacaactattatacttctttcgtctactttcgggacggtagggaccgaaggtggagactacgaaacgactaggtggctagcaccatctntcctntac

SEQ ID NO: 63186 - DNA, 521 bp, Homo sapiens
  misc_feature: GYAE6OF01CSUCX.31.78.H01.1.454.CMB.1.raw
  modified_base (511)..(511): a, c, t, g, unknown or other
  misc_feature (511)..(511): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaaactcctgatttactgggcttctacccgggcatccggggttcctaaccgattcattggcagcgggtctgggaccgatttcactctcaccatcagcagcctgcaggctgagatgtggctagtttatactgtcagctaacattatacttctttcgtctacgtttcggcggtagggaccaaggtggagtatacgaaacgactggtggctgcaccatntgtcttctac

SEQ ID NO: 63187 - DNA, 537 bp, Homo sapiens
  misc_feature: GYAE6OF01ELJMC.31.78.H01.1.454.CMB.1.raw
  modified_base (418)..(418): a, c, t, g, unknown or other
  misc_feature (418)..(418): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttacgtgggcttccgtacccgggcacgttcccggggttacctaaccgattccatttggcagcgggtctgggaccgatttcactctcaccatcagcagcctgcaggctgaagntgtggctagtttattactgtcagcaactattatactttctttcgtctacgtttcggcggaggaccgtaaggtggagatacgaaacgtactggtcggctgaccacatcttcgtcttctac

SEQ ID NO: 63188 - DNA, 530 bp, Homo sapiens
  misc_feature: GYAE6OF01ACXSS.31.78.H01.1.454.CMB.1.raw
  modified_base (312)..(312): a, c, t, g, unknown or other
  misc_feature (312)..(312): n is a, c, g, or t
  modified_base (328)..(328): a, c, t, g, unknown or other
  misc_feature (328)..(328): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacaactacttagcttggtaccagcagaaagtaggacagcctcctaaactcctgatttacngggcttctacccgggnatccggggttcctaaccgattcattggcagtcgggtctgggaccgatttcactcctcaccatcagcagcctgcaggctagaagatgtggctagtttatacgtgtcagtcaactattatacttctttcgttctactttcggacggtagggtaccaaggtggagatacgaaacgtatggtggctgacaccatctgtcttctacg

SEQ ID NO: 63189 - DNA, 528 bp, Homo sapiens
  misc_feature: GYAE6OF01CP7TT.31.78.H01.1.454.CMB.1.raw
  modified_base (312)..(312): a, c, t, g, unknown or other
  misc_feature (312)..(312): n is a, c, g, or t
  modified_base (439)..(439): a, c, t, g, unknown or other
  misc_feature (439)..(439): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctacctaaactcctgatttacngggcttcgtacccgggcacgtccggggttcctaaccgattcattggcaggcgggtctgggaccattcactctcacatcagcagcctgcaggctagaagatgtggctagtttatactgtcagcaactnttatacttctttcgtctacgtttcggcggtagggaccaagggtggagatacgaaacggtactggtcggctgaccacatctgtcttctac

SEQ ID NO: 63190 - DNA, 526 bp, Homo sapiens
  misc_feature: GYAE6OF01D1RBW.31.78.H01.1.454.CMB.1.raw
  modified_base (330)..(330): a, c, t, g, unknown or other
  misc_feature (330)..(330): n is a, c, g, or t
  modified_base (414)..(414): a, c, t, g, unknown or other
  misc_feature (414)..(414): n is a, c, g, or t
  modified_base (436)..(436): a, c, t, g, unknown or other
  misc_feature (436)..(436): n is a, c, g, or t
  modified_base (522)..(522): a, c, t, g, unknown or other
  misc_feature (522)..(522): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagccctacctaaactcctagatttactgggcttctacccgggnagttccgggttacctaaccgattcattggcagcgggtctgggaccatttcactctcaccatcagcagcctgcagctgaagatgngctagtttatactgtcagcaanattatacttctttcgtctactttcggacggaggtaccaaggtgagatacgaaacgtagtgtcggctgactacccatcctgttcctntacc

SEQ ID NO: 63191 - DNA, 552 bp, Homo sapiens
  misc_feature: GYAE6OF01DHPMW.31.78.H01.1.454.CMB.1.raw
  modified_base (312)..(312): a, c, t, g, unknown or other
  misc_feature (312)..(312): n is a, c, g, or t
  modified_base (395)..(395): a, c, t, g, unknown or other
  misc_feature (395)..(395): n is a, c, g, or t
  modified_base (417)..(417): a, c, t, g, unknown or other
  misc_feature (417)..(417): n is a, c, g, or t
  modified_base (420)..(420): a, c, t, g, unknown or other
  misc_feature (420)..(420): n is a, c, g, or t
  modified_base (434)..(434): a, c, t, g, unknown or other
  misc_feature (434)..(434): n is a, c, g, or t
  modified_base (445)..(445): a, c, t, g, unknown or other
  misc_feature (445)..(445): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacgggggacatcgtgatgagccagtttccagactccctggctgtgtctctgggcgagagggccaccatcaactgcaagtccagccagagtgttttattggccccacaataacactacttagcttggtaccagcagaaagtaggacagcctcctaaactcctgactttacngggcttcgtacccgggcacgttcccggggttacctaaccgattcattggcaggtcgggtctgggacctatttcactctcaccntcagcagcctgcaggctgaagntgnggctagtttatacngtcagcaactnttactactttctttcgtctacgtttcggacggagggacctaagggtgagtactacgaaaacgtattggtcggctaggccctaacctattcctaggttccttctaccg

SEQ ID NO: 63192 - DNA, 638 bp, Homo sapiens
  misc_feature: GYAE6OF01AORVU.31.78.H01.1.454.CMB.1.raw
  modified_base (205)..(205): a, c, t, g, unknown or other
  misc_feature (205)..(205): n is a, c, g, or t
tcagcagtagacgtcacgaccggtgctcgatttagtgtgagtagtttgggtttgggggtagggcgtacaacaaggcaggcaggggcgagcaagatggtgttgcagacccaggtcttcatttctctgttgctctggatctctggtgcctacggggacatcgtgatgagccagtttccagactccctggctgtgtctctgggcgagngggccaccatcaactgcaagtccagccagtagttgttttattcggccccacaataacaactacttagcttggtaccagcagaaagtagacagcctcctaaactcctgactttctgggtcttcctacccgggcaacgtccggggttacctaacgattcagttggcaggccgggtcgtagggaccgtatttcactctcacatcacgcacgcctgcacggcttagaagtatggtcggcttaagttttattacgttgtacacgtacctaaactatttacgttaaccctttctttttaccggtcccgttaattttcccgggggaacggggaacgggtaacccgttaaggggtgggtaaccgaaagtttacgaaaaacccggttaccgtgggttacggacgtccggtacaacccgtattaccttcggttcttacctacg

SEQ ID NO: 63193 - DNA, 566 bp, Homo sapiens
  misc_feature: GYAE6OF01EQYXW.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacgggacatcgtgatgagccagtttccagactccctggctgtgtctctgggcgagagggccaccatcaactgcaagtccagccagagtgtttattggccccacaataacaactacttagctggtaccagcaagaaagtaggacagcctctaaactcctgactttactgggcttcgtacccgggctagttcccggggttcctaaaccgattccattcggcaggcgggtctggggacccatttccactctcaccatcagcagcctgcaggctgaagatgtggctagtttattactgtcagcaactattatactttcttcgttctacgttttcggacgggtacgggaccgaagggtacggagaattaccgaaaacggaacttggtcggtacgtaggacctaattacctaattcgttgttccttaccg

SEQ ID NO: 63194 - DNA, 534 bp, Homo sapiens
  misc_feature: GYAE6OF01CEZI8.31.78.H01.1.454.CMB.1.raw
  modified_base (492)..(492): a, c, t, g, unknown or other
  misc_feature (492)..(492): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagaggccaccatcaactgcaagtccagccagagtgttttattggccccacaataacaactacttagcttggtaccagcagaaagtaggacagcctacctaaactcctgatttactgggcttcgtacccgggcacgtccggggttcctaaccgattcattggcaggcgggtctgggacctatttcactctcaccatcagcagcctgcaggctagaagatggtggctagtttattactgtcagctaactattactacttctttcgtctacgtttcggcggacgggacctaaggtgganatacgaaacgactggtgctgaccaccattctgtccttcgtac

SEQ ID NO: 63195 - DNA, 514 bp, Homo sapiens
  misc_feature: GYAE6OF01AL00M.31.78.H01.1.454.CMB.1.raw
  modified_base (408)..(408): a, c, t, g, unknown or other
  misc_feature (408)..(408): n is a, c, g, or t
  modified_base (511)..(511): a, c, t, g, unknown or other
  misc_feature (511)..(511): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttactgggcttctacccgggcatccggggttcctaaccgattcattggcagcgggtctgggaccgatttcactctcaccatcagcagcctgcaggctgaagntgtggctagtttatactgtcagcaactattatacttcttcgtctacgtttcggcggaggaccaggtggagatacgaaacgatggtcgctgcaccatctgtctntac

SEQ ID NO: 63196 - DNA, 534 bp, Homo sapiens
  misc_feature: GYAE6OF01BKA14.31.78.H01.1.454.CMB.1.raw
  modified_base (311)..(311): a, c, t, g, unknown or other
  misc_feature (311)..(311): n is a, c, g, or t
  modified_base (351)..(351): a, c, t, g, unknown or other
  misc_feature (351)..(351): n is a, c, g, or t
  modified_base (528)..(528): a, c, t, g, unknown or other
  misc_feature (528)..(528): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcagagggccaccatcaactgcaagtccagccagagtgttttattggccccacaataacaactacttagcttggtaccagcagaaagtaggacagcctacctaaactcctgatttacngggtccttcgtacccgggcagtcccggggttcctaaccgnttcattggcaggcgggtctgggaccctatttcactctcaccatcagcagcctgcaggctgaagatgtgctagtttatactgtcagcaactattatacttctttcgtctactttcggcggtaggaccgaaggtgacgtatcgaaacgtactggtcgcttacacctatctagtcttcgnttcccg

SEQ ID NO: 63197 - DNA, 540 bp, Homo sapiens
  misc_feature: GYAE6OF01DGPRH.31.78.H01.1.454.CMB.1.raw
  modified_base (532)..(532): a, c, t, g, unknown or other
  misc_feature (532)..(532): n is a, c, g, or t
  modified_base (537)..(537): a, c, t, g, unknown or other
  misc_feature (537)..(537): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggccccaccaataacaactacttagcttggtaccagcagaaagtaggacagcctacctaaactcctgatttactgggcttctacccgggcacgtccggggttcctaaccgattcattggcaggcgggtctgggaccgtatttcactctcaccatcagcagcctgcaggctagaagatgtggctagtttattactgtcagcaactattaacttacttctttcgtctacgtttcggcggtagggaccgaaggtggagtataccgaaaacgtatggtcgcgtgactaccatctntcttntac

SEQ ID NO: 63198 - DNA, 528 bp, Homo sapiens
  misc_feature: GYAE6OF01AKV0B.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgtttattggccccacaataacaactacttagcttggtaccagcagaaagtaggacagcctcctaaactcctagatttactgggcttctacccgggctagtcccggggttcctaaccggattcattcggcaggcgggtctgggacctatttcactctcaccatcagcagcctgcaggctagaagtagtgtggctagtttatactgtcagacaactatttactacttctttcgtctactttcggcggaggaccaaggtgagatacgaaacgtatgtggctgctaccatctgtcttctac

SEQ ID NO: 63199 - DNA, 522 bp, Homo sapiens
  misc_feature: GYAE6OF01BOAAS.31.78.H01.1.454.CMB.1.raw
  modified_base (309)..(309): a, c, t, g, unknown or other
  misc_feature (309)..(309): n is a, c, g, or t
  modified_base (511)..(511): a, c, t, g, unknown or other
  misc_feature (511)..(511): n is a, c, g, or t
  modified_base (518)..(518): a, c, t, g, unknown or other
  misc_feature (518)..(518): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgtttattggccccacaataacaactacttagcttggtaccagcagaaagtaggacagcctctaaactcctgatttacngggcttctacccgggcatccggggttcctaaccgattcattggcagcgggtctgggaccatttcactctcaccatcagcagcctgcaggctagaagatgtggctagtttatactgtcagacaactattatactttctttcgtctacgtttcggcggagggaaccagggtgagatacgaaacgtactggtcgcgtgacacatntcgtctntacc

SEQ ID NO: 63200 - DNA, 590 bp, Homo sapiens
  misc_feature: GYAE6OF01AKHWX.31.78.H01.1.454.CMB.1.raw
  modified_base (274)..(274): a, c, t, g, unknown or other
  misc_feature (274)..(274): n is a, c, g, or t
  modified_base (278)..(278): a, c, t, g, unknown or other
  misc_feature (278)..(278): n is a, c, g, or t
  modified_base (292)..(292): a, c, t, g, unknown or other
  misc_feature (292)..(292): n is a, c, g, or t
  modified_base (316)..(316): a, c, t, g, unknown or other
  misc_feature (316)..(316): n is a, c, g, or t
  modified_base (331)..(331): a, c, t, g, unknown or other
  misc_feature (331)..(331): n is a, c, g, or t
  modified_base (364)..(364): a, c, t, g, unknown or other
  misc_feature (364)..(364): n is a, c, g, or t
  modified_base (566)..(566): a, c, t, g, unknown or other
  misc_feature (566)..(566): n is a, c, g, or t
tcagcagtagacgtcacgaccggtgctcgatttagtgtgagtagtttgggtttgggggtaggctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggccccacaataacaactcttagcttggtcnccancaagaagtacgacncgcctactaactcagttacttcgnggtctccgtaccggntacggttcccggtaccacgtctctagtcgacgnggtcggtcgtaccgggtactacgtttccactcctacacgtactcgagcgacgccgtcgcgacgtcgtaagaacgtcgtcggacggtcgttaagtttacttacgtctacgacacgtaactatttacttcctttacttcgttacttcggttacgggacgtacggtaacggtaggtcgaagtacgtaacgtaacgtgtggttcgntacgactaccattcctgttctacg

SEQ ID NO: 63201 - DNA, 579 bp, Homo sapiens
  misc_feature: GYAE6OF01DXV4N.31.78.H01.1.454.CMB.1.raw
  modified_base (318)..(318): a, c, t, g, unknown or other
  misc_feature (318)..(318): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctcgtgggcgaggagggccaccatcaactgcaagtccagccagagttgtttattcggccccacaataacaactactagcttggtaccagcaagaaagtaggacagcctactaaactcctagtatttacgnggcttccgacccgggtcacgttccggggttaccctaaccgattcagttcggcaggccggggtctcgggaccgtatttcactctcaccatcacgcacgcctgcgaggctagaagagtggtaggctagtttattactgtcagtacaatattactacttctttcgtactacgtttacggacggtaacgggaccgtaagggtggacgtaataccgaaacgtacgtacggtcggctacgacctaccacttacgtgtccttcgtacc

SEQ ID NO: 63202 - DNA, 509 bp, Homo sapiens
  misc_feature: GYAE6OF01AXJEC.31.78.H01.1.454.CMB.1.raw
  modified_base (507)..(507): a, c, t, g, unknown or other
  misc_feature (507)..(507): n is a, c, g, or t
tcagcagtagacgtcacgaccggtgctcgatttagtgtgagtagtttgggtttggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttactgggcttctacccgggcatccggggttcctaaccgattcattggcagcgggtctgggaccgatttcactctcaccatcagcagcctgcaggctgaagatgtggcagtttatactgtcagcaacattatacttctttcgtctactttcggcggagggaccaaggtgagatcgaaacgatgtggctgcacatctgtcttnac

SEQ ID NO: 63203 - DNA, 626 bp, Homo sapiens
  misc_feature: GYAE6OF01EIGCD.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagttgttttattcggccccacaataacaactacttagcttggtaccagcaagaaagtaggacagcctacctaaactcctagtactttacgtgggtcctttccgtacccgggctacgttcccgggggttaccctaaaccggtatttccaagtttcgggctacgggccggggttcgtcggggacccgtatttccactctaccacctatcagcacgcctgcacggctagaacgagtggtggtactagtttacttacgtgtacagactaactattactacctttcttacgttctacgtttcgggacggtacgggaccgtaagggtacggtagtaacgtaccgaaaacggtacgttggtacggacgtacgaccgtaccctattccgttcgttccttcgtacc

SEQ ID NO: 63204 - DNA, 525 bp, Homo sapiens
  misc_feature: GYAE6OF01EIABV.31.78.H01.1.454.CMB.1.raw
  modified_base (503)..(503): a, c, t, g, unknown or other
  misc_feature (503)..(503): n is a, c, g, or t
  modified_base (522)..(522): a, c, t, g, unknown or other
  misc_feature (522)..(522): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgtttattcggccccacaataacaactacttagcttggtaccagcaagaaagtaggacagcctcctaaactcctgatttactgggcttccgtacccgggctacgtccggggttcctaaccgattcattggcagcgggtctgggacctatttcactctcaccatcagcagcctgcaggctagaagatgtgctagtttattacgtgtcagcaactattatacttctttcgtctacgtttcggcggaggtacaaggtgagatacgaaacgtatggngctgactacatctgtcttntac

SEQ ID NO: 63205 - DNA, 579 bp, Homo sapiens
  misc_feature: GYAE6OF01C5PYI.31.78.H01.1.454.CMB.1.raw
  modified_base (320)..(320): a, c, t, g, unknown or other
  misc_feature (320)..(320): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagttgttttattcggccccaacaataacaactacttagcttggtaccagcaagaaagtaggacagccctacctaaactcctgtactttacncgggtctttcctacccgggctacgttccccggggttacctaaaccggtattacagttcggcgtacggtcggggtcctaggggacccgtatttcactcctacaccatccagcacgcctgcaggctagaagatgtggacttagtttattactgtcacgacaatactttatactttctttcgtcttacgttcggacggtagggaaccgtaaggtcgagactacgaaacgataggtgacctgacacctatcctgtcttctacg

SEQ ID NO: 63206 - DNA, 893 bp, Homo sapiens
  misc_feature: GYAE6OF01C9Z0C.31.78.H01.1.454.CMB.1.raw
tcagcagtagacgtcacgaccggtgctcgatttagtgtgagtagtttgggtttgggggagctacaacaggcaggcaggggcagcaagatggtgttgccgacccaggtcttcatttctctgttgctctggatctctggtgcctacgggacatcgtgatgagccagtttccagacctccctggctgtgtctcgtgggcgagagggccaccatcaactgcaagtccagccagagttgttttattcggccccacaataacaactactagcttggtaccagcaagaaagtaggacagcccttacctaaactcctagtactttacgtgggtccttccgtacccgggctacgttccccggggttacctaaacccggtatttccagtttcgggacctaggtccggggttctacgggggacccgtattttcccgaacctttcctaccgaaccctattccgaacggcccgtaacgtccccgttggacccgtaaggggtcccgttaagggaaaacggtagttacgggttacgggtacccgtttaagggttttttaactttaacccgtttacggttacccgtaaacgggtaacccttaaaaccgtttaacgttttttaaactttaaaccccgttttttcccgttttttaaccccggtttacccgtttaacccgggttttttacccggggggaacccgggggttaaaccggggggtaaaccccggtaaaaggggggtttacggggtaaaacggttaaaccgtttaaaccccgggaaaaaacccgggttaaaccggtttacggggtttaccggggtacccgttaccgggtaaccccgtaaaccccgttaacgtttacccgtttaccgggttttaccccttttacccgtaacccgttttcccccccgg

SEQ ID NO: 63207 - DNA, 541 bp, Homo sapiens
  misc_feature: GYAE6OF01B839V.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacaactacttagcttggtaccagcagaaagtaggacagcctacctaaactcctgatttactgggcttcgtacccgggcacgtccggggttacctaaccgattcattggcagcggtctgggaccatttcactctcacatcagcagcctgcgaggctagaagtagtgtggctagtttatactgtcagacaactattatactttctttcgtactacgtttcgggacggacggaccgtaagggtggagagtacgaaacgtacgtggtcggctgacctaccatctgtcttctac

SEQ ID NO: 63208 - DNA, 734 bp, Homo sapiens
  misc_feature: GYAE6OF01ALKBF.31.78.H01.1.454.CMB.1.raw
tcagcagtagacgtcacgaccggtgctcgatttagtgtgagtagtttgggtttgggggatctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagttgtttattcggccccacaataacaactacttagcttggtaccagcaagaaagtaggacagcctacctaaactcctagactttacgtcgggtcttccgtacccgggctaacgttcccggggttaccctaaaccggtacttccagtttcggactaacggtccggggttcgtcggggaccgttactttccgaaccttccgtaccaaccctatcccaaggccaacgtccctaggaccaagggtcctaggaaagtacgttcggtacggtacttaaggttttacttaacgtcggtaccaacgtacctaaaacttacttttaacttaaccttttcctttaccggttccttaaccggttttcggggaaccggggtaacgggtaacccgtaaaggggttcgggaaacgtaacgttaaccggtaaaaaccggttacggttacgggtacgggttacccttacggacccgttaacccgttaattcccgtttacggtttccttccggttaaaccc

SEQ ID NO: 63209 - DNA, 521 bp, Homo sapiens
  misc_feature: GYAE6OF01AT9NA.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgtttattggccccacaataacaactacttagcttggtaccagcagaaagtaggacagcctcctaaactcctgatttactgggcttctacccgggcatccggggttcctaaccgattcattggcagcggtctgggaccgatttcactctcaccatcagcagcctgcaggctagaagatgtggctagtttattactgtcagcaacattaatactttctttcgtctactttcggcggtagggaccaaggtggagatacgaaacgatggtgctgcctaccatctgtcttcgtac

SEQ ID NO: 63210 - DNA, 510 bp, Homo sapiens
  misc_feature: GYAE6OF01BWLT6.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttactgggcttctacccgggcatccggggttctaaccgattcattggcagcgggtctgggaccgatttcactctcaccatcagcagcctgcaggctgaagatgtggctagtttattactgtcagcaacattatacttctttcgtcactttcggcggtaggaccaggtgagatcgaaacgatgtggctgcaccatctgtcttcac

SEQ ID NO: 63211 - DNA, 544 bp, Homo sapiens
  misc_feature: GYAE6OF01D38QO.31.78.H01.1.454.CMB.1.raw
  modified_base (537)..(537): a, c, t, g, unknown or other
  misc_feature (537)..(537): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacaactacttagcttggtaccagcagaaagtaggacagcctacctaaactcctagtactttactgggccttcgtacccgggaatcccggggttacctaaccgattcattggcagcgggtctgggacctatttcactctcaccatcagcagcctgcaggctagaagatggtggctagtttattactgtcagcaactattatactttctttcgtctacgtttcgggcggaggaccgaagggtggagatacaaacgtactggtaggctcgcaccgtatctagtcttcncttcccg

SEQ ID NO: 63212 - DNA, 530 bp, Homo sapiens
  misc_feature: GYAE6OF01CEJGU.31.78.H01.1.454.CMB.1.raw
  modified_base (310)..(310): a, c, t, g, unknown or other
  misc_feature (310)..(310): n is a, c, g, or t
  modified_base (326)..(326): a, c, t, g, unknown or other
  misc_feature (326)..(326): n is a, c, g, or t
  modified_base (436)..(436): a, c, t, g, unknown or other
  misc_feature (436)..(436): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactcctggctgtgtctctgggcgagaggccaccatcaactgcaagtccagccagagtgttttattggccccacaataacaactacttagcttggtaccagcagaaagtaggacagcctacctaaactcctgatttacngggcttctacccgggnacgtccgggttcctaaccgattcattggcagcgggtctgggacctattcactctcaccatcagcagcctgcaggctgaagatgtggctagttttatactgtcagccaaanatttatacctttctttcgtctacgtttcggacggagggaccaagggtcgagtatacgaaacgattggtcggctggccacattctgttcttctac

SEQ ID NO: 63213 - DNA, 521 bp, Homo sapiens
  misc_feature: GYAE6OF01EDNJO.31.78.H01.1.454.CMB.1.raw
tcagcagtagacgtcacgaccggtgctcgatttagtgtgagtagtttgggtttggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagccctacctaaactcctgatttactgggcttcgtacccgggcacgtccggggttcctaaccgattcattggcaggcgggtctgggacctatttcactctcaccatcagcagcctgcagctgaagatgtggctagtttatactgtcagcaacattatactttcttcgtactactttcggacggtagggaaccaaggtggagatacgaaacgatgtggctgcacatctgtctctac

SEQ ID NO: 63214 - DNA, 529 bp, Homo sapiens
  misc_feature: GYAE6OF01BBZ01.31.78.H01.1.454.CMB.1.raw
  modified_base (414)..(414): a, c, t, g, unknown or other
  misc_feature (414)..(414): n is a, c, g, or t
  modified_base (525)..(525): a, c, t, g, unknown or other
  misc_feature (525)..(525): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattggccccacaataacaactacttagcttggtaccagcagaaagtaggacagcctacctaaactcctgatttactgggcttctacccgggcagtccggggttcctaaccgattcattcggcagcgggtctgggaccgtatttcactctcaccatcagcagcctgcaggctagaagntgtggctagtttatacgtgtcagcaatattattacttctttcgtctacgtttcggcggaggaccaagggtgagatacgaaacgtatggtggctgactaccatctgttcctntacc

SEQ ID NO: 63215 - DNA, 675 bp, Homo sapiens
  misc_feature: GYAE6OF01CHTXW.31.78.H01.1.454.CMB.1.raw
  modified_base (364)..(364): a, c, t, g, unknown or other
  misc_feature (364)..(364): n is a, c, g, or t
  modified_base (411)..(411): a, c, t, g, unknown or other
  misc_feature (411)..(411): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagacctccctggctgtgtctcgtgggcgaggagggccaccatcaactgcaagtccagccagagttgttttattcggcccaacaataacaactacttagcttggtaccagcagaaagtaggacagccctacctaaactcctagatttacgtgggctttcctacccggggctacgtcccggggttacctaaccgnttcattggcaggcgggtctcgggaccgtatttcactctcaccatcancacgcctgcgaggctgaacgagtggtggacctagttttactacgttcgtacaacggtactaaacttaagtttaactttaacctttccgttttaccgttaccgttaacccggtttttccggggaaccggggtaacgggtaaacccggtaaaggggttacgggaaacggtaaaccgtaaaccggaaaaaccggtaacgttcgggtacgggtcccttcggacccgtaacccgtacttacccgtttcgttcccgtttacctaaccccg

SEQ ID NO: 63216 - DNA, 716 bp, Homo sapiens
  misc_feature: GYAE6OF01BK6FM.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagacctccctggctgtgtctcgtgggcgagaggccaccatcaactgcaagtccagccagtagttgttttacttcggaccccaacaataaccaactacttagcttaggtaccagacaagaaagtaggacagcctacctaaactcctagtaactttacgtgggtccttaccgtacccgggctacgttcccgggggtttaccctaaaccgtatttaccgagtttcgggacctagggtccggggttacgtacggggaaccgtactttccgaaccttctaccaacctatccgaacgccacgtccctgaccgtaggaccttaggaaacgtagttcggtggtaccttaaggttttaacgttacgttacggtaccaacggtacctaaacttaagttttaaccttaaccttttccgttttacggttaccttaccggttttcgggaccgggtaacgggtacccgtaaagggtcggtaagtaacgtaaccgaaaacggtacgtgggtacggtacgtacggaccctaaccgtattacgttcgttccgttctaaccg

SEQ ID NO: 63217 - DNA, 535 bp, Homo sapiens
  misc_feature: GYAE6OF01CQHL8.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctacctaaactcctgatttactgggccttctacccgggcacgttcccggggttcctaaccgattcattggcaggcgggtctgggaccgattcactctcaccatcagcagcctgcaggctagaagatgtggctagtttatactgtcagctaacatttatacttctttcgtctacgtttcggacggtagggtaccaagggtcggagtatacgaaacggatggtcggctgacaccatctgtcttctac

SEQ ID NO: 63218 - DNA, 523 bp, Homo sapiens
  misc_feature: GYAE6OF01BRNAB.31.78.H01.1.454.CMB.1.raw
  modified_base (414)..(414): a, c, t, g, unknown or other
  misc_feature (414)..(414): n is a, c, g, or t
  modified_base (520)..(520): a, c, t, g, unknown or other
  misc_feature (520)..(520): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctacctaaactcctgatttacgtgggcttcgtacccgggcagtcccggggttcctaaccgattcattggcagcgggtctgggaccgtatttcactctcaccatcagcagcctgcaggctgaagntgtggctagtttatactgtcagcaactattatacttctttcgtctacgtttcggcggagggaccaagggtgagatcgaaacgtatggtgctgcaccatctgtcttntac

SEQ ID NO: 63219 - DNA, 519 bp, Homo sapiens
  misc_feature: GYAE6OF01DTTQ4.31.78.H01.1.454.CMB.1.raw
  modified_base (517)..(517): a, c, t, g, unknown or other
  misc_feature (517)..(517): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttactgggcttctacccgggcatccggggttcctaaccgattcattggcagcgggtctgggaccgatttcactctcaccatcagcagcctgcaggctgaagatgtggctagtttattactgtcagcaactattatacttctttcgtctacgtttcggcggaggaccaaggtggagatacgaaacgaatggtcggctgcactatctgtcttnac

SEQ ID NO: 63220 - DNA, 562 bp, Homo sapiens
  misc_feature: GYAE6OF01CSXEO.31.78.H01.1.454.CMB.1.raw
  modified_base (329)..(329): a, c, t, g, unknown or other
  misc_feature (329)..(329): n is a, c, g, or t
  modified_base (441)..(441): a, c, t, g, unknown or other
  misc_feature (441)..(441): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagtgttttattggccccacaataacaactacttagcttggtaccagcagaaagtaggacagcctcctaaaactcctgatttactgggcttctacccgggnagtccggggttcctaacgattcattggcagcgggtctggggacctatttccactctcaccatcagcagcctgcaggctagaagatgtggctagtttatactgtacagacaanttaattacttctttacgtcctacgttttcggacggtagggaccctaaagggttggaacgtagttacgaaaaccggtaacttggttagggacttcgacacctatccttagtccttctaaccg

SEQ ID NO: 63221 - DNA, 832 bp, Homo sapiens
  misc_feature: GYAE6OF01C4F52.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccactacaactcgacaacgtccacgaccaaggtagtttagtttttacgttccggacccccaaacctaaaacttaaaacctaaccttaacgttaacggtcgtttacgggtaacccaggaccgaaaggtaaaacggtacggaactaccggtacccttaacccttaaaaccttccgtagttaacttttaccggtcgggtcctttacccggaccccggggtactaccgggtttaccccgggggttaccctaaaccggtacttaccgtaagtttcggaccgtacgggggtccgggttcggtacgggggaacccgtttagtttaccgtaacccgttcctaccctaaaccctattacccgaacgtcccgaaccggtcccgtaggacccgtaagggtcccgtaaggtaaacggtagttcgggttacgggtactttaaaggtttttaactttaccggtcgttaccgtaacgtacctaaactttagtttaaactttaaccgttttccgtttacccgtacgtttaccgtttccggggacgggtacgggtaaacccgtagggtaggaacgtaacgtaaccggtaaaacgtacgttggtcgggactcggaccctacgtacttgttcgttccttctacccg

SEQ ID NO: 63222 - DNA, 729 bp, Homo sapiens
  misc_feature: GYAE6OF01DY5FQ.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatggagcctagttccagacctccgtggctgtgtctcgtgggcgaggacggccaccataccaactcgacaacgtccacgaccaagtagtttgtttttagttccggaccccaacctaaataaacctaacttacgttacgtcgttacggtaaccagacgaaagtaaaggtacggaacacgtaccctaacctaactctagtactttacgtcggtcttaccgtaccggctacgttcccgggttaccctaaccgtattcgagttcggacgtacgggtccgggtcgtacggggaacccttatttccacttccacaccatacgacgcacgtcctcgcgaggtctaaggaagtagttggtacggtacttaagtttttaactaccgttcgtacaacgtactaaacttactttaacgtttaccttttccgtttaccgttaccttaccggtttaccggggaacggggtaaccggtaaccgttaaggggtacggaacgtaaacgttaaccgaaaaccggtacggttacggtcggtacctacggtaccctaaccgttaattccgttacggtttccttccgttacccg

SEQ ID NO: 63223 - DNA, 526 bp, Homo sapiens
  misc_feature: GYAE6OF01BGUDY.31.78.H01.1.454.CMB.1.raw
  modified_base (311)..(311): a, c, t, g, unknown or other
  misc_feature (311)..(311): n is a, c, g, or t
  modified_base (349)..(349): a, c, t, g, unknown or other
  misc_feature (349)..(349): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacactacttagcttggtaccagcagaaagtaggacagcctcctaaactcctagatttacngggccttctacccgggcagtcccggggttcctaaccgnttcattggcagcggtctgggacctatttcactctcaccatcagcagcctgcaggctgaagatgtgctagtttatacgtgtcagcaactattatacttcttcgtctacgtttcggcggtaggaccgaaggtgagtatacgaaacgtactgtggctgacctacatctcgttcttcgtac

SEQ ID NO: 63224 - DNA, 562 bp, Homo sapiens
  misc_feature: GYAE6OF01C3OB7.31.78.H01.1.454.CMB.1.raw
  modified_base (417)..(417): a, c, t, g, unknown or other
  misc_feature (417)..(417): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggccccacaataacaactacttagcttggtaccagcagaaagtaggacagcctacctaaactcctgatttactgggctttcgtacccgggcacgttccggggttccctaaccgattcattggcaggcgggtctgggacctattcactctcaccatcagcagcctgcaggctgaagntgtggctagttttatactgtcagcaactatttactactttctttcgtctacgtttcgggacggagggaaccaagggtggactagtaccgaaaacgtacttggtcggctggacctacccgaattcccgttacgttctttcgtaacc

SEQ ID NO: 63225 - DNA, 528 bp, Homo sapiens
  misc_feature: GYAE6OF01CN6OC.31.78.H01.1.454.CMB.1.raw
  modified_base (525)..(525): a, c, t, g, unknown or other
  misc_feature (525)..(525): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggcccacaataacaactacttagcttggtaccagcagaaagtaggacagcctacctaaactcctgatttactgggcttctacccgggcacgtccggggttcctaaccgattcattggcagcgggtctgggacctatttcactctcaccatcagcagcctgcaggctagaagatgtggctagtttacttactgtcagcaactattaatactttctttcgtctacgtttcggcggtagggaacctaggtggagatacgaaaacgactggtggctgcacatctcgtctntac

SEQ ID NO: 63226 - DNA, 548 bp, Homo sapiens
  misc_feature: GYAE6OF01AP12L.31.78.H01.1.454.CMB.1.raw
  modified_base (310)..(310): a, c, t, g, unknown or other
  misc_feature (310)..(310): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgtttattggccccacaataacaactacttagcttggtaccagcagaaagtaggacagcctcctaaactcctgatttacngggcttcgtacccgggcacgtcccggggttacctaaccgattccattcggcaggcgggtctgggaccatttcactctcaccatcagcagcctgcagctgaagatgtggctagtttatacgtgtcagacaactattatacttctttcgtctacgtttcggacggtacggaccgaagggtgagtaacgtacgaaacgtaacgtggtggcgtagacctacctattacctgttccttcgtac

SEQ ID NO: 63227 - DNA, 626 bp, Homo sapiens
  misc_feature: GYAE6OF01ENUGP.31.78.H01.1.454.CMB.1.raw
tcagcagtagacgtcacgaccggtgctcgatttagtgtgagtagtttgggtttgggggagctacaacaggcaggcaggggcagcaagatggtgttggcagacccaggtcttcagtttctctggttggctctggatctctcggtgcctacgggacatcgtgatgagccagtttccagactccctggctgtgtctcgtgggcgaggagggccaccgatcgaactggacaagtccagccagagttgttttattcggaccccacaataacaactacttagcttggtaccagcaagaaagtaggacagtccctacctaaactcctagtactttacgtgggcctttccgtacccgggctacgttcccggggttaccctaaacccggtatttccgaagtttcggactacgggtccggggtacgtggggaacccgtaattttccaacttcgtacacccgtatcagccaggcctgacgaggtctagaacgagtggtggtactaggtttacttagtcgtacagactaagtattattacctttcttacgtactaccgtttcgggcgacgggtaccgtaaggtagagtagtaacgaaacgtataggtcgctacggacctacattactgttctcgtacc

SEQ ID NO: 63228 - DNA, 523 bp, Homo sapiens
  misc_feature: GYAE6OF01CQH80.31.78.H01.1.454.CMB.1.raw
  modified_base (374)..(374): a, c, t, g, unknown or other
  misc_feature (374)..(374): n is a, c, g, or t
  modified_base (512)..(512): a, c, t, g, unknown or other
  misc_feature (512)..(512): n is a, c, g, or t
  modified_base (520)..(520): a, c, t, g, unknown or other
  misc_feature (520)..(520): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttactgggcttctacccgggcagtcccggggttcctaaccgattcattggcagcgggtctgggaccgnttcactctcaccatcagcagcctgcaggctgaagatgtggcagtttatactgtcagcaacatttactacttctttcgtcacttttcgggcggagggacctaagggtggaagtactacgaaacgatggtggctgcaccntctgtctntac

SEQ ID NO: 63229 - DNA, 642 bp, Homo sapiens
  misc_feature: GYAE6OF01DNI7C.31.78.H01.1.454.CMB.1.raw
  modified_base (332)..(332): a, c, t, g, unknown or other
  misc_feature (332)..(332): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgacgcctagtttccagactcccgtggctgtgtctcgtgggcgaggacgggccaccatcaactgacaagtccagccagtagttgttttacttcggaccccaactaactaacaactacttagcttaggaccagacaagaaagtaggacagcctacctaactcctagtacttacgngggtcttccgtaccgggctacgtcccgggttacctaacgtacttcagttcggcacgggtcgggtctacgggacctatttccactctccacctatcacgcagcctagcgaggtcctaggaagtacgtggtcgacttagtttaactaccgtgtacacgtactaacttatttacgtactttccgtttccgtacttacgttcgggacgggtacgggtaacctaaggggtcgaagtaacgtaaccgtaaaacgacgttacggtcggtaccttacggaccctaaccttacgtccgtttacggtccttaccgtaccg

SEQ ID NO: 63230 - DNA, 565 bp, Homo sapiens
  misc_feature: GYAE6OF01EHY4B.31.78.H01.1.454.CMB.1.raw
  modified_base (561)..(561): a, c, t, g, unknown or other
  misc_feature (561)..(561): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagacctccctggctgtgtctcgtgggcgaggagggccaccatcaactgacaagtccagccagtagttgttttattcggccccaacaataacaactacttagcttggtaccagacaagaaagtaggacagccctacctaaactcctagtactttacgtgggtcttaccgtacccgggctacgttcccggggttacctaaccgattcattggcgaggtcgggtcgtcgggaccgtatttcacttctcaccatcagcacgcctgcagctagaagatgtggactagtttatacgtgtcagacaactattacttactttcttcgtctacgtttcggacggtacggacgaaggtgagatacgaaacgtactggtcgctgaccacactctcgttctntacc

SEQ ID NO: 63231 - DNA, 530 bp, Homo sapiens
  misc_feature: GYAE6OF01B8YEB.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgtttattcggccccacaataacaactacttagcttggtaccagcagaaagtaggacagcctacctaaactcctgatttactgggcttccgtacccgggcacgtcccggggttcctaaccgattcattggcagcgggtctggggaccgatttcactctcaccatcagcagcctgcaggctgaagatggtggctagtttatacgtgtcagcaactattatactttcttcgtctactttcggacggtagggaccaagggtgagatacgaaacgtactggtgctgacaccatctgttctctac

SEQ ID NO: 63232 - DNA, 523 bp, Homo sapiens
  misc_feature: GYAE6OF01DP917.31.78.H01.1.454.CMB.1.raw
  modified_base (432)..(432): a, c, t, g, unknown or other
  misc_feature (432)..(432): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacaactacttagcttggtaccagcaagaaagtaggacagcctacctaaactcctgatttacgtgggcttcacccgggcacgtccgggttcctaacgattcattggcaggcgggtctgggacctatttcactctcaccatcagcacgcctgcaggctagaagatgtgctagtttatacgtntcagctaactattataacttctttcgtctacgtttcggacggaggaccaaggtgagatacgaaacgatggtgctgacacatctgtctctac

SEQ ID NO: 63233 - DNA, 580 bp, Homo sapiens
  misc_feature: GYAE6OF01DE6RF.31.78.H01.1.454.CMB.1.raw
  modified_base (555)..(555): a, c, t, g, unknown or other
  misc_feature (555)..(555): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgtttattcggccccaacaataacaactacttagcttggtaccagcaagaaagtaggacagccctacctaaactcctagactttactgggtccttccgtacccggggctaacgtcccgggggtttaccctaaaccggtatttccagtttcggactaagggccggggttctcgggggaccctagtttccaactcctaccaacctatccaaggcagcctgcaggctagaagatggtggactaggtttatacgtgtcagacaactatttactacttctttcgtctacgtttcggacggaggaccaagggtgagatacgaaacgatggngctgcctaccatctcgttctctacc

SEQ ID NO: 63234 - DNA, 542 bp, Homo sapiens
  misc_feature: GYAE6OF01CZEL9.31.78.H01.1.454.CMB.1.raw
  modified_base (373)..(373): a, c, t, g, unknown or other
  misc_feature (373)..(373): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccaccaataacaactacttagcttggtaccagcagaaagtaggacagcctctaaactcctgatttactgggtcttctacccgggcagtccggggttccaaccgattcattggcaggcggtctgggaccntttcactctcacatcagcagcctgcaggctgaagatgtggctagttttatactgtcagcaacatttatactttctttcgtactacgtttcggacggtagggaccaagggtcgaagagtacaaacggtactggtcggcttcggcctaaccacttcttagtcctttctacc

SEQ ID NO: 63235 - DNA, 539 bp, Homo sapiens
  misc_feature: GYAE6OF01D4UOH.31.78.H01.1.454.CMB.1.raw
  modified_base (330)..(330): a, c, t, g, unknown or other
  misc_feature (330)..(330): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcaagaaagtaggacagcctacctaaactcctgatttactgggcttcgtacccgggnacgtccggggttacctaaccgattcattggcagcgggtctgggaccgatttcactctcaccatcagcagcctgcaggctgaagatgtgctagtttatactgtcagacaacattatacttctttcgttctacgtttcggacggtacgggaccgtaagggtggagatacgaaacgtataggtggctgacctaccactctcgttcttctacg

SEQ ID NO: 63236 - DNA, 585 bp, Homo sapiens
  misc_feature: GYAE6OF01DB0TA.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagtagttgttttattcggaccccacaaataacaactacttagcttggtaccagcaagaaagtaggacagcctacctaaactcctgtactttacgtgggtcttccgtacccgggctacgttcccggggttaccctaaccgtattcgattggcaggcgggtctgggacctatttcactctcaccatcagcagcctgcaggctgaagatgtggctagtttatacgtgtcagactaactatttaacttactttctttcgtacgttacgtttcgggacggacgggtaccgaagggtcggagaacgttacgaaaccggtaagtggtcggaccgtgaccctacctattcctcgttccttcgtaccg

SEQ ID NO: 63237 - DNA, 512 bp, Homo sapiens
  misc_feature: GYAE6OF01BSIGK.31.78.H01.1.454.CMB.1.raw
  modified_base (509)..(509): a, c, t, g, unknown or other
  misc_feature (509)..(509): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgtttattggccccacaataacaactacttagcttggtaccagcagaaagtaggacagcctcctaaactcctgatttactgggcttctacccgggcagtccggggttcctaaccgattcattggcagcgggtctgggaccgatttcactctcaccatcagcagcctgcaggctgaagatgtggctagtttatactgtcagcaacattatacttctttcgtctactttcggcggtagggaccaaggtgagatacgaaacgatgtgctgcacatctgtctntac

SEQ ID NO: 63238 - DNA, 604 bp, Homo sapiens
  misc_feature: GYAE6OF01ESGPV.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagtgtttattcggccccacaataacaactacttagcttaggtaccagcagaaagtaggacagcctactaaactcctagtactttacgtcgggtctttccgtacccggggctacggttccccggggtttacctaaaccgtattcagtttcggcaggcgggtcgtgggacctatttccactctcaccatcgagccagcctgcaggtctagaacgatggtcgactagtttacttactgtacagacctaactatttacttacttcctttacgtccttacgtttcgggacgggtaacgggtaccgaagggtcggtaagaacgtaccgaaaaccggtaacgtggtacggcgtacgacctacctattcttcgttctctaacg

SEQ ID NO: 63239 - DNA, 532 bp, Homo sapiens
  misc_feature: GYAE6OF01CUGFT.31.78.H01.1.454.CMB.1.raw
  modified_base (313)..(313): a, c, t, g, unknown or other
  misc_feature (313)..(313): n is a, c, g, or t
  modified_base (377)..(377): a, c, t, g, unknown or other
  misc_feature (377)..(377): n is a, c, g, or t
  modified_base (412)..(412): a, c, t, g, unknown or other
  misc_feature (412)..(412): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggccccacaataacaactacttagcttggtaccagcagaaagtaggacagcctcctaaactcctgatttacngggctttctacccgggcacgtccggggttcctaaccgattcattggcagcgggtctgggacctnttcactctcaccatcagcagcctgcaggctgaagntgtggctagtttatactgtcagcaactattaattacttctttcgtctacgtttcggacggagggaccgaggtggagatacgaaacgtatggtcggctgactaccatcttcgtcttctacg

SEQ ID NO: 63240 - DNA, 574 bp, Homo sapiens
  misc_feature: GYAE6OF01EBTBN.31.78.H01.1.454.CMB.1.raw
  modified_base (563)..(563): a, c, t, g, unknown or other
  misc_feature (563)..(563): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacaactacttagcttggtaccagcaagaaagtaggacagccctacctaaactcctagtatttacgtgggtcctttccgtaccccgggctacgttccccgggggtttaccctaaaccggtatttccagtttcgggcctagggccggggtcgtcggggacccgtatttccacttcctccaccatcagcacgcctgcaggctagaagagtggtggctagtttattactgtcagacaactattatacttctttcgtctacgtttcggacggaggaccaagggtggagatacgaaacgtatggtggctgacacatntcgtcttctac

SEQ ID NO: 63241 - DNA, 546 bp, Homo sapiens
  misc_feature: GYAE6OF01BXZ71.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagaggccaccatcaactgcaagtccagccagagtgtttattggccccacaataacaactacttagcttggtaccagcaagaaagtaggacagcctacctaaactcctagactttactgggtcttcgtacccgggctacgtcccggggttacctaaaccgtattcaattggcaggcgggtcgtgggaccgtatttcgactcgtcacatcagcagcctgcaggctgaagatgtgctagtttatactgtacagactaactattatacttctttcgtctactttcggacggtacggaccgtaaggtcgagacgtacgaaaacgatggtcggactgacctacatctcgtctctac

SEQ ID NO: 63242 - DNA, 521 bp, Homo sapiens
  misc_feature: GYAE6OF01BCL2F.31.78.H01.1.454.CMB.1.raw
  modified_base (349)..(349): a, c, t, g, unknown or other
  misc_feature (349)..(349): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctacctaaactcctgatttacgtgggcttctacccgggcagtccggggttcctaaccgnttcattggcaggcgggtctgggaccgtatttcactctcaccatcagcagcctgcaggctagaagatgtggctagtttatactgtcagacaatattatacttcttcgtctacgtttcggcggtacggacaggtggagatacgaaacgtactggtgctgcacatctgtctctac

SEQ ID NO: 63243 - DNA, 842 bp, Homo sapiens
  misc_feature: GYAE6OF01BV4FG.31.78.H01.1.454.CMB.1.raw
  modified_base (311)..(311): a, c, t, g, unknown or other
  misc_feature (311)..(311): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactcctggctgtgtctctgggcgagaggccaccatcaactgcaagtccagccagagtgttttattcggccccacaataacaactacttagcttggtaccagcagaaagtaggacagccctactaactcctagatttacngggtcttcgtacccgggctacgttcccggggtttcctaaaccggtatttccgaagtttcggccgtaacgggtccgggggttaccgtacgggggtaaccccgtaagtttttaccgaaccgtttcccgttaccaaccccgtaaacgttcccgaacggtcccgtaacggtccccgtttacggaccgtaacgggtcccgttaaggtaaacggtaagttcgggttacgggtaccgttaaggttttttaaacgtttaaccgttacggtttaccgaaacggttacctaaaacccgttaagttttaacctttaacccgtttttacccgtttttaccggtttacccgttaaccgggtttttacccgggggtaaccgggggtaaccgggggtaaaccccggtaaaggggggtttacggaaacgggtaacgtttaaacccggaaaaaccgggttaaacgttacgggttacgggtacccgttacgggtaacccgtaaccccgtaacgtttacccgttccggtttacccgtttcccgtaacccg

SEQ ID NO: 63244 - DNA, 529 bp, Homo sapiens
  misc_feature: GYAE6OF01C7LZ9.31.78.H01.1.454.CMB.1.raw
  modified_base (312)..(312): a, c, t, g, unknown or other
  misc_feature (312)..(312): n is a, c, g, or t
  modified_base (427)..(427): a, c, t, g, unknown or other
  misc_feature (427)..(427): n is a, c, g, or t
  modified_base (517)..(517): a, c, t, g, unknown or other
  misc_feature (517)..(517): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccaccaataacaactacttagcttggtaccagcagaaagtaggacagcctcctaaactcctgatttacngggcttctacccgggcagtccggggttccaaaccgattcattggcagcgggtctgggaccgatttcactctcaccatcagcagcctgcaggctgaagatgtggcagtttattacngtcagcaactattatacttctttcgtctacgtttcggcggtagggaaccaagggtgagtatacgaaaacgactggtggctgactaccatntcgtcttcgtac

SEQ ID NO: 63245 - DNA, 514 bp, Homo sapiens
  misc_feature: GYAE6OF01C8UOO.31.78.H01.1.454.CMB.1.raw
tcagcagtagacgtcacgaccggtgctcgatttagtgtgagtagtttgggtttggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaaactcctgatttactgggcttctacccgggcatccggggttcctaaccgattcattggcagcgggtctgggaccgattcactctcaccatcagcagcctgcaggctgaagatgtggcagtttatactgtcagcaactattatacttctttcgtctactttcgggcggagggaccaaggtggagtatcgaaacgactgtggctgcacatctgtcttcac

SEQ ID NO: 63246 - DNA, 526 bp, Homo sapiens
  misc_feature: GYAE6OF01EJ5SS.31.78.H01.1.454.CMB.1.raw
  modified_base (326)..(326): a, c, t, g, unknown or other
  misc_feature (326)..(326): n is a, c, g, or t
tcagcagtagacgtcacgaccggtgctcgatttagtgtgagtagtttgggtttggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctacctaaactcctgatttactgggcttctaccgggnatccggggttcctaacgattcattggcagcgggtctgggaccgatttcactctcaccatcagtagcctgcaggctagaagatgtggctagtttattctgtcagcaacattataacttctttcgtctactttcggcggtaggaccaaggtggaagtatacgaaacgacgtgtaggctagcaccatactgtcttcattcccg

SEQ ID NO: 63247 - DNA, 541 bp, Homo sapiens
  misc_feature: GYAE6OF01BM8NS.31.78.H01.1.454.CMB.1.raw
  modified_base (412)..(412): a, c, t, g, unknown or other
  misc_feature (412)..(412): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagaggccaccatcaactgcaagtccagccagagtgtttattggccccacaataacaactacttagcttggtaccagcagaaagtaggacagccctacctaaactcctagatttacgtgggcttctacccgggcagtcccggggttcctaaccgattcattggcagcgggtctgggacctatttcactctcaccatcagcagcctgcaggctgaagntgtggctagtttattactgtcagcaactattatactttctttcgtctacgtttcggcggtacgggaccaagggtgagatacgaaacgtaactggtacgctagacctacctagttctgttccttcgtacc

SEQ ID NO: 63248 - DNA, 518 bp, Homo sapiens
  misc_feature: GYAE6OF01APAD1.31.78.H01.1.454.CMB.1.raw
  modified_base (411)..(411): a, c, t, g, unknown or other
  misc_feature (411)..(411): n is a, c, g, or t
  modified_base (511)..(511): a, c, t, g, unknown or other
  misc_feature (511)..(511): n is a, c, g, or t
  modified_base (515)..(515): a, c, t, g, unknown or other
  misc_feature (515)..(515): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttatttggccccaccaataacaactacttagcttggtaccagcagaaagtaggacagccctcctaaactcctgatttactgggcttctacccgggcatccggggttcctaaccgattcattggcagcgggtctgggaccgatttcactctcaccatcagcagcctgcaggctgaagntgtggctagtttatactgtcagcaactattatactttctttcgtctactttcggcggaggaccaaggtgagatacgaaacgactgtggctgcaccatctntctntac

SEQ ID NO: 63249 - DNA, 523 bp, Homo sapiens
  misc_feature: GYAE6OF01EMJEL.31.78.H01.1.454.CMB.1.raw
  modified_base (518)..(518): a, c, t, g, unknown or other
  misc_feature (518)..(518): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccgtcaactgcaagtccagccagacgtgttttattggccccaccaataacaactacttagcttggtaccagcagaaagtaggacagcctcctaaactcctgatttactgggcttctacccgggcatccggggttcctaaccgattcattggcagcgggtctgggaccatttcactctcaccatcagcagcctgcaggctgaagatgtggctagtttatactgtcagcaactattatacttctttcgtctacgtttcggcggacggacctaaggtggagatacaaacgactgtggctgcactatctagtcttcntcccg

SEQ ID NO: 63250 - DNA, 524 bp, Homo sapiens
  misc_feature: GYAE6OF01DC078.31.78.H01.1.454.CMB.1.raw
  modified_base (513)..(513): a, c, t, g, unknown or other
  misc_feature (513)..(513): n is a, c, g, or t
  modified_base (515)..(515): a, c, t, g, unknown or other
  misc_feature (515)..(515): n is a, c, g, or t
  modified_base (520)..(520): a, c, t, g, unknown or other
  misc_feature (520)..(520): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacaactacttagcttggtaccagcagaaagtaggacagcctcctaaactcctgatttactgggcttctacccgggctagtccggggttcctaaccgattcattggcagcgggtctgggaccgtattcactctcaccatcagcagcctgcaggctgaagatgtggctagtttattactgtcagcaactattactacttctttcgtctacgtttcggcggtaggaccaaggtggagtatacgaaacgactggtgctgcacatntntcttntacg

SEQ ID NO: 63251 - DNA, 520 bp, Homo sapiens
  misc_feature: GYAE6OF01ERK7T.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgtttattggccccacaataacaactacttagcttggtaccagcagaaagtaggacagccctcctaaactcctgatttactgggcttcgtacccgggcagtccggggttcctaaccgattcattggcaggcgggtctgggaccatttcactctcacatcagcagcctgcaggctagaagatgtgctagtttatactgtcagcaatattatacttctttcgtctacgtttcggacggtaggaccaaggtggagatacgaaacgtatggtggctagcaccatctgtctctac

SEQ ID NO: 63252 - DNA, 912 bp, Homo sapiens
  misc_feature: GYAE6OF01CFKK9.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagaggccaccatcaactgcaagtccagccagagttgtttattcggccccaacaataacaactacttagcttaggtaccagcaagaaagtaggacacgcctacctaaactcctagtactttacgtcgggtcctttaccgtaaccccggggctaaccggtttccccgggggtttacccctaaaaccccggtattttccgaacgttttcgggacctaagggtcccgggggttactacggggggtaaccccgttaacgtttttcccgaacctttcccgttacccaaaccccttaattacccgaaacggccccgtaaacggtccccgttacggtaccgaacggggtccgttaacgggtaaaaggtaacggtttaggggttacgggtacccgtttaaagggttttttaaccgtttaaaccggtttcggttaacccgtaacggtaaacccttaaaaccgtttaacgtttttaaaccttttaaccgttttttacccgtttttaccccggtttacccgtttaaacccggttttttccccggggggaaccggggtttaaccgggggtaaaccccggttaaaagggggttaccgggtaaaacgggttaaaccgttaaacccggtaaaaaccgggttaaacgttacggggttaaccgggtacccgttacggaaccgtaaacccccgttaagttcccggtttaccgtttaccgtttacccgttaacccg

SEQ ID NO: 63253 - DNA, 559 bp, Homo sapiens
  misc_feature: GYAE6OF01CPRA3.31.78.H01.1.454.CMB.1.raw
  modified_base (313)..(313): a, c, t, g, unknown or other
  misc_feature (313)..(313): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctacctaaactcctgattttacngggtcttcgacccgggcacgttcccggggttccaaccgattcattggcaggcgggtctgggaccgtatttcacgtctcaccatcagcagcctgcagctgaagatgtgctagtttatactgtcaaagcaaactattaactactttctttcgtactacgtttcggacggtacgggaccgtaaggtggaagtataaccgaaacgtaatggtcgggctaggacctacctacgttcctacgtccttctacg

SEQ ID NO: 63254 - DNA, 542 bp, Homo sapiens
  misc_feature: GYAE6OF01DQGP9.31.78.H01.1.454.CMB.1.raw
  modified_base (321)..(321): a, c, t, g, unknown or other
  misc_feature (321)..(321): n is a, c, g, or t
  modified_base (334)..(334): a, c, t, g, unknown or other
  misc_feature (334)..(334): n is a, c, g, or t
  modified_base (353)..(353): a, c, t, g, unknown or other
  misc_feature (353)..(353): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacagttcgtgatgagtccagtttccagactccctggctgtgtctcgtgggcgagaggggccaccatcaactgcaagtccagccagagttgttttattcggccccacaataacaactacttagcttggtaccagctagaaagtaggacagcctacctaaactcctgtattacgnggcttcaccgggntacgtccgggtctaacgtnttcattggcagcgggtctgggaacctatttcactctacacatcagcagcctgcagctagaagatgtgactagtttatactgtacagactaactattaactactttcttcgtctacgtttcggacggtacgggaaccaagggtggagtagtacgtaaacgtatgtggctgacctacatctagtctctacg

SEQ ID NO: 63255 - DNA, 519 bp, Homo sapiens
  misc_feature: GYAE6OF01EGWYG.31.78.H01.1.454.CMB.1.raw
  modified_base (328)..(328): a, c, t, g, unknown or other
  misc_feature (328)..(328): n is a, c, g, or t
  modified_base (512)..(512): a, c, t, g, unknown or other
  misc_feature (512)..(512): n is a, c, g, or t
  modified_base (516)..(516): a, c, t, g, unknown or other
  misc_feature (516)..(516): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctacctaaactcctgatttactgggcttctacccgggnagtccggggttcctaaccgattcattggcagcgggtctggggacctatttcactctcaccatcagcagcctgcagctgaagatgtggctagtttatactgtcagcaactattatacttctttcgtctacgtttcggcggtaggaccgaggtggagatacgaaacgtagtgtgctgccacatctntctntac

SEQ ID NO: 63256 - DNA, 552 bp, Homo sapiens
  misc_feature: GYAE6OF01EGJGI.31.78.H01.1.454.CMB.1.raw
  modified_base (432)..(432): a, c, t, g, unknown or other
  misc_feature (432)..(432): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtagacagcctacctaaactcctgtatttactgggcttcctacccgggcacgtccggggttcctaaccgattcattggcaggcggtctgggaccgtatttcactctcaccatcagcagcctgcaggctagaagatgtgctagtttatacgtntcagacaatattactacttctttcgtctacgtttcggacggtacgggtaccgaaggtgaacgagtaccgaaaacgtaacttggtcggactcgacctaacctattcctgttccttctaccg

SEQ ID NO: 63257 - DNA, 811 bp, Homo sapiens
  misc_feature: GYAE6OF01DA23I.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctcgtgggcgaggacgggccaccatcaactgcaagtccagccagagttgttttatcggccccaacaataacaactacttagcttaggtaccagacaagaaagtaggacagtccctacctaaactcctagtactttacgtgggtccttccgtacccgggctacggtcccggggttacctaaaccggtacttactagtttcggacgtacgggtccggggttcgtacggggtaacccgtagtttccgaacgttaccttaccaacccgtattaccgaacggccgtaaccggtcccgttacggaccgtacgggtaccgttaagggaaacggtaacgttgggttacgggtacctttaaggtttttaacgttaccgttacgtaccgtaacggtaaccttaaacgttaacttttaactttaaccgttttcccgtttttaaccggttacccgtttaaccgggtttttaccggggaaccggggttaaccggggtaacccggtaaaggggttacgggtaaacggttaaacgtaaacccggtaaaaaccggtaacggttacgggttacgggacccgttacggtaaccctaaccgttacgtttaccgtttccggttacctttaccgttaaccccgg

SEQ ID NO: 63258 - DNA, 534 bp, Homo sapiens
  misc_feature: GYAE6OF01EPEGN.31.78.H01.1.454.CMB.1.raw
  modified_base (415)..(415): a, c, t, g, unknown or other
  misc_feature (415)..(415): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagtgttttattggccccacaataacaactacttagcttggtaccagcagaaagtaggacagccctacctaaactcctgatttactgggcttcgtacccgggcagtccggggttcctaaccgattcattggcagtgggtctgggaccgtatttcactctcaccatcagcagcctgcaggctagaagntgtggactagtttatactgtcagacaactattattaccttctttcgtctacgtttcggacggacgggaccaagggtgagatacgaaacgatggtgctgacctacatctcgttctctacg

SEQ ID NO: 63259 - DNA, 524 bp, Homo sapiens
  misc_feature: GYAE6OF01BPIGN.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctctaaactcctgatttactgggcttcgtacccgggcacgtccggggttcctaaccgattcattggcagcgggtctgggaccatttcactctcaccatcagcagcctgcaggctgaagatgtggctagtttatactgtcagcaactattatacttctttcgtctacgtttcggacggtagggaccaaggtggagatacgaaacgtatggtcggctgactacatctgtcttctac

SEQ ID NO: 63260 - DNA, 736 bp, Homo sapiens
  misc_feature: GYAE6OF01EWIG1.31.78.H01.1.454.CMB.1.raw
tcagcagtagacgtcacgaccggtgctcgatttagtgtgagtagtttgggtttgggggagctaacaacaggcaggcaggggcagcaaacgatggtgttgcagacccaggtcttccattttcgtctggttcgctcgtggactcttcttgggtggcctaggggacatcgtgaatgacgcctagtttccgagactccctggctgtgtctctggggcaggagggccaaccatccaagtcgcaagtccaggccagagttgttttagttcggccccacgaattaacaacctttacttacgcttaggtaccagacaggtaaagtacggacaggccctacctaaacgtcctaggtactttacgtgggtcttaccgtaccggggactacggttcccggggttacctaaaccgatttcgattcggcaggtcggttctcgggaccctatttccgacgtcctacgacctactcacgaccacgtacccttgaccaagggtacctacggaaagtacgtcgtaggtccgttaaggttttacttacgtcgtaccagacctaactactttaactaaccgtttccgtttaccggttacgttaaccgttttcgggaccgggttaaggggtaacccggtaaaggggttaggtaaccggtaaccgttaaccggtaaaaccggttaccggttaggttccgggacccgttaggacccgtaaaccgtcgtttaccgtttcggttccttccgtaacccggg

SEQ ID NO: 63261 - DNA, 673 bp, Homo sapiens
  misc_feature: GYAE6OF01AEFM3.31.78.H01.1.454.CMB.1.raw
  modified_base (278)..(278): a, c, t, g, unknown or other
  misc_feature (278)..(278): n is a, c, g, or t
tcagcagtagacgtcacgaccggtgctcgatttagtgtgagtagtttgggtttgggggtaggcgtacaacaggcaggcaggggcgagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgtttattcggccccacaataacaactacttagcttggaaccngcagaaagtggacagccctactaaactcctgatttacgtgggtccttcctacccgggcacgttcccggggttacctaaaccggtattccgattcggcaggtccgggtctcggggacctatttcgaactcctcaacccgtataccgagtccgacgccctagccgacggtctagaaggtactggtcggcgttagtttatacttgtacaagctaaaccgtattacttaacttcgtttaccgtctaaccgttttccgggacgggtaacggggtaccctaaagggttcgggtaaacgtaacttaaccggaaaacccggttaaggttacgggttaccgggtacgtaccggtaccgtaaccggtaccttaaccggtttcgttaccccgtttacgttaacccg

SEQ ID NO: 63262 - DNA, 589 bp, Homo sapiens
  misc_feature: GYAE6OF01B3ZE5.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagacgggccaccatcaactgcaagtccagccagagttgttttattcggccccaacaaataacaactacttagcttggtaccagcaagaaagtaggacagcctacctaaactcctagtactttacgtcggtcttcgtacccgggctacgttccggggttaccctaaccgtacttcagttcggcgacggcgggtctcgggaccgtatttcactctacacctatcagcagcctgcgacggctagaagagtgtgtactagtttactactgtcagactaactattattactttcttcgttactacgtttcggacggacggaaccgtagggtagacgtaacgtaccgtaaacgtaacgtggtcgactacggacctactactacgttcgttctcgtacc

SEQ ID NO: 63263 - DNA, 599 bp, Homo sapiens
  misc_feature: GYAE6OF01D6W5R.31.78.H01.1.454.CMB.1.raw
  modified_base (551)..(551): a, c, t, g, unknown or other
  misc_feature (551)..(551): n is a, c, g, or t
  modified_base (595)..(595): a, c, t, g, unknown or other
  misc_feature (595)..(595): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacaactacttagcttggtaccagcagaaagtaggacagcctacctaaactcctagactttacgtcgggtccttccgtaacccgggctaacgttcccgggggttaccctaaccgtattccaagtttcggacctaggccggggttcgtcggggaacccgtatttccaacttcctccaaccatccaaggtcacgccctgacaggtctagaagatggtggctagttttatacgtgtcagtaccaatattaattacctttctttcgtactacgtttcgggacggtaacggaccaagggttgganaactacgaaacgtaattggtaggctgacctaccattctgtcctntacc

SEQ ID NO: 63264 - DNA, 520 bp, Homo sapiens
  misc_feature: GYAE6OF01DQ3VD.31.78.H01.1.454.CMB.1.raw
  modified_base (517)..(517): a, c, t, g, unknown or other
  misc_feature (517)..(517): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttactgggcttctacccgggcacgtccggggttcctaaccgattcattggcagcgggtctgggaccgtattcactctcaccatcagcagcctgcaggctgaagatgtggctagttttattactgtcagcaactattaatactttctttcgtctacgtttcggacggaggaccaagggtgagatacgaaagactgtgctgcacatctgtctntac

SEQ ID NO: 63265 - DNA, 538 bp, Homo sapiens
  misc_feature: GYAE6OF01AFCMQ.31.78.H01.1.454.CMB.1.raw
  modified_base (317)..(317): a, c, t, g, unknown or other
  misc_feature (317)..(317): n is a, c, g, or t
  modified_base (336)..(336): a, c, t, g, unknown or other
  misc_feature (336)..(336): n is a, c, g, or t
  modified_base (419)..(419): a, c, t, g, unknown or other
  misc_feature (419)..(419): n is a, c, g, or t
  modified_base (511)..(511): a, c, t, g, unknown or other
  misc_feature (511)..(511): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggccccacaataacaactacttagcttggtaccagcaagaaagtaggacagccctacctaaactcctgatttacgngggtcttccgtacccgggntacgtccggggttacctaacgattcattggcagcgggtctgggacctatttcactctcacatcagcagcctgcagctagaagntgtgctagtttatactgtcagacaactattactacttctttacgtctactttcggacggtacggacctaaggtgagatacgaaacgtatggngctgacacctatctcgttcctcgtacg

SEQ ID NO: 63266 - DNA, 533 bp, Homo sapiens
  misc_feature: GYAE6OF01BUZOU.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttactgggcttctacccgggcacgtccggggttcctaaccgattcattggcaggcgggtctggggaccgtatttccactctcaccatcagcagcctgcaggctagaagatgtggctagtttattacgtgtcagcaactattattaccttctttccgtctacgtttcgggacggacggaccaagggtggagatacgaaacgtatggtgctgccacatctgtctctacg

SEQ ID NO: 63267 - DNA, 618 bp, Homo sapiens
  misc_feature: GYAE6OF01B46ZU.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagactccctggctgtgtctcgtgggcgaggacggccacatcaactgcaagtccagccagagttgtttatcgcccacaataacaactactagcttaggaccagacaagaagtaggacagcctacctaactcctagtactttacgcgggtcttaccgacccgggctacggttcccgggttacctaaaccgtattcagtttcggacgtaggtccgggtcgtacgggaccgttactttcactcctacgacctatcagccacgtcctgcgacggtctagaagagtggtgtacttagtttaattaccgtgtacagtactaactactttacttacttcgtttactaccgtacgtttcggacgggtacggaccgtaagggtacggagtacgtaacgaaacgtagttacggtcggtactacgaccgtaccgtacttacgtcgttcgtccttaccg

SEQ ID NO: 63268 - DNA, 548 bp, Homo sapiens
  misc_feature: GYAE6OF01EFUYW.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtctccatttctctgttgctctggatctctggtgcctacggggacatcgtgatgagccagtttccagactccctggctgtgtctctgggcgagagggccaccatcaactgcaagtccagccagagtgtttattggccccacaataacaactacttagcttggtaccagcaagaaagtaggacagcctcctaaactcctagatttactgggcttctacccgggcatccggggttcctaaccgattcattggcagcgggtctgggaccgtatttcactctcaccatcagcagcctgcaggctgaagatgtggctagtttacttactgtcagacaactaattattacttctttcgttctactttcggcgggacgggaaccgtaacggtaggagtaactacgaaaccgaacgtgtcgggctcgctaccactattcgttcttctaccg

SEQ ID NO: 63269 - DNA, 526 bp, Homo sapiens
  misc_feature: GYAE6OF01EOFFL.31.78.H01.1.454.CMB.1.raw
  modified_base (435)..(435): a, c, t, g, unknown or other
  misc_feature (435)..(435): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgtttattggccccacaataacaactacttagcttggtaccagcagaaagtaggacagcctcctaaactcctgatttactgggcttctacccgggcagtccggggttcctaaccgattccattggcagcgggtctgggaccatttcactctcaccatcagcagcctgcaggctgaagatgtggctagtttatactgtcagctaanattattacttctttcgtctacgtttcggcggtagggtaccaagggtgagtatacgaaacgtaatggtgctgacaccatactcgtctctacg

SEQ ID NO: 63270 - DNA, 589 bp, Homo sapiens
  misc_feature: GYAE6OF01EWXPJ.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagtgttttattcggccccacaataacaactacttagcttaggtaccagacagaaagtaggacagcctacctaaactcctagactttacgtgggtccttccgtacccgggctacgttcccggggttacctaaaccggtattcagttcggctaggccgggtcgtcggggacctatttcacttcctcaccatcagccagcctgcgaggctagaagagtgtggtacttaagtttacttacgtgtacagtactaactatttaacttacctttctttacgtacctacgtttcggacggtaagggacctaagggtgagtataacgtaaactagtgtcggctacgaccaacctatctcgtcttctacc

SEQ ID NO: 63271 - DNA, 526 bp, Homo sapiens
  misc_feature: GYAE6OF01B2CV9.31.78.H01.1.454.CMB.1.raw
  modified_base (311)..(311): a, c, t, g, unknown or other
  misc_feature (311)..(311): n is a, c, g, or t
  modified_base (486)..(486): a, c, t, g, unknown or other
  misc_feature (486)..(486): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttacngggcttctacccgggcagtccggggttcctaaccgattcattggcagcgggtctgggacccgtatttcactctcaccatcagcagcctgcaggctagaagatgtggctagtttatactgtcagcaactattatacttctttcgtctacgtttcggcggtagggaccaaggtgganagtacgaaacgtactggtggctgcaccatctgttctctac

SEQ ID NO: 63272 - DNA, 720 bp, Homo sapiens
  misc_feature: GYAE6OF01BLYWU.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagacctccctggctgtgtctcgtgggcgagagggccaccatcaactgcaagtccagccagagttgttttattcggccccaacaataacaactacttagcttggtaccagacaagaaagtaggacagcctactaaactcctagtatttacgtggtccttcgacccgggctacgttcccggggttacctaaaccgtattccgagtttcggactagggtccggggtacgtaggggtacccgtaattttccaaccgttcctacaaccctatccgaagcctaacgcccgttggaccgacggtacgttaggaaagtacgtcggtggtaccttaaggttttaattaccgtgtacgaacgtactaaactactttaacttaccttttaccgtttaccgtaccgttaaccggtttaccgggacgggtaaacgggtaacccgtaaaggggttacggtaaaggtaaaccgttaaccggtaaaaccggtaacgttacgggttccggaccttacggaccccgtaaccgtactttaccgtacgtttacccgttccgttaacccg

SEQ ID NO: 63273 - DNA, 525 bp, Homo sapiens
  misc_feature: GYAE6OF01CRQDX.31.78.H01.1.454.CMB.1.raw
  modified_base (313)..(313): a, c, t, g, unknown or other
  misc_feature (313)..(313): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaaataacaactacttagcttggtaccagcagaaagtaggacagcctacctaaactcctgatttacngggcttctacccgggcagtcccggggttcctaaaccggattcattggcagcgggtctgggaccgattcactctcaccatcagcagcctgcaggctgaagatggtggcagtttattactgtacagcaactatttaatacttctttcgtctacgtttcggacggaggaccaaggtgagatacgaaacgatgtggctgctacatctgtcttctac

SEQ ID NO: 63274 - DNA, 819 bp, Homo sapiens
  misc_feature: GYAE6OF01B61GG.31.78.H01.1.454.CMB.1.raw
tcagcagtagacgtcacgaccggtgctcgatttagtgtgagtagtttgggtttgggggagctacaacaggcaggcaggggcagcaagatggtgttgccagacccaggtcttcatttctctgttgctctggatctctggtgccgtacggggacatcgtgatgagcctagtttccagactccctggctgtgtctcgtgggcgagacggccaccgatcaactgacaacgtccagccagtagttgtttatcggcccaacaataacaactactagcttggtaaccaggacaagaaagtggacagtcctaccgtaaactcctagtactttaccgcgggtacttaccgtacccgggctacggttacccggggttaccaacggtattcgaagtttcggaccaagggtccggggtacgttacgggggaccctaagttttccaacgttcctacgaacccgaattccgaacggtccgtacggcccgtaggaccgtaacgggtccttaaggaaacgtaaggttcgggttagggaccgtttaagggttttaacttaacgttacggtaccgtaacggtaacctaaaaccgttaagttttaaccgtttaacctttacggttttaccggttaccttaaacccgggtttttcggggaacccggggttaacgggggaaaccccgttaagggggttaacgggtaaaccgttaaaccgttaaaccggtaaaaacccggtaacgtttacggggtacccgggtacccgttaaccggaacccggttaacccggttaaaccgtttcccggtttaacggttccccgtttaacggttaaccccgg

SEQ ID NO: 63275 - DNA, 524 bp, Homo sapiens
  misc_feature: GYAE6OF01A2UGC.31.78.H01.1.454.CMB.1.raw
  modified_base (329)..(329): a, c, t, g, unknown or other
  misc_feature (329)..(329): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacaactacttagcttggtaccagcagaaagtaggacagcctcctaaactcctagatttactgggcttctacccgggnactccggggttcctaaccgtattcattggcaggcgggtctgggaccgatttcactcctcaccatcagcagcctgcaggctgaagatggtggctagtttattactgtcagcaactattatacttctttcgtctactttcggcggtacgggacaaggtggagatacgaaacgactgtgctgcaccatctgtctctac

SEQ ID NO: 63276 - DNA, 521 bp, Homo sapiens
  misc_feature: GYAE6OF01CNQ5N.31.78.H01.1.454.CMB.1.raw
  modified_base (311)..(311): a, c, t, g, unknown or other
  misc_feature (311)..(311): n is a, c, g, or t
  modified_base (326)..(326): a, c, t, g, unknown or other
  misc_feature (326)..(326): n is a, c, g, or t
  modified_base (342)..(342): a, c, t, g, unknown or other
  misc_feature (342)..(342): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccaccaataacaactacttagcttggtaccagcagaaagtaggacagcctctaaactcctgatttacnggcttctacccgggnatccgggtcctaacgnttcattggcagcgggtctggggaccgatttcactctcaccatcagcagcctgcaggctgaagatgtgcagtttatactgtcagcaacattatacttctttcgtctactttcggcggagggaccaagggtggaagatacgaaacgaagtgtggctgactacctatctacgtcgttctaac

SEQ ID NO: 63277 - DNA, 541 bp, Homo sapiens
  misc_feature: GYAE6OF01EFLVN.31.78.H01.1.454.CMB.1.raw
  modified_base (366)..(366): a, c, t, g, unknown or other
  misc_feature (366)..(366): n is a, c, g, or t
  modified_base (383)..(383): a, c, t, g, unknown or other
  misc_feature (383)..(383): n is a, c, g, or t
tcagcagtagacgtcacgaccggtgctcgatttagtgtgagtagtttgggtttggggagctacaacaggcaggcaggggcgagcaagatggtgttgcagacccaggtcttcatttctctgttgctctggatctctggtgcctacggggacatcgtgatgagccagtttccagactccctggctgtgtctctggcgagagggccaccatcaactgcaagtccagccagagtgttttatttcggccccaccaataacaactacttagcttggtaccagcagaaagtaggacagcctcctaaactcctgatttactgggcttctacccgggcatccggggttcctaaccgattcattggcagcgggtcngggaccgatttcactcncaccatcagcacgcctgcaggctgaagatggtgctagttttactactgtcagacaactattaactactttctttcgtctacgtttcggcggacgggtaccaaagggtggagaactacgaaaacgtactggtggctgaccaccattctcgttctcgtac

SEQ ID NO: 63278 - DNA, 558 bp, Homo sapiens
  misc_feature: GYAE6OF01BZIW4.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctacctaaactcctagatttactgggtcttctacccgggcacgtcccggggttcctaaccgattcattggcagcgggtctgggaccgatttcactctcaccatcagcagcctgcaggctgaagatgtggtctagtttattactgtacagacaaactatttactaacctttctttcgtctacgttttcgggcgggtaacgggaccgtaaagggtgagtagtaccgaaacggtaatggtggcgtcgacgtaccattctcgttcttctacg

SEQ ID NO: 63279 - DNA, 529 bp, Homo sapiens
  misc_feature: GYAE6OF01C19NJ.31.78.H01.1.454.CMB.1.raw
  modified_base (526)..(526): a, c, t, g, unknown or other
  misc_feature (526)..(526): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactactagcttggtaccagcagaaagtaggacagcctcctaaactcctagatttactgggctttctacccgggctaacgtcccggggttcctaaaccgattcattggcaggcgggtctgggaccgatttcactctcaccatcagcagcctgcaggctagaagatgtggctagtttatactgtcagcaatattatacttctttcgtctactttcggacggtaggaccaaggtggagatacgaaacgtactggtcggctgacacatctgtcttntac

SEQ ID NO: 63280 - DNA, 526 bp, Homo sapiens
  misc_feature: GYAE6OF01CLRZJ.31.78.H01.1.454.CMB.1.raw
  modified_base (311)..(311): a, c, t, g, unknown or other
  misc_feature (311)..(311): n is a, c, g, or t
  modified_base (363)..(363): a, c, t, g, unknown or other
  misc_feature (363)..(363): n is a, c, g, or t
  modified_base (432)..(432): a, c, t, g, unknown or other
  misc_feature (432)..(432): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgtttattcgccccacaataacaactacttagcttggtaccagcagaaagtaggacagcctacctaaactcctgatttacngggcttctacccgggcagtccgggttacctaacgattcatggcagcgggtcngggaccgatttcactctcacatcagcagcctgcaggctagaacgatgtggactagtttatactgtcagnaacattatacttcttcgtctacgtttcggacggaggaccaaggtgaagatacgaaacgaactggtcgactgacctaccatctcgtcttctaacc

SEQ ID NO: 63281 - DNA, 545 bp, Homo sapiens
  misc_feature: GYAE6OF01DPEW5.31.78.H01.1.454.CMB.1.raw
  modified_base (349)..(349): a, c, t, g, unknown or other
  misc_feature (349)..(349): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattggccccacaataacaactacttagcttggtaccagcagaaagtaggacagcctacctaaactcctgatttactgggcttcacccgggcagtcccggggttcctaaccgnttcattggcagcggtcgtgggaccgtattcactctcacatcagcagcctgcagctgaagatgtgctagtttatactgtcagcaacatttaactacttctttcgtctacgtttcggacggtaggaccgtaaggtggaagtagtaccgaaaacgtacgttaggtcggctgacctacctaatccttcgtcttccgtacg

SEQ ID NO: 63282 - DNA, 525 bp, Homo sapiens
  misc_feature: GYAE6OF01DJHCT.31.78.H01.1.454.CMB.1.raw
  modified_base (411)..(411): a, c, t, g, unknown or other
  misc_feature (411)..(411): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcaagaaagtaggacagcctcctaaactcctgatttactgggcttccgtacccgggcacgttccggggttacctaaccgattcattggcagcgggtctgggactattcactctcacatcagcagcctgcagctgaagntgtgctagtttatactgtcagcaatattactacttctttcgtctacgtttcggcggtaggaccgtaaggtgagatacgaaacgtactggtgctgactacctatctcgtctctac

SEQ ID NO: 63283 - DNA, 568 bp, Homo sapiens
  misc_feature: GYAE6OF01A5LMQ.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcaagaaagtaggacagccctacctaaactcctgatttacgtgggtccttcgtaccccgggctacgtcccggggttacctaaccgtattcattggcaggcgggtcgtgggaccgtatttcactctcaccatcagcacgcctgcaggctagaagagtgtggctagtttattactgtcagacaactattaattacctttctttacgtctacgtttcggacggtacgggaaccgaagggtggagtagtacgaaacggtactggtcggctcgacctacctatcttcgttccttcgtacc

SEQ ID NO: 63284 - DNA, 527 bp, Homo sapiens
  misc_feature: GYAE6OF01D4MMK.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacaactactagcttggtaccagcagaaagtaggacagcctcctaaactcctagatttacgtgggtccttcgtacccgggctacgtccggggttcctaaaccgattcagttcggcaggcgggtctgggaccatttcactctcaccatcagcagcctgcaggctgaagatgtggctagtttatactgtcagcaactattatactttctttcgtctacgtttcggacggacggaccaaggtgagatacgaaacgtatgtgctgcacatctgtcttcac

SEQ ID NO: 63285 - DNA, 542 bp, Homo sapiens
  misc_feature: GYAE6OF01BVLV4.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccaccaataacaactacttagcttggtaccagcagaaagtaggacagcctacctaaactcctgtatttactgggcttcgtacccgggctacgtcccggggttcctaaccgattcattggcaggcgggtctgggaccgtatttcactctcaccatcagcagcctgcaggctgaagatgtggctagtttattactgtcagcaactattaatacttctttcgtactactttcgggcggtacgggaccgtaaggtcggagaagtacgaaacgtactggtcggctgcaccatctcgtcttctac

SEQ ID NO: 63286 - DNA, 544 bp, Homo sapiens
  misc_feature: GYAE6OF01DF087.31.78.H01.1.454.CMB.1.raw
  modified_base (541)..(541): a, c, t, g, unknown or other
  misc_feature (541)..(541): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggccccacaataacaactacttagcttggtaccagcaagaaagtaggacagcctacctaaactcctgtatttacgtgggtcttctacccgggctacgtcccggggttccctaaccggtattcagttcggcagcgggtctgggaccgtatttcactctcaccatcagcagcctgcaggctagaagatgtggctagtttattctgtcagcaactattatacttctttcgtctacgtttcggacgggtacgggaccgtaaggtggagtatacgaaacgtatggtggctgctacatctgtcttntac

SEQ ID NO: 63287 - DNA, 516 bp, Homo sapiens
  misc_feature: GYAE6OF01A7PMI.31.78.H01.1.454.CMB.1.raw
  modified_base (508)..(508): a, c, t, g, unknown or other
  misc_feature (508)..(508): n is a, c, g, or t
  modified_base (513)..(513): a, c, t, g, unknown or other
  misc_feature (513)..(513): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccaccaataacaactacttagcttggtaccagcagaaagtaggacagcctcctaaactcctgatttactgggcttctacccgggcactccggggttcctaaccgattcattggcagcgggtctgggaccgatttcactctcaccatcagcagcctgcaggctgaagatgtggctagtttatactgtcagcaacattatacttctttcgtctactttcggcggtagggaccaaggtggagatacgaaacgatgtgctgcacatctntcttntac

SEQ ID NO: 63288 - DNA, 540 bp, Homo sapiens
  misc_feature: GYAE6OF01A5LDX.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgtttattcggccccacaataacaactacttagcttggtaccagcaagaaagtaggacagccctacctaaactcctagatttacgtgggctttacctacccgggcagttcccggggttacctaaccgtattccattcggcaggcgggtctgggaccgtatttcactctcaccatcagcagcctgcagctgaagatgtggctagtttatactgtcagtacaatattatacttcgtttcgtctacgtttcggacggtaggaccgaggtggagatacgaaacgtactggtgctgacctacatctcgtctctac

SEQ ID NO: 63289 - DNA, 569 bp, Homo sapiens
  misc_feature: GYAE6OF01DPEGH.31.78.H01.1.454.CMB.1.raw
  modified_base (437)..(437): a, c, t, g, unknown or other
  misc_feature (437)..(437): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagtgttttattcggccccacaataacaactacttagcttggtaccagcaagaaagtaggacagccctacctaaactcctgtatttacgtgggtcttccgtacccgggctacgttcccggggttacctaaccggactttcagtttggccaggtcgggtcgtcggggaccctatttcactctcaccatcagcagcctgcaggctagaagntggtgctagtttacttacgtgtacagactaactatttatacctttctttcgtcctacgtttcggacggtagggacctaaggtggagtaatacgaaacgtatggtcgctgaccacctatctcgttctctaccg

SEQ ID NO: 63290 - DNA, 523 bp, Homo sapiens
  misc_feature: GYAE6OF01A7F41.31.78.H01.1.454.CMB.1.raw
  modified_base (311)..(311): a, c, t, g, unknown or other
  misc_feature (311)..(311): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttacngggcttctacccgggcagtccgggttctaaccgattcattggcagcgggtctgggaccgatttcactctcaccatcagcagcctgcaggctgaagatgtgctagtttatactgtcagcaactattatacttctttcgtctactttcggacggtagggacctaagggtggaagatacgaaacgtactggtgctgacacctatctgtcttctac

SEQ ID NO: 63291 - DNA, 570 bp, Homo sapiens
  misc_feature: GYAE6OF01BUIZE.31.78.H01.1.454.CMB.1.raw
  modified_base (415)..(415): a, c, t, g, unknown or other
  misc_feature (415)..(415): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggccccacaataacaactacttagcttggtaccagcagaaagtaggacagcctacctaaactccttattactgggtcttcgtacccgggcacgtcccgggttacctaaccgattcattggcagcgggtctgggacctattcactctcaccatcagcagcctgcaggctagaagngtgtggctagtttatactgtcacgctaactatttactactttctttcgtcctacgtttcgggacggacgggacctaagggtggaagtactaacgtaaacggtacgtggtacggtctaggacctaccgtacttcgtagttcctttcacgttccccg

SEQ ID NO: 63292 - DNA, 541 bp, Homo sapiens
  misc_feature: GYAE6OF01AEPWS.31.78.H01.1.454.CMB.1.raw
  modified_base (416)..(416): a, c, t, g, unknown or other
  misc_feature (416)..(416): n is a, c, g, or t
  modified_base (538)..(538): a, c, t, g, unknown or other
  misc_feature (538)..(538): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttacgtgggcttcgtacccgggcacgtccggggttacctaaccgattcattcggcaggcgggtctgggaccgatttcactctcaccatcagcagcctgcaggctagaagntgtgctagtttatacgtgtacacgctaactattactacttctttcgtctacgtttcggacggtacgggaccgtaggtggagacgtacgaaacgtagtggtggctgactacatctcgttcttntac

SEQ ID NO: 63293 - DNA, 532 bp, Homo sapiens
  misc_feature: GYAE6OF01E0TVB.31.78.H01.1.454.CMB.1.raw
  modified_base (331)..(331): a, c, t, g, unknown or other
  misc_feature (331)..(331): n is a, c, g, or t
  modified_base (352)..(352): a, c, t, g, unknown or other
  misc_feature (352)..(352): n is a, c, g, or t
tcagcagtagacgtcacgaccggtgctcgatttagtgtgagtagtttgggtttgggggatctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacaactacttagcttggtaccagcaagaaagtaggacagcctacctaaactcctgatttactgggcttcgtacccgggnagtcccggggttcctaaccgnttcattggcaggcgggtctgggaccgtatttcactctcaccatcagcagcctgcaggctgaagatgtggctagtttatactgtcagacaatattatacttctttcgtctacgtttcggacggtaggaccaagggtgagtactacgaaacgtatggtgctgacctacatctcgttctctac

SEQ ID NO: 63294 - DNA, 557 bp, Homo sapiens
  misc_feature: GYAE6OF01DUC3Y.31.78.H01.1.454.CMB.1.raw
  modified_base (315)..(315): a, c, t, g, unknown or other
  misc_feature (315)..(315): n is a, c, g, or t
  modified_base (348)..(348): a, c, t, g, unknown or other
  misc_feature (348)..(348): n is a, c, g, or t
  modified_base (552)..(552): a, c, t, g, unknown or other
  misc_feature (552)..(552): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagtgttttattcggccccacaaataacaactactagcttggtaccagcagaaagtaggacagcctactaaactcctagatttacgnggctctacccggcagtccggggttcctaaccgnttccagttggcagcgggtctggggaccgtatttcactctcaccatccagcagcctgcgaggctagaagatgtggctagtttatactgtcagtcaatattaatactttctttacgtctacgtttcggacgggtacgggtaccaaagggtcggaagtaataccgaaacgaacttggtggaccttgactaccacttcttgttccttntaccg

SEQ ID NO: 63295 - DNA, 738 bp, Homo sapiens
  misc_feature: GYAE6OF01CE7I8.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagacctccctggctgtgtctcgtgggcgagagggccacatcaactgcaagtccagccagagttgttttatcggccccacaataacaactactagcttggaccagcaagaaagtaggacagcctacctaaactcctagtactttacgtgggtcctttccgtacccgggctaacggttcccggggtttaccctaaaccggtatttccgtaagtttcgggacctaagggtccgggggttacgtacgggggaaccccgtagttttccgaaccttccgtaccaaccctattccgaacggccacggtcccgtggaccgacgggtcctaggaaacgtagttcggtacgggtacttaaggttttaacttaacgttcggttaccgaaggacctaaacgtatttaacttaccttttccgtttcccgttacgttaccgttttcggggaccgggtaacgggtaacccgtaaaggggttcggtaaacggtaacgtaaccgtaaaaccggtaacgttacgggttcgggtacctacggacccgtaacccgtacgttccgttacggttccgttaccgtaaccg

SEQ ID NO: 63296 - DNA, 604 bp, Homo sapiens
  misc_feature: GYAE6OF01DC18F.31.78.H01.1.454.CMB.1.raw
  modified_base (318)..(318): a, c, t, g, unknown or other
  misc_feature (318)..(318): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagttgttttattcggccccacaataacaactacttagcttggtaccagcaagaaagtaggacagcctacctaaactcctagatttacgngggccttcgtaccccgggctaacgttcccgggggttaccctaaaccggtatttcgaatttcggccaggtcggggtctggggaccgtatttcactctcaccatcagcacgcctgcaggctagaagatggtggctagtttacttacgtgtacagacaactattaattactttctttcgtctacgtttcgggacgggtacggaccgtaagggtggaagtactaacgtaaaacggtaacgttggtacggccttggacctaaccctattccgttacgtcctttacgtaccc

SEQ ID NO: 63297 - DNA, 534 bp, Homo sapiens
  misc_feature: GYAE6OF01BELG8.31.78.H01.1.454.CMB.1.raw
  modified_base (314)..(314): a, c, t, g, unknown or other
  misc_feature (314)..(314): n is a, c, g, or t
  modified_base (351)..(351): a, c, t, g, unknown or other
  misc_feature (351)..(351): n is a, c, g, or t
  modified_base (441)..(441): a, c, t, g, unknown or other
  misc_feature (441)..(441): n is a, c, g, or t
  modified_base (523)..(523): a, c, t, g, unknown or other
  misc_feature (523)..(523): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagtgttttattcggccccacaataacaactacttagcttggtaccagcagaaagtaggacagcctacctaaactcctgatttacnggcttcgtacccgggcacgtccggggttcctaaccgnttcattcggcaggcgggtctgggaccgtatttcacttctccaccatcagcagcctgcaggctagaagatgtgctagtttactactgtcanacaatattatactttcttcgtctacgtttcggacggtaggaccaaggtgagactacgaaacgtatagtcgctagccactatntcgtcttctac

SEQ ID NO: 63298 - DNA, 736 bp, Homo sapiens
  misc_feature: GYAE6OF01DLCQY.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggccccaacaataacaactactagcttggtacagcagaagtaggacagcctcctaaactcctgtatttactgggtcttccgtacccgggctacgtcccgggggttaccctaaccggtacttacaacgtttcggccgtaggtccgggtcgttacggggtaacccgtagttttccaaccgttcctaccgaacctacttaccagtccaacggtccctagaccgaagggccttaggaaacgtaacgttgggtacgggtaccttaaggtttttaacttacgttagtttaccgaacggtactaaacttaattttaacttaaacctttttccgttttaccgttaccgttaaccgttttccggggaccggggtaacgggtaacccggtaaacggggttagggtaacggtaaacgttaaccgtaaaaaccggtaacgttagggtccgggtacgtaccggtaaccgtaaccctagtttaccctacggttcccttacgttaacccg

SEQ ID NO: 63299 - DNA, 553 bp, Homo sapiens
  misc_feature: GYAE6OF01C4F5E.31.78.H01.1.454.CMB.1.raw
  modified_base (425)..(425): a, c, t, g, unknown or other
  misc_feature (425)..(425): n is a, c, g, or t
  modified_base (429)..(429): a, c, t, g, unknown or other
  misc_feature (429)..(429): n is a, c, g, or t
  modified_base (455)..(455): a, c, t, g, unknown or other
  misc_feature (455)..(455): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggccccaccaataacaactacttagcttggtaccagcagaaagtaggacagcctacctaaactcctgtatttactgggtcctttcgtacccgggctacgttcccggggttcctaaccggtattcattggcaggcgggtctgggacctattcactctcaccatcagcagcctgcaggctagaagntggnggtctagtttatactgtcagcaactnttatactttctttcgtctacgtttcggacggagggtaccaaggtggagtagtacgaaacgtactggtcggctgcctaacctattcctgtccttcgtac

SEQ ID NO: 63300 - DNA, 524 bp, Homo sapiens
  misc_feature: GYAE6OF01BN04C.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttacgtgggcttcgtacccgggcattcccggggttcctaaccgattcattggcagcgggtctgggacccgatttcactctcacatcagcagcctgcaggctgaagatgtggctagtttatactgtcagcaactattactacttctttcgtctacgtttcggcggtaggaccaaggtgagatacgaaacgtatggtgctgactaccatctgttctctac

SEQ ID NO: 63301 - DNA, 652 bp, Homo sapiens
  misc_feature: GYAE6OF01C6H7R.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagttgtttattcggccccacaataacaactacttagcttaggaccagcagaaagtaggacagccctacctaaactcctagtacttttacgtgggtcctttccgtaacccggggctaacgttcccgggggttaccctaaaccgattccagtttcggcctaggccgggtctggggacctatttcgacttctccaacctatacacgtcacgtcctagcagggctaggaagtagtggtacggacttagtttaataacgtgtacagacctaaatattaacttactttccgtttaccgtacttaccggttttcgggccgggtaagggtacccgtaaagggtcggaaggtaactaccgtaaaaacggtaccgtaggtcggtaccgttcgacctaaccgtaacgttccgttcgttaccttccgttaacccg

SEQ ID NO: 63302 - DNA, 536 bp, Homo sapiens
  misc_feature: GYAE6OF01CQM60.31.78.H01.1.454.CMB.1.raw
  modified_base (314)..(314): a, c, t, g, unknown or other
  misc_feature (314)..(314): n is a, c, g, or t
  modified_base (329)..(329): a, c, t, g, unknown or other
  misc_feature (329)..(329): n is a, c, g, or t
  modified_base (347)..(347): a, c, t, g, unknown or other
  misc_feature (347)..(347): n is a, c, g, or t
  modified_base (416)..(416): a, c, t, g, unknown or other
  misc_feature (416)..(416): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattggccccacaataacaactacttagcttggtaccagcagaaagtaggacagccctacctaaactcctgatttacngggcttcacccgggnacgtccgggttccaacgnttcattggcagcgggtctgggacctatttcactctcaccatcagcagcctgcaggctagaagatgtggntagtttattacgtgtcagacaactattaatactttctttcgtctacgtttcggcggtacggaccgtaaggtaggagtatacgaaaacgtactggtcggactgacacattctcgtctctac

SEQ ID NO: 63303 - DNA, 529 bp, Homo sapiens
  misc_feature: GYAE6OF01EI6Q5.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctactaaactcctgtatttacgtgggcttcgtacccgggcacgtccggggttcctaaccggattcattggcaggcgggtctgggaccgtatttcactctcaccatcagcagcctgcaggctgaagatggtgctagtttatactgtcagcaactattatacttcttcgtctacgtttcggacggtaggaccagggtgagtatacgaaacgtactggtcgctgctacatctgttctctacg

SEQ ID NO: 63304 - DNA, 603 bp, Homo sapiens
  misc_feature: GYAE6OF01AK7FG.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgaggacgggccaccatcaactgcaagtccagccagtagttgttttattcggccccaacaataacaactacttagcttggtaccagcaagaaagtaggacacgccctacctaaactcctgtactttacgtgggtccttccgtacccgggctacgttcccggggttaccctaaccgtattctagttcggcaggtcgggtcgtcgggaccgtatttccacttcctaccacctatcacgcacgcctgcgaggctagaagtagtggtggactagtttactacgtgtcagactaactatttacttacctttcgttccgtacttacgttcgggacggtacgggtaccgaagggtggaacgtacgtacgaaacgtagtggtcgcgtagacctacctatccgtgtccttcgtaccg

SEQ ID NO: 63305 - DNA, 519 bp, Homo sapiens
  misc_feature: GYAE6OF01ACHW3.31.78.H01.1.454.CMB.1.raw
  modified_base (407)..(407): a, c, t, g, unknown or other
  misc_feature (407)..(407): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttactgggcttctacccgggcatccggggttcctaaccgattcattggcagcggtctgggaccgatttcactctcaccatcagcagcctgcaggctgaagntgtggctagtttatactgtcagcaacattatactttcttcgtctacgtttcggcggtagggaccaaggtggagtatcgaaacgtatggtgctgcctacatctcgtcttctac

SEQ ID NO: 63306 - DNA, 531 bp, Homo sapiens
  misc_feature: GYAE6OF01BOVYU.31.78.H01.1.454.CMB.1.raw
  modified_base (327)..(327): a, c, t, g, unknown or other
  misc_feature (327)..(327): n is a, c, g, or t
  modified_base (346)..(346): a, c, t, g, unknown or other
  misc_feature (346)..(346): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacaactacttagcttggtaccagcagaaagtggacagcctcctaaactcctgatttactgggcttcgacccgggnacgtccgggttcctaacgnttcattggcagcggtctgggaccatttcactctcaccatcagcagctgcaggctgaagatgtcgctagtttatactgtacagcaagtattatactttctttcgtctacgtttcggcggtacggaccaagggtcgagtactacgaaacgtatcggtcgactgacctactactctcgttctcgtaac

SEQ ID NO: 63307 - DNA, 517 bp, Homo sapiens
  misc_feature: GYAE6OF01A2MMQ.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttactgggcttcgtacccgggcagtccggggttcctaaccgattcattggcagcgggtctgggacctatttcactctcaccatcagcagcctgcaggctgaagatgtgctagtttatactgtcagcaactattatacttctttcgtctacgtttcggcggtaggaccaaggtgagatacgaaacgatggtcgctgcacatctgtcttctac

SEQ ID NO: 63308 - DNA, 613 bp, Homo sapiens
  misc_feature: GYAE6OF01DEYB0.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggcccaccatcaactgcaagtccagccagagttgtttattcggcccacaataacaactacttagcttggaccagcagaaagtaggacagccctacctaaactcctagtactttacgtgggtcttaccgtaccccgggctacgtcccggggttacctaaccggtattcagttggcgaggtcgggtcgtgggaccgtatttccactcctacaccatcagcagccctgccgaggctaggaacgtagtggtggactagttttactactgtacagactaactattatactttctttcgtactaccgtttcggacgggtacgggaccgtaaagggtcggaagtacgtaaccgtaaaacggtaacgttggttcggaccgtcgacccgtaacctattaccgttcgttaccttccgtaccg

SEQ ID NO: 63309 - DNA, 605 bp, Homo sapiens
  misc_feature: GYAE6OF01CLVL1.31.78.H01.1.454.CMB.1.raw
  modified_base (395)..(395): a, c, t, g, unknown or other
  misc_feature (395)..(395): n is a, c, g, or t
  modified_base (575)..(575): a, c, t, g, unknown or other
  misc_feature (575)..(575): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagactccctggctgtgtctctgggcgagagggccaccatcaactgcaagtccagccagagttgttttattcggaccccaaccaaataacaactacttagcttggtaccagacaagaaagtaggacagccctacctaaactcctagatttactgggtcttcgacccgggctacgtcccggggttacctaacggtattcagttcggcaggcggtctaggggacctntttccactctacaccatccaagccagcccgtgcgacggtctaggaagtatggtaggacttaggttttatacgtcgtacaagtactaaacctatttacttacctttctttaccgtctaacgtttcgggacggtacgggaccaagggtaggataacgtacgaaaacgaacgttggcggtccnggaccctaacacttacgttcgtcttctacc

SEQ ID NO: 63310 - DNA, 572 bp, Homo sapiens
  misc_feature: GYAE6OF01CKDXB.31.78.H01.1.454.CMB.1.raw
  modified_base (417)..(417): a, c, t, g, unknown or other
  misc_feature (417)..(417): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgtttattcggccccacaataacaactacttagcttggtaccagcagaaagtaggacagcctacctaaactcctagatttactgggcttcctacccgggctacgtcccggggttcctaaccgattcagttggcaggcgggtctgggacctatttcactctcacatcacgcagcctgcaggctgaagntgtggctagtttatactgtcagtcaactattactactttccgtttcgtacttaccgttttcgggacggtaacgggaaccgtaagggttcggaagtacgtaccgaaaacgtagtcggtcggctagccctaacctattccgttcgttcttcgtaccg

SEQ ID NO: 63311 - DNA, 536 bp, Homo sapiens
  misc_feature: GYAE6OF01BPRJG.31.78.H01.1.454.CMB.1.raw
  modified_base (524)..(524): a, c, t, g, unknown or other
  misc_feature (524)..(524): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcaagaaagtaggacagcctacctaaactcctgtatttacgtgggcttcgtacccgggcacgtccggggttcctaaccgattcattggcagcgggtctgggaccgatttcactctcaccatcagcagcctgcagctgaagatgtggctagtttatactgtcagctaactattatacttctttcgtctacgtttcggacggtaggaccgaaggtggagtacgtacgaaacgtatggtggctgactaccactntcgttctctacg

SEQ ID NO: 63312 - DNA, 845 bp, Homo sapiens
  misc_feature: GYAE6OF01CWZVA.31.78.H01.1.454.CMB.1.raw
  modified_base (318)..(318): a, c, t, g, unknown or other
  misc_feature (318)..(318): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggccccaacaataacaactacttagcttggtaccagcagaaagtaggacagcctacctaaactcctagatttaccgngggtcctttcgtaccccgggctaacgttaccccgggggtttaccctaaaccggtactttaccgaatttcgggaccgtaagggtcccgggggttaccgttacggggggtaaccccgttaacgttttccgaaccgttccgttaccaacccctaacttcccgaacgggttccaacggtccccgttcggaccgtaacggggtcccttaagggtaaaggtaacggttcgggtttacggggtaccttaaacgggttttttaaactttaacccgtttagggtttacccgtaaacggtaccctaaaaaccgttaactttttaacgttttaacccttttcccgtttttttacccggttacccgttaaccggttttttacccgggggaccggggtaacgggggtaacccgtaaaggggtacgggtaaacggtaacgttaaccgtaaaaaccgggtaacgttacgggttacgggtaccgttacggtacccgtaacccgtaacgttcccgtttacgggtttccctttaccgttaacccg

SEQ ID NO: 63313 - DNA, 515 bp, Homo sapiens
  misc_feature: GYAE6OF01ALOCM.31.78.H01.1.454.CMB.1.raw
  modified_base (311)..(311): a, c, t, g, unknown or other
  misc_feature (311)..(311): n is a, c, g, or t
  modified_base (373)..(373): a, c, t, g, unknown or other
  misc_feature (373)..(373): n is a, c, g, or t
  modified_base (508)..(508): a, c, t, g, unknown or other
  misc_feature (508)..(508): n is a, c, g, or t
  modified_base (510)..(510): a, c, t, g, unknown or other
  misc_feature (510)..(510): n is a, c, g, or t
  modified_base (512)..(512): a, c, t, g, unknown or other
  misc_feature (512)..(512): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtggacagcctcctaaactcctgattttacngggcttctacccgggcagtccggggttcctaaccgattcattggcagcgggtctgggacctntttcactctcaccatcagcagcctgcaggctagaagatgtgctagtttatactgtcagcaactattactacttctttcgtctacgtttcggacgaggtaccaggtggagatacgaaacgatgtgctgcacatctntntntac

SEQ ID NO: 63314 - DNA, 674 bp, Homo sapiens
  misc_feature: GYAE6OF01AB70U.31.78.H01.1.454.CMB.1.raw
tcagcagtagacgtcacgaccggtgctcgatttagtgtgagtagtttgggtttgggggaggctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggccccacaataacaactacttagcttggtaccagcagaaagtaggacagccctacctaaactccctgacttttacgtcgggcttccgtaccccgggctaacgttcccgggggtttaccctaaaccggtaattcctagtttcgggccaggtcggggttccgttggggaacccgtattttccgaacctccttaccgaccctacttccgacgtaccacggcccttggaccgaggtccgttaggaagtaagtcggttacggtcctaagttttaacttacgtcggtcaacggtacctaaacgtatttacgttaactttccttttaccgttcctaaccgttttcgggaccgggtacgggacctaaagggtcggaagtactaccgaaacggtaactggtcggtcctacgcctaaccagttacctcgtccgttctaccg

SEQ ID NO: 63315 - DNA, 579 bp, Homo sapiens
  misc_feature: GYAE6OF01CPM56.31.78.H01.1.454.CMB.1.raw
  modified_base (133)..(133): a, c, t, g, unknown or other
  misc_feature (133)..(133): n is a, c, g, or t
  modified_base (312)..(312): a, c, t, g, unknown or other
  misc_feature (312)..(312): n is a, c, g, or t
  modified_base (330)..(330): a, c, t, g, unknown or other
  misc_feature (330)..(330): n is a, c, g, or t
  modified_base (398)..(398): a, c, t, g, unknown or other
  misc_feature (398)..(398): n is a, c, g, or t
  modified_base (404)..(404): a, c, t, g, unknown or other
  misc_feature (404)..(404): n is a, c, g, or t
  modified_base (450)..(450): a, c, t, g, unknown or other
  misc_feature (450)..(450): n is a, c, g, or t
  modified_base (561)..(561): a, c, t, g, unknown or other
  misc_feature (561)..(561): n is a, c, g, or t
  modified_base (568)..(568): a, c, t, g, unknown or other
  misc_feature (568)..(568): n is a, c, g, or t
  modified_base (574)..(574): a, c, t, g, unknown or other
  misc_feature (574)..(574): n is a, c, g, or t
tcagcagtagacgtcacgaccggtgctcgatttagtgtgagtagtttgggtttggggagctacaacaggcaggcaggggcagcaagatggtgttgcagacccaggtcttcatttctctgttgctctggatctntggtgccgtacggggacatcgtgatgagccagtttccagactcctggctgtgtctgtgggcgagaggccaccatcaactgcaagtccagccagagttgtttatcgcccaacaataacaactacttagcttaggaccagcaagaaagtggacagcctacctaaaactcctgaacttttcngggtctttcgacccgggnacgtccgggttaccaaccgtattccagttggccaggtccggggtctcggggaacctcttttcacttcncaaccntccagccacgtcctggcaggcagaagatcgtggactagtttatacngtacagtcaactaattactaactttcgtttacgtcttaaccgtttcggacggacggtaccgaaaggtcgaaggtataacccgaaagtaactggtacgctaggccaaacgtnttccgtntccttntaccc

SEQ ID NO: 63316 - DNA, 546 bp, Homo sapiens
  misc_feature: GYAE6OF01ALAJ5.31.78.H01.1.454.CMB.1.raw
  modified_base (359)..(359): a, c, t, g, unknown or other
  misc_feature (359)..(359): n is a, c, g, or t
  modified_base (424)..(424): a, c, t, g, unknown or other
  misc_feature (424)..(424): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgaggagggccaccatcaactgacaagtccagccagagttgttttattcggccccacaataacaactacttagcttggtaccagcaagaagtaggacagcctacctaaactcctgtatttacgtgggccttcgtacccgggcacgttccggggttacctaacgnttcattggcaggtcgggtctgggacctattcactctcaccatcagcacgcctgcaggctagaagntggtagctagtttatctgtcagactaactattactacttctttcgtctacgttcggacggaggtaccgaggtgagatacgaaacgtacgtggtcggcgtgactacctatcgtcgtctcgtac

SEQ ID NO: 63317 - DNA, 556 bp, Homo sapiens
  misc_feature: GYAE6OF01EFODP.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagtgttttattcggccccacaataacaactacttagcttggtaccagcaagaaagtaggacagccctacctaaactcctgtatttacgtgggcttccgtacccgggctacgtcccggggttacctaaccgattcagttcggcaggcgggtcgtgggacctatttcactctcaccatcagcagcctgcaggctagaagagtggtggctagtttagtactgtcagacaatattatactttctttcgtactacgtttcgggacggtacggaccgtaaggtggagatacgaaaacgtagtggtcggctgaccactatctcgttccttgtac

SEQ ID NO: 63318 - DNA, 555 bp, Homo sapiens
  misc_feature: GYAE6OF01EQV4K.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcaagaaagtaggacagcctacctaaactcctagatttactgggcttcgtacccgggtcacgttcccggggttacctaaccgattcattggcaggtgggtcgtgggacctatttcacttctcaccatcagcagcctgcaggctgaagagtgtgctagtttattactgtcagacaactattattacttctttcgtctacgtttcggacgggtacgggtaccgaagggtcggagaactacgaaacgtacgtaggtggctgacctaccacttctcgttctcgtac

SEQ ID NO: 63319 - DNA, 682 bp, Homo sapiens
  misc_feature: GYAE6OF01CSM2O.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagactccctggctgtcgtctcgtgggcgaggacgggccaccatcaactgcaagtccagccagagttgttttacttcggaccccaacaataaccaactacttagacttggtaaccagacaagaaagtaggacagtaccctacctaaactcctagtatttacgtgggtacttccgtacccgggctacgttcccggggttacctaaccgtattcagttcggaccgtaggtccgggtcgtacgggaccgtactttcacgtctacaaccgatacacgtcacgcctggaccgaggctagaagtagtggtacggtacttagtttaacttacgtgtacgaacgactaaactacgttttaacttaccgttttccttttacgtaccgttaccggtttacggggtacccgggtaacggggtaaacccgtaaggggttacggaacgtaacgtaaccgaaaacggtacgttgggttacggcttacggacctacccgtaattcccgttagttccttacgtaaccg

SEQ ID NO: 63320 - DNA, 517 bp, Homo sapiens
  misc_feature: GYAE6OF01EJTLV.31.78.H01.1.454.CMB.1.raw
  modified_base (327)..(327): a, c, t, g, unknown or other
  misc_feature (327)..(327): n is a, c, g, or t
  modified_base (346)..(346): a, c, t, g, unknown or other
  misc_feature (346)..(346): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttactgggcttctacccgggnatccggggttcctaaccgnttcattggcagcgggtctgggaccgatttcactctcaccatcagcagcctgcaggctgaagatgtggctagtttatactgtcagcaacattatacttctttcgtctacgtttcggcggagggaccaagggtgagatacgaaacgtactgtggctgcaccatctgtctctac

SEQ ID NO: 63321 - DNA, 549 bp, Homo sapiens
  misc_feature: GYAE6OF01DU5FJ.31.78.H01.1.454.CMB.1.raw
  modified_base (353)..(353): a, c, t, g, unknown or other
  misc_feature (353)..(353): n is a, c, g, or t
  modified_base (419)..(419): a, c, t, g, unknown or other
  misc_feature (419)..(419): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagaggccaccatcaactgcaagtccagccagagtgttttattcggccccacaataacaactacttagcttggtaccagcagaaagtaggacagcctcctaaaactcctagatttacgtgggtcttcgtacccgggcagtccggggttcctaaaccgnttcattggcagcgggtctgggacctatttcactctcaccatcagcagcctgcaggctgaagattgngctagtttattactgtcagcaactattatactttctttcgtctactttcgggcggtacgggacccaaagggttggagaatacgtaaaacgaacgttggtaggctagccgtacctatcttcgtcttcgtac

SEQ ID NO: 63322 - DNA, 534 bp, Homo sapiens
  misc_feature: GYAE6OF01DWDAE.31.78.H01.1.454.CMB.1.raw
  modified_base (352)..(352): a, c, t, g, unknown or other
  misc_feature (352)..(352): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagttccagactccctggctgtgtctctgggcgagagggccaccatcaactgcaagtccagccagagtgttttattcggccccacaataacaactacttagcttggtaccagcaagaaagtaggacagcctacctaaactcctgtatttactgggcttcgtacccgggcacgtccggggttcctaaccgnttcattggcaggcgggtctgggacgtattcactctcaccatcagcagcctgcaggctagaagatgtggctagtttactactgtcagcaactattattacttctttcgtctacgtttcggacggaggaaccgaaggtggagtatacgaaacgtagtgtggctgacctacatctcgtcttctac

SEQ ID NO: 63323 - DNA, 529 bp, Homo sapiens
  misc_feature: GYAE6OF01CPE2V.31.78.H01.1.454.CMB.1.raw
  modified_base (313)..(313): a, c, t, g, unknown or other
  misc_feature (313)..(313): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccaccaataacaactacttagcttggtaccagacagaaagtaggacagcctcctaaactcctgatttacngggcttctacccgggcatccggggttcctaaccgattcattggcagcgggtctgggacattcactctcacatcagcagcctgcaggctgaagatgtggctagtttatactgtcagcaactattaatacttctttcgtctacgtttcggacggtagggaaccaaggtggagtagtacgaaaacgtaatggtggctggctaccatctacgtcttctac

SEQ ID NO: 63324 - DNA, 508 bp, Homo sapiens
  misc_feature: GYAE6OF01CBLBQ.31.78.H01.1.454.CMB.1.raw
  modified_base (214)..(214): a, c, t, g, unknown or other
  misc_feature (214)..(214): n is a, c, g, or t
  modified_base (310)..(310): a, c, t, g, unknown or other
  misc_feature (310)..(310): n is a, c, g, or t
  modified_base (326)..(326): a, c, t, g, unknown or other
  misc_feature (326)..(326): n is a, c, g, or t
  modified_base (499)..(499): a, c, t, g, unknown or other
  misc_feature (499)..(499): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaacngcaagtccagccagagtgtttattggcccacaataacaactacttagcttggtaccagcagaaagtaggacagccctcctaaactcctgatttacngggcttctacccgggnatccgggtcctaaccgattcattggcagcgggtctgggaccgatttcactctcaccatcagcagcctgcaggctgaagatgtggcagtttatactgtcagcaacattatacttctttcgtcactttcgcggaggaccaaggtcggagatcaaacgaactgtggctgcacatcngtcttctac

SEQ ID NO: 63325 - DNA, 555 bp, Homo sapiens
  misc_feature: GYAE6OF01EI655.31.78.H01.1.454.CMB.1.raw
  modified_base (441)..(441): a, c, t, g, unknown or other
  misc_feature (441)..(441): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacaactacttagcttggtaccagcaagaaagtaggacagcctacctaaactcctagatttacgtgggtccttcgtacccgggctacgttcccggggttaccctaaaccggtattcgaagtttcggcagggtcggggtctcgggaccgtatttcactctcaccatcagcagcctgcaggctagaagatgngctagtttatactgtcagcaatattatacttcttcgtctacgtttcggacggacgggaccgaaggtcgaagtactacgaaacgtagtggtgctgacctacatctgtcttctacc

SEQ ID NO: 63326 - DNA, 551 bp, Homo sapiens
  misc_feature: GYAE6OF01EM0L3.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagttgttttattcggccccacaataacaactacttagcttggtaccagcaagaaagtaggacagcctacctaaactcctagtatttactgggcttcgtacccgggcatcgtcggggttacctaaccgtattcagttggcagcgggtctgggacctatttcactctcaccatcagcacgcctgcaggctagaagatggtggctagtttattactgtcagcaactattattacttctttcgtctacgtttcgggcggaggaccgaagggtggaagtagtaccgaaagactggtcggtctcgaccacctattccgtgtcttaccg

SEQ ID NO: 63327 - DNA, 541 bp, Homo sapiens
  misc_feature: GYAE6OF01A9ZUW.31.78.H01.1.454.CMB.1.raw
  modified_base (375)..(375): a, c, t, g, unknown or other
  misc_feature (375)..(375): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcaagaaagtaggacagcctcctaaactcctgatttactgggcttctacccgggcagtcccggggttcctaaccgattcattggcagcgggtctgggacctntttcactctcaccatcagcagcctgcaggctagaagatgtggctagtttattactgtcagtacaatattaattactttcgtttcgtctacgtttcgggcggacggacctaagggtgagtactacgaaacgtacgtggtcggctgaccacctatctcgttcttctac

SEQ ID NO: 63328 - DNA, 538 bp, Homo sapiens
  misc_feature: GYAE6OF01DKEGL.31.78.H01.1.454.CMB.1.raw
  modified_base (348)..(348): a, c, t, g, unknown or other
  misc_feature (348)..(348): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccacatcaactgcaagtccagccagagtgttttattggccccacaataacaactacttagcttggtaccagcagaaagtaggacagcctacctaaactcctgactttactgggcttctacccgggcatccggggttacctaaccgnttcattggcagcggtctgggaccgatttcactctcaccatcacgcagcctgcaggctgaagatgtgctagtttattacgtgtacagcaacatttatacctttctttcgtctaacgttttcggacggtaggaacccgtaaggtggagatacgaaaacgaactggtgactgaccacatcttcgtcttctacg

SEQ ID NO: 63329 - DNA, 534 bp, Homo sapiens
  misc_feature: GYAE6OF01BG7EJ.31.78.H01.1.454.CMB.1.raw
  modified_base (531)..(531): a, c, t, g, unknown or other
  misc_feature (531)..(531): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacaactacttagcttggtaccagcagaaagtaggacagcctcctaaactcctgactttactgggcttctacccgggcagtccggggttcctaaccgattcattggcaggcgggtctgggaccatttcactctcaccatcagcagcctgcaggctagaagatgtggctagtttatactgtcagactaactattatactttctttcgtactacgtttcggcggtacgggaccaagggtggagagtacgaaacgtagtggtggctgacctacatctgtcttntac

SEQ ID NO: 63330 - DNA, 541 bp, Homo sapiens
  misc_feature: GYAE6OF01A4AUM.31.78.H01.1.454.CMB.1.raw
  modified_base (332)..(332): a, c, t, g, unknown or other
  misc_feature (332)..(332): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctacctaaactcctgatttacgtgggtccttctaccccgggnacgttcccggggttacctaaccgattcattggcagcgggtctgggaccattcactctcaccatcagcagcctgcaggctgaagatgtggctagtttatactgtcagctaactattactacttcttcgtctacgtttcggcggtacgggaccaagggtgagtactacgaaaacgtactggtcggactgacctaccatctgttcttctacg

SEQ ID NO: 63331 - DNA, 543 bp, Homo sapiens
  misc_feature: GYAE6OF01CJ0GS.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggccccacaataacaactacttagcttggtaccagcagaaagtaggacagcctcctaaactcctgatttactgggcttcgtacccgggcacgttcccggggttacctaaccgattcattcggcagcgggtctgggaccgtatttcactctcaccatcagcagcctgcaggctagaagatgtggctagtttatactgtacagcaactattacttacttctttcgtctacgtttcggacgggtacggacctagggtggagtactacgaaacgtatggtcggctagcacctatctcgtcttctac

SEQ ID NO: 63332 - DNA, 667 bp, Homo sapiens
  misc_feature: GYAE6OF01DFMWH.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagttccagacctccctggctgtgtctcgtgggcgagagggccacatcaactgacaagtccagaccagagttgtttattcggccccacaataacaactactagcttaggtaccagacaagaaagtacgacacgaccctacctaaactcctagtaactttacgtcgggtcttccgtacccgggctacgttcccggggttaccctaaccgtattcagttcggacaggtcgggtactcggggacccgtatttccgacttcctaccgaaccagtccagtccaacgtcctacgacgaggtactaggaacgtagtcgtaggacttagtttaattaccgtgtaccgaagtacctaaacgtatttacgttaacctttcgtttaccgttaccgttaacggtttccgggaacgggtaaccgggtaacgtaagggtggaacgtaacgtaaccggaaaacgtagtagggtcggacctacggacctaaccctagtacccgttgtccgttccgtaccg

SEQ ID NO: 63333 - DNA, 557 bp, Homo sapiens
  misc_feature: GYAE6OF01CN7VV.31.78.H01.1.454.CMB.1.raw
  modified_base (313)..(313): a, c, t, g, unknown or other
  misc_feature (313)..(313): n is a, c, g, or t
  modified_base (377)..(377): a, c, t, g, unknown or other
  misc_feature (377)..(377): n is a, c, g, or t
  modified_base (412)..(412): a, c, t, g, unknown or other
  misc_feature (412)..(412): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttatcggccccacaataacaactacttagcttggtaccagcagaaaagtaggacagcctacctaaactcctgatttacngggtcttctacccgggcagtccggggttcctaaccgattcattggcagcgggtctgggaccgtnttcactctcacatcagcagcctgcaggctagaagntgtggctagtttatactgtacagcaactattaatactttctttcgtctacgtttcggacgggtagggaccgtaagggtggaagtagtacgaaaacggtacttggtacgggacctagacctaaccattctacgttccttacgtacc

SEQ ID NO: 63334 - DNA, 552 bp, Homo sapiens
  misc_feature: GYAE6OF01BO92E.31.78.H01.1.454.CMB.1.raw
  modified_base (432)..(432): a, c, t, g, unknown or other
  misc_feature (432)..(432): n is a, c, g, or t
  modified_base (548)..(548): a, c, t, g, unknown or other
  misc_feature (548)..(548): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgtttattcggccccacaataacaactacttagcttggtaccagcagaaagtaggacagcctacctaaactcctagtatttacgtgggtccttccgtacccggggctacgttcccggggtttacctaaaccgtattcagttggctaggcgggtcgtgggaccgtatttcactctcaccatcagcagcctgcaggctagaagngtgtgctagtttactatgtcagcaactattacttacttcgtttcgtactacgtttcggcggaggaccgaaggtgagatacgaaacgtactggtgctcgactaccactctcgtcttntacc

SEQ ID NO: 63335 - DNA, 581 bp, Homo sapiens
  misc_feature: GYAE6OF01AXB6D.31.78.H01.1.454.CMB.1.raw
  modified_base (338)..(338): a, c, t, g, unknown or other
  misc_feature (338)..(338): n is a, c, g, or t
  modified_base (354)..(354): a, c, t, g, unknown or other
  misc_feature (354)..(354): n is a, c, g, or t
  modified_base (375)..(375): a, c, t, g, unknown or other
  misc_feature (375)..(375): n is a, c, g, or t
  modified_base (405)..(405): a, c, t, g, unknown or other
  misc_feature (405)..(405): n is a, c, g, or t
tcagcagtagacgtcacgaccggtgctcgatttagtgtgagtagtttgggtttgggggagctacaacaggcaggcaggggcagcaaagatggtgttgcagacccaggtcttcatttcgtctggttcgcgtcgtggactctcttgggtgcctacggggacatcgtgatgacgccagtttccagacctcccgtggctgtgtctcgtggggcgagagggccaacgatcaacgtgcaagtccagccagagtgtttattcggccccacgaataacaacttacttagcttaggtaccagacaggaaagtaggacaggccctcctaaacgtcctagactttacgngggtcttcgaccgggnacggtccgggttacctaacgnttcgattcggcaggtcgggtctgggaaccntttcacgtctcgacctatcagcacgcctgcaggtactagaagtctgtagacgtagtttactacgtgtacagcaatattatacttcttcgtctacgtttacggcggtaggaccgtaggtggatacgtacgaaacgtatggtacggctagacctacgacttcttcgttcttcgtaccg

SEQ ID NO: 63336 - DNA, 515 bp, Homo sapiens
  misc_feature: GYAE6OF01DGNJ5.31.78.H01.1.454.CMB.1.raw
  modified_base (512)..(512): a, c, t, g, unknown or other
  misc_feature (512)..(512): n is a, c, g, or t
tcagcagtagacgtcacgaccggtgctcgatttagtgtgagtagtttgggtttggggagctacaacaggcaggcaggggcagcaagatggtgttgcagacccaggtcttcatttctctgttgctctggatctctggtgcctacggggacatcgtgatgagccagtttccagactccctggctgtgtctctgggcagagggccaccatcaactgcaagtccagccagagtgttttattggccccacaataacaactacttagcttggtaccagcagaaagtaggacagcctcctaaaactcctgatttactggcttcacccgggcagtccggggtcctaaccgattcattggcagcgggtctgggaccatttcactctcaccatcagcagcctgcaggctgaagatgtggctagttttatactgtcagcaatattaatacttctttcgtctacgtttcggcggaggaccgtaaggtggagagtacgaaacgactgtgctgcacatctgtcttntac

SEQ ID NO: 63337 - DNA, 546 bp, Homo sapiens
  misc_feature: GYAE6OF01EH7OY.31.78.H01.1.454.CMB.1.raw
  modified_base (543)..(543): a, c, t, g, unknown or other
  misc_feature (543)..(543): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagttccagactccctggctgtgtctctgggcgagagggccaccatcaactgcaagtccagccagagtgttttattcggccccacaataacaactacttagcttggtaccagcaagaaagtaggacacgccctacctaaactcctagtactttacgtgggtccttccgtaccccgggctacgttcccggggttaccctaaaccgattcattcggcaggcgggtctgggaccgtatttcactctcaccatcagcagcctgcaggctagaagtatggtgctagtttattactgtcagactaatattatactttctttcgtctacgtttcggacggacggacaaggtggagatacgaaacgatggtcgctgctacatctgtctntac

SEQ ID NO: 63338 - DNA, 522 bp, Homo sapiens
  misc_feature: GYAE6OF01A7HMC.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagaggccaccatcaactgcaagtccagccagagtgttttattggccccacaataacaactacttagcttggtaccagcagaaagtaggacagcctcctaaactcctgatttactgggcttcgtaccgggcatccgggttcctaacgattcattggcagcgggtctgggaccgatttcactctcaccatcagcagcctgcagctgaagatgtgctagtttatactgtcagacaactattatactttcttcgtctacgtttcggcggagggacctaaggtcggagactacgaaacgtaatggtgctgcctaaccatctcgtcttctac

SEQ ID NO: 63339 - DNA, 546 bp, Homo sapiens
  misc_feature: GYAE6OF01A85KJ.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctacctaaactcctgactttactgggtcttcgtacccgggcacgttcccggggttacctaaccgattcagttggcaggcgggtctgggaccgtatttcactctcaccatcagcagcctgcaggctgaagatgtggctagtttatactgtcagcaactattactacttctttcgtctacgtttcgggcggtagggacctaagggtcggaagtactacgaaacgtacgtggtcggctgacctacatctgttcctctac

SEQ ID NO: 63340 - DNA, 639 bp, Homo sapiens
  misc_feature: GYAE6OF01C3JRY.31.78.H01.1.454.CMB.1.raw
tcagcagtagacgtcacgaccggtgctcgatttagtgtgagtagtttgggtttgggggagctacaacaggcaggcaggggcagcaaaatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggccccacaataacaactacttagcttggtaccagcaagaaagtaggacagcctacctaaactcctagtacttttacgtgggtaccttccgtacccgggctaacgttcccggggttacctaaccgtattcattggcaggtcgggtctcgggaccgtattcactctcaccatcagcagcctgcaggctagaagtagtgtaggactagtttatacgttgtactagactaactatttattactttctttacgttactaccgtttcgggacgggtacgggaccgtaagggtacggtaagtaacgtaacgaaaaccggtaacgttagggttacgggtcgtacggtaacccgacccgttaacgtttaccgttacggtttacccttccgttaacccgtttccccg

SEQ ID NO: 63341 - DNA, 578 bp, Homo sapiens
  misc_feature: GYAE6OF01B0N1H.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccaccaataacaactacttagcttggtaccagcaagaaagtaggacagcctacctaaactcctagtactttacgtgggtccttccgtaccccgggctaacgttccccgggggtttaccctaaaccggtatttccagtttcggccaggccggggttcgtcggggacccgtatttccactcctaccaccatccagccagccctgcaggctagaagatgtggctagtttatactgtcagcaactattactactttctttcgtactacgtttcgggacggtaggaccgaagggtgagactacgaaacgtatggtgctgaccactatctgtcctcgtac

SEQ ID NO: 63342 - DNA, 540 bp, Homo sapiens
  misc_feature: GYAE6OF01D9IMP.31.78.H01.1.454.CMB.1.raw
  modified_base (330)..(330): a, c, t, g, unknown or other
  misc_feature (330)..(330): n is a, c, g, or t
  modified_base (418)..(418): a, c, t, g, unknown or other
  misc_feature (418)..(418): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacaactacttagcttggtaccagcagaaagtaggacagcctcctaaactcctgatttacgtgggcttcgtacccgggntacgtccggggttacctaaccgattcattggcaggcgggtctgggaccgtatttcactctcaccatcagcagcctgcaggctagaagntgtggctagtttatacgtgtacagacaactattatactttctttcgtctacgtttcggacggaggaccaagggtggagtatacgaaacgtatggtcgctgcctacctatcttgttctcgtac

SEQ ID NO: 63343 - DNA, 520 bp, Homo sapiens
  misc_feature: GYAE6OF01BYK75.31.78.H01.1.454.CMB.1.raw
  modified_base (513)..(513): a, c, t, g, unknown or other
  misc_feature (513)..(513): n is a, c, g, or t
  modified_base (517)..(517): a, c, t, g, unknown or other
  misc_feature (517)..(517): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacaactacttagcttggtaccagcagaaagtaggacagcctcctaaactcctgtatttacgtgggcttcgtacccgggcagtccggggttcctaaccgattcattggcagcgggtctgggaccgatttcactctcaccatcagcagcctgcaggctgaagatgtggctagtttattactgtcagcaactattatacttctttcgtctacgtttcggcggtaggaccaagggtgagatacgaacgactgtgctgcacatctntctntac

SEQ ID NO: 63344 - DNA, 568 bp, Homo sapiens
  misc_feature: GYAE6OF01CJTEX.31.78.H01.1.454.CMB.1.raw
  modified_base (432)..(432): a, c, t, g, unknown or other
  misc_feature (432)..(432): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgacaagtccagccagagttgttttattcggccccacaataacaacttacttagcttggtaccagcaagaaagtaggacacgcctacctaaactcctgtatttacgtggtcttccgtacccgggcacgttcccggggttacctaaccgtattcagttggactaggcgggtctgggaccgtatttcactctcacatcagcacgcctgcaggctagaagngtgtggtctagtttactactgtcagactaactatttactactttcttcgttctacgtttcgggacggtacggaccgtagggtggagtactacgaaacgtagtaggtcgcgtagacctacctatctgttcctctacc

SEQ ID NO: 63345 - DNA, 792 bp, Homo sapiens
  misc_feature: GYAE6OF01C9OI6.31.78.H01.1.454.CMB.1.raw
  modified_base (112)..(112): a, c, t, g, unknown or other
  misc_feature (112)..(112): n is a, c, g, or t
  modified_base (152)..(152): a, c, t, g, unknown or other
  misc_feature (152)..(152): n is a, c, g, or t
tcagcagtagacgtcacgaccggtgctcgatttagtgtgagtagtttgggtttgggggtagggctacaacgaggcaggcagggcaggcagactcggtgttggccaggacccnggtcttcatttctctcgttcgctctggagtctctgggtcnccgtaccgggactctcggtcgagtcgacgcctagtttccacgtcctcccgtggtcgtcgtcgttcgtcgtgggcgagacggcccactactcaactcgacaacgaccacgaccaggtacgtttggttttaacttcggaccctactaattaacctaacttacgtacgacttacggtaacccagtaacgacgaaacgtaggactaggtccttaccgttaaacgtccgtgtaacgtttacggtcggtccgtttaccgacccgggtgttaccgttcccggggttaaccctaaaccggttctttacgacgtttacggaccgtaggtcccggggtcgttacgggaacccgttagtttcccgaaccttccctacgaacctaacgttccgacggtccgtacgtcccgtggaccggtagggacgttacggaaggtacgttggttacggttacgttaacgttttacgtacgttacggtctaaacgtacaaacttaacgttaaacttacctttaccgtttacggttacggttacggtttccgggaccgggtacgggtaaccgtaacgggtggtaccgtacgtaaccgtaaaccgtacggtacggtcggacctcgtacccgtacgtacgttaccttccgtccgtttcctaccc

SEQ ID NO: 63346 - DNA, 586 bp, Homo sapiens
  misc_feature: GYAE6OF01ASO6A.31.78.H01.1.454.CMB.1.raw
  modified_base (435)..(435): a, c, t, g, unknown or other
  misc_feature (435)..(435): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagaggccaccatcaactgacaagtccagccagagttgttttattcggccccaacaataacaactacttagcttggtaccagcagaaagtaggacacgccctacctaaactcctagtactttacgtcgggtcttccgtaacccgggctacgttcccggggttacctaaccgattcgattggcgagccgggtctggggacctattccactctcaccatcagcagcctgcaggctagaacgntggtgactagtttatactgtcagactaactattactactttctttcgttctacgtttcggacgggtacggaaccgtagggtggaacgacgtaaccgaaacgtaacgttggtacggctacgacctaacctattacctgttccttcgtacccg

SEQ ID NO: 63347 - DNA, 511 bp, Homo sapiens
  misc_feature: GYAE6OF01E24JN.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttactgggcttctacccgggcatccggggttcctaaccgattcattggcagcgggtctgggaccgatttcactctcaccatcagcagcctgcaggctgaagatgtggctagtttatactgtcagcaacattatacttctttcgtctactttcggcggaggaccaaggtgagatcaaacgatgtggctgcaccatctgtctcgtac

SEQ ID NO: 63348 - DNA, 825 bp, Homo sapiens
  misc_feature: GYAE6OF01CF51M.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgaggagggccacatcaactgcaagtccagccagagttgttttatcgcccacaataacactactagcttaggtacagcagaaagtaggacagccctacctaaactcctagactttacgtgggtcctttccgtaccccgggtctaacgttcccggtaacggtttacccctaaacccggtatttaccgtaagtttacggggaccgtaagggtcccgggggtttaccgttacggggggtaaaccccgttacgttttttacccgaacccgttttaccccgttaacccgtaaccccttaaacgttacccgaaacggggacccctaaaccgggtccccgtttacggggacccgttaaacgggggtaccccgtttaagggaaaaccggttaggtttacggggttaacggggttacctttaaacgggttttttaaccgttttacggttacggttacccgtaacggtaccctaaaccgttaattttaaccgtttaccctttttcccgtttaccgttaccttaaccgggttttccggggaccgggtaacgggtaacccgtaagggtcggaaagtaaccgtaacgtaaaaccggtacgttggtacggtactccgactacctaacgtcttcgtcctttaccg

SEQ ID NO: 63349 - DNA, 546 bp, Homo sapiens
  misc_feature: GYAE6OF01EG84A.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacaactactagcttggtaccagcagaaagtagacagcctcctaaactcctgatttacgtgggcttccgtacccgggctacgttcccggggttacctaaaccgtattccagtttggcaggcgggtctcgggaccgtatttcactctcaccatcagcagcctgcaggctgaagatgtgctagtttatactgtcagacaactattattacttctttcgtactactttcggacggacggaccaagggtcgagtactacgaaacgatggtcggctgacctacacttctgttcctgtacc

SEQ ID NO: 63350 - DNA, 757 bp, Homo sapiens
  misc_feature: GYAE6OF01CLYO2.31.78.H01.1.454.CMB.1.raw
  modified_base (312)..(312): a, c, t, g, unknown or other
  misc_feature (312)..(312): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagttgtttattcggcccacaataacaactactagcttggtaccagcaagaaagtaggacagcctaccaaactcctgatttacnggtcttcgtaccggctacgttcccgggttacctaaccgtatttcgtaacgttcggacgtaacggtccggggttacgtacgggggtaacccgtaacttttccgacctttacctacccgaaccctattaccgagtccgtaacggcccttaggacccgtaacgggtccttaagggaaacgtaaggttcggtacgggtaccttaaggtttttaacttaacgtcggttaccgaacggtaaccttaaaacttaacttttaacgttaaccttttccgttttacccgtaccgttaaccggttttccggggaccgggtaacggggtaacccgtaaagggtacgggaaagtaaacgtaaccgtaaaaaccgggttattaccggggtacggtacccgttaacggtaccctaaacccggttaattccccggtttgttacccgttacccgttaacccg

SEQ ID NO: 63351 - DNA, 523 bp, Homo sapiens
  misc_feature: GYAE6OF01A2VTC.31.78.H01.1.454.CMB.1.raw
  modified_base (498)..(498): a, c, t, g, unknown or other
  misc_feature (498)..(498): n is a, c, g, or t
  modified_base (518)..(518): a, c, t, g, unknown or other
  misc_feature (518)..(518): n is a, c, g, or t
tcagcagtagacgtcacgaccggtgctcgatttagtgtgagtagtttgggtttgggggagctacaacaggcaggcaggggcagcaagatggtgttgcagacccaggtcttcatttttctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttactgggcttctacccgggcatccggggttcctaaccgattcattggcagcgggtctgggaccgatttcactctcaccatcagcagcctgcaggctgaagatgtggcagtttatactgtcagcaactattatactttctttcgtctacgtttcggcggtagggaccaagggtgagtatacgaaacgactgnggctgcacatctgtcttcgntcccg

SEQ ID NO: 63352 - DNA, 695 bp, Homo sapiens
  misc_feature: GYAE6OF01BHBSF.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgaggagggccacatcaactgcaagtccagccagagttgttttattcggccccacaataacaactacttagcttggtaccagcaagaaagtaggacagccctacctaaactcctagtactttacgtgggtccttccgtaccccgggctaacggttccccgggggttaccctaaacccggtattccgaagtttcgggaccgtagggtcccggggttacgtacgggggaacccgttattttccgaaccttcctaccaaccctagtccagccacgtcccgtcgccgtagggtctaggaaaggtagtcggtaggtacttaaggttttaacttacgttggtaccaaggtacctaaacttatttaacttaccttttaccgtttaccgttaccgttaccggttttccggggacgggtaacgggtaaccgtaaggggtgggaagtaacgttaacgaaaaccgtagtggtcggacgtgaccgtacctacttccttgttccttcgtaccg

SEQ ID NO: 63353 - DNA, 538 bp, Homo sapiens
  misc_feature: GYAE6OF01BPL8G.31.78.H01.1.454.CMB.1.raw
  modified_base (415)..(415): a, c, t, g, unknown or other
  misc_feature (415)..(415): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggccccacaataacaactacttagcttggtaccagcagaaagtaggacagcctcctaaactcctgatttactgggtcttctacccgggcacgtcccggggttcctaaccgattcattggcagcgggtctgggaccgtatttcactctcaccatcagcagcctgcaggctgaagntgtggctagtttatactgtcagcaactattatacttctttcgtcttacgtttcggcggtaggaccgaagggtgagactacgaaacgtacgtggtcggctgacacctatcttgttccttctacc

SEQ ID NO: 63354 - DNA, 557 bp, Homo sapiens
  misc_feature: GYAE6OF01B5RHO.31.78.H01.1.454.CMB.1.raw
  modified_base (419)..(419): a, c, t, g, unknown or other
  misc_feature (419)..(419): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggccccacaataacaactacttagcttggtaccagcagaaagtaggacagcctacctaaactcctgatttacgtgggcttcgtacccgggcagttcccggggttcctaaccgattcattggcagcgggtctgggaccatttcactctcaccatcagcagcctgcaggctagaaacgtntggtgctagtttattactgtcagacaactattaacttacttctttcgtctaccgtttcgggacggtacgggacctaagggtggagacgtacgaaacggtaagtggtggacgtagaccacctatcttcttcttctaccg

SEQ ID NO: 63355 - DNA, 582 bp, Homo sapiens
  misc_feature: GYAE6OF01BRMCP.31.78.H01.1.454.CMB.1.raw
  modified_base (573)..(573): a, c, t, g, unknown or other
  misc_feature (573)..(573): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagtgttttattcggccccacaataacaactacttagcttggaccagcaagaaagtaggacagcctacctaaactcctagtatttacgtgggcctttccgtaccccgggctacgttcccggggttacctaaacccggtatttccaagtttcggcctagggccggggtctcggggaacccgtatttccaactcctcaaccatccagcacgcctgcaggctagaagatggtggctaggttttatactgtacagacaatattacttactttcttcgtctacgtttcggacggtacggaccgtaagggtggagacgtacgaaacgtaatggtcgctgactaccatcctntcttctacg

SEQ ID NO: 63356 - DNA, 532 bp, Homo sapiens
  misc_feature: GYAE6OF01A22LX.31.78.H01.1.454.CMB.1.raw
  modified_base (324)..(324): a, c, t, g, unknown or other
  misc_feature (324)..(324): n is a, c, g, or t
  modified_base (407)..(407): a, c, t, g, unknown or other
  misc_feature (407)..(407): n is a, c, g, or t
  modified_base (435)..(435): a, c, t, g, unknown or other
  misc_feature (435)..(435): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgtttattggccccacaataacaactacttagcttggtaccagcagaaagtggacagcctcctaaactcctgatttactgggcttcacccgggnatccgggtcctaaccgattcattggcaggcggtctgggaccgtatttcactctcaccatcagcacgcctgcaggctagaagtntgtggctagtttatactgtcagcaactnttaatacttctttacgtctacgtttcggcggtaggacctaagggtgaagagtacgaaacgtacgtaggtcggactgacacctattctgttctcgtac

SEQ ID NO: 63357 - DNA, 764 bp, Homo sapiens
  misc_feature: GYAE6OF01BH1UY.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctcgtggtcgccgtacgggacatcgtgatgacgcctacgtttccagtacctcccgtggtctgtcgtctcggtgggacgaggacgggcccaccatacaactcgactaacgtccacgaccgaggtagtttagtttttacgttccggaccccctaactaaactaaacctaacttaacgttacgtcgttacggtaccagacgaaaggtaaagtacggacacgtccctaacctaactccgtagttacttacggcggtccttaccggaccggataccgggttcccgggttacctaaccgtacttcgtagttcggacgtacgggtccgggttcgtacggggtaaccctttatttaccgaccttcctaaccaaccgtataccgacgtaccgaccgtccgtgacgtacggtacgtaaggaaacgtagttcggtacgtacgtttaagttttactacgtgtacaagtacctaattatttacttacctttcgtttacgtacttacggtttaccgggacgggtaacgggtaaccggtagggtacggtaaacgtaacgttaaaccgaaacggttacgttagggtccggtaccttacggaaccctaaccgttacgttaccggtttctttacccgttaccgttaccccg

SEQ ID NO: 63358 - DNA, 553 bp, Homo sapiens
  misc_feature: GYAE6OF01EEAJP.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagttccagactccctggctgtgtctctgggcgaggagggccaccatcaactgcaagtccagccagagttgtttattcggccccacaataacaactacttagcttggtaccagcagaaagtaggacagcctacctaaactcctgatttactgggcttcgacccggcacgtccggggttacctaacgattcattggcaggcggtcgtgggaccgtattcactctacaccatcagcagcctgcagctagaagatgtggctagtttactacgtgtcagacaactattaactactttctttcgtctaccgtttcgggcggaagggtaccgaagggtaggaagtaagtacgaaaacgtagtaggtcggactgacctaccattctcgttctctaccg

SEQ ID NO: 63359 - DNA, 828 bp, Homo sapiens
  misc_feature: GYAE6OF01CLHFD.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagactccctggctgtgtctcgtgggcgagaggccaccatcaactgacaagtccagccagagttgtttattcggccccaacaaataacaactactagcttaggtaccagacaagaaagtaggacacgacctacctaaactcctagtatttacgtcgggtcttccgtacccgggctacgttccggggttacctaaccgtacttcagttcggaccgtaggtccggggtactcggggaacccgtacgttttccgaaccttccctacccgaaccctaacttaccgaacggtacccgtaacggtaccccgttcggacccgtaacggggtacccgttaagggaaaaggtaacggttcgggttacgggtacccgtttaaaggttttttaaacgtttaacccgttcggttaaccaacggtaaccgtaaaacctttaacttttaaacgtttaaccctttttaccggtttttacccgttacccgtttaacccggtttttccgggggtaaccggggtaacgggggtaaaccccgtaaaggggttaacgggaaacggttaaacgttaaccgtaaaaacccgggtaaaccttagggttacgggtaccgttacggtaccccgtaaacccgttacgtttacccgtttacggtttccctttaccgttaaccccg

SEQ ID NO: 63360 - DNA, 644 bp, Homo sapiens
  misc_feature: GYAE6OF01EGGD0.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttatttggccccacaataacaactacttagcttggtaccagcagaaagtggacagcccctaactaactcctagtactttacggtggtccttaccggtacccggactaccggttcccggggttaccctaaaccgtacttccagttcggacgagggccgggttcgtacggggacctatttccacttcctccaaccatacagcacgcctgcgaggtctaggaacgtagttggtggacttaagttttacttacgttgtaccagtacctaacttatttaacttacctttccgtttcgtaccttaccggtttcgggacgggtacgggtaaccgtaaggggtcggaacgtaattaaccgaaaacggtacgttggtcggccgtagaccctaacctattccgttcgttccttcgtaccg

SEQ ID NO: 63361 - DNA, 674 bp, Homo sapiens
  misc_feature: GYAE6OF01ARIQF.31.78.H01.1.454.CMB.1.raw
  modified_base (320)..(320): a, c, t, g, unknown or other
  misc_feature (320)..(320): n is a, c, g, or t
  modified_base (367)..(367): a, c, t, g, unknown or other
  misc_feature (367)..(367): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgaggagggccaccatcaactgcaagtccagccagagttgttttattcggccccacaataacaactacttagcttggtaccagcaagaaagtaggacagcctacctaaactcctagtatttacgngggtccttccgtacccgggctacgtcccggggtttacctaaaccgtnttacctagttcgggactaacgggtcggggttaccgtcgggggtaacccgtattttccgaaccttctaccgaaccctatccgaagccagcccgtggacgacggctagaagtagtcggtaggcttaagtttactacgtgtacacgtactaactagttacttactttcctttacgttaccgtacgttttaccgggacgggtacgggtaaccgtaagggttcggaactacgttaaccgaaaaccggtacttcgggtcggtaccgtacggtaccctaacccgtagttacccttcggttcccttacgtacccg

SEQ ID NO: 63362 - DNA, 555 bp, Homo sapiens
  misc_feature: GYAE6OF01AGEH8.31.78.H01.1.454.CMB.1.raw
  modified_base (440)..(440): a, c, t, g, unknown or other
  misc_feature (440)..(440): n is a, c, g, or t
  modified_base (519)..(519): a, c, t, g, unknown or other
  misc_feature (519)..(519): n is a, c, g, or t
  modified_base (544)..(544): a, c, t, g, unknown or other
  misc_feature (544)..(544): n is a, c, g, or t
  modified_base (546)..(546): a, c, t, g, unknown or other
  misc_feature (546)..(546): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctgggatctctggtgcctacggggacatcgtgatgagccagtttccagactccctggctgtgtctcgtgggcgagagggccaccatcaactgcaagtccagccagagttgttttattcggccccacaataacaactacttagcttggtaccagcaagaaagtaggacacgccctacctaaactcctgtactttacgtgggtccttccgtaccccgggctacgtcccggggttacctaaccgtattcagttcggctaggcgggtcgtcgggaccgtatttcactctcaccatcagcacgcctgcgaggctagaagngtgtggctagtttatactgtcagtacaactattactactttcttccgtactacgttcgggcggtaggaccaagggtganatacgaaacgatggtcgctgctacntntgtctctcg

SEQ ID NO: 63363 - DNA, 554 bp, Homo sapiens
  misc_feature: GYAE6OF01CAVO8.31.78.H01.1.454.CMB.1.raw
  modified_base (400)..(400): a, c, t, g, unknown or other
  misc_feature (400)..(400): n is a, c, g, or t
  modified_base (424)..(424): a, c, t, g, unknown or other
  misc_feature (424)..(424): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacaactacttagcttggtaccagcagaaagtaggacagcctcctaaactcctgatttactgggcttctacccggcatccgggttctaaccgattcattggcagcggtctgggaccgatttcgactctcaccatcagcagcctgcaggntgaagatgtggcagtttatactgnagacaactattactacttctttcgtactacgtttcgggacggtacgggaacctaaggtcgggaagacttaccgaaaacgaccgttagtcgggccttgaccaaccctagttacctcggttcttcgtaaccg

SEQ ID NO: 63364 - DNA, 525 bp, Homo sapiens
  misc_feature: GYAE6OF01CK5OW.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttactgggcttctacccgggcacgtccggggttcctaaccgattcattcggcagcgggtctgggaccgtatttcactctcaccatcagcagcctgcaggctgaagatgtggctagtttatactgtcagcaactattatactttctttcgtctacgtttcggacggagggtaccaagggtggagtatacaaacgtatggtggctgcacatctgtctctac

SEQ ID NO: 63365 - DNA, 526 bp, Homo sapiens
  misc_feature: GYAE6OF01CUUQ9.31.78.H01.1.454.CMB.1.raw
  modified_base (309)..(309): a, c, t, g, unknown or other
  misc_feature (309)..(309): n is a, c, g, or t
  modified_base (370)..(370): a, c, t, g, unknown or other
  misc_feature (370)..(370): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagatgtttattggcccacaataacaactacttagcttggtaccagcagaaagtaggacagcctacctaaactcctgatttacngggcttctacccgggcagtccggggttcctaaccgattcattggcagcgggtctgggaccntttcactctcaccatcagcagcctgcaggctgaagatgtgcagtttatactgtcagcaactattaatactttctttcgtctacgtttcggacggtagggaacctaaggtaggagatacgaaacgtaatggtggctagctacactctgtcgttctac

SEQ ID NO: 63366 - DNA, 578 bp, Homo sapiens
  misc_feature: GYAE6OF01A4OLC.31.78.H01.1.454.CMB.1.raw
  modified_base (450)..(450): a, c, t, g, unknown or other
  misc_feature (450)..(450): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagttgttttattcggccccaacaataacaactacttagcttggtaccagacaagaaagtaggacacgcctacctaaactcctagtactttacgtgggtccttccgtacccgggctacgttcccggggttaccctaaaccggtacttcagttcggcagggtccgggtcgtcggggaccgtatttcgactcctacaccatcagcagcctgcgaggctagaagntggtgctagtttactactgtcagactaactattactactttcgttcgtactacgtttcggacggtaggaccgagggtgagtaatacgaaacgtagtggtcgctagacctactatctcgtcctctaccg

SEQ ID NO: 63367 - DNA, 660 bp, Homo sapiens
  misc_feature: GYAE6OF01DG7ID.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagactccctggctgtgtctcgtgggcgaggagggccaccatcaactgacaagtccagccagagttgttttattcggaccccaacaataacaactacttagcttggtaccagacaagaaagtaggacagaccctacctaaactcctagtactttacgtcgggtcttccgacccgggctacgttcccggggttacctaaccggtattacgagttcggcgacgggtccgggtacgtacggggacccgtatttaccgacttcctaccaacctactacacggcacgccctgaccgacggtccgtaggaaaggtagtggtcggtacttaaggtttacttacgtgtaccgaagtactaaactatttacttacctttcgtttaccgttacttacggtttcgggacgggtaacgggaaccgtaagggtcggaacgtaacgtaaccgaaaacggtacgtggtacggctagaccgacctattccgtcgttccttcgtacc

SEQ ID NO: 63368 - DNA, 788 bp, Homo sapiens
  misc_feature: GYAE6OF01BSOM8.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagaggccaccatcaactgcaagtccagccagagtgtttattcggcccacaataacaactacttagcttggtaccagcagaaagtaggacagcctacctaaactcctgtactttacgtgggtccttccgtacccgggctacgttcccggggttaccctaaaccggtatttaccaagtttcggacgtacggtccggggttacgtcgggggtaacccgtagttttccgaaccgtttcctacccaacccgtaacttccgaacggtaccgaacggtcccttacggaccgtaacggggtccttaagggaaacggtaacgttacgggtcgggtaccgttaaggttttttaacgtttaaccgttcggttaccgtaacggtaacctaaaccgttaacgttttaaccgttaacctttttacccgttttaccgttaccttaaccgtttttaccgggaccggggttaaccggggtaacccgtaaaggggttacgggtaacggtaaacgttaaccgtaaaaaccggtaacgttacgggttacgggtaccgttacggacccgtaaccctaacgtttacccgttacggtttaccctttcgtaacccg

SEQ ID NO: 63369 - DNA, 589 bp, Homo sapiens
  misc_feature: GYAE6OF01CV9UQ.31.78.H01.1.454.CMB.1.raw
  modified_base (315)..(315): a, c, t, g, unknown or other
  misc_feature (315)..(315): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattggccccacaataacaactacttagcttggtaccagcaagaaagtaggacagcctacctaaactcctgtatttacngggtcttctacccgggcacgtccggggttcctaaccgattcagttggcaggtcgggtctgggacctagtttcactctacaacatcagcacgcctgcaggctagaagatgtggactagtttatactgtcagctaactattactactttctttacgtctacgtttcgggacgggtacgggaacctaagggtcggaagtacgtaccgaaaaaccggtacgttagggtacggtacctacggacctaacccgtattaccgttcgttccgttcctaaccg

SEQ ID NO: 63370 - DNA, 555 bp, Homo sapiens
  misc_feature: GYAE6OF01CBJK0.31.78.H01.1.454.CMB.1.raw
  modified_base (546)..(546): a, c, t, g, unknown or other
  misc_feature (546)..(546): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggccccacaataacaactacttagcttggtaccagcagaaagtaggacagcctacctaaactcctgatttacgtgggtccttccgtacccgggctaacgttcccgggggttaccctaaaccggtattccaagtttcggcaggtcggggtctggggaccctatttcgactctacaccatcagcagcctgcaggctagaagatgtggctagtttatactgtcagcaactattatactttctttcgtctacgtttcggacggtaggaccgaaggtggagatacgaaacgtatggtggctgactacatntgtctctac

SEQ ID NO: 63371 - DNA, 531 bp, Homo sapiens
  misc_feature: GYAE6OF01A91PA.31.78.H01.1.454.CMB.1.raw
  modified_base (310)..(310): a, c, t, g, unknown or other
  misc_feature (310)..(310): n is a, c, g, or t
  modified_base (526)..(526): a, c, t, g, unknown or other
  misc_feature (526)..(526): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctctaaactcctgatttacngggcttcgtacccgggcacgttcccggggttacctaaccgtattcattggcaggcgggtctgggacctatttcactctcaccatcagcagcctgcaggctagaagatgtggctagtttattactgtcagctaacatttactacttctttcgtctacgtttcggcggtaggaccgaaggtggagatacgaaacgtactggtgctgcacatctgtctntaccg

SEQ ID NO: 63372 - DNA, 582 bp, Homo sapiens
  misc_feature: GYAE6OF01BBY2J.31.78.H01.1.454.CMB.1.raw
  modified_base (425)..(425): a, c, t, g, unknown or other
  misc_feature (425)..(425): n is a, c, g, or t
  modified_base (436)..(436): a, c, t, g, unknown or other
  misc_feature (436)..(436): n is a, c, g, or t
  modified_base (439)..(439): a, c, t, g, unknown or other
  misc_feature (439)..(439): n is a, c, g, or t
  modified_base (466)..(466): a, c, t, g, unknown or other
  misc_feature (466)..(466): n is a, c, g, or t
  modified_base (577)..(577): a, c, t, g, unknown or other
  misc_feature (577)..(577): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagacctccctggctgtgtctcgtgggcgagacgggccaccatcaactgacaagtccagccagtagttgttttattcggccccaacaataacaactacttagcttggtaccagacaagaaagtaggacacgcctacctaaactcctagtactttacgtgggccttcgtacccgggctacgtcccgggttacctaaccgattcagttcggcaggcggtcgtgggacctattcactcacactatcagcacgcctgcnggctagaagtntgngctagtttactctgtcagtacaaagtnttaactactttcgttacgtcttacgttcgggacggtaggtaaccgtaagggtcgaagtactaacgaaaacggtacttgggtcgctacggactaccgtatcttagtccgttntaccg

SEQ ID NO: 63373 - DNA, 767 bp, Homo sapiens
  misc_feature: GYAE6OF01C69D0.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagttgttttattcggccccacaataaacaactacttagcttcggtaccagacaagaaagtaggacagccctacctaaactcctgtatttacgtgggtctttccgacccgggctacggttcccggggttaccctaaccggtacttcgtaacgtttcgggaccgtaacgggtccggggttccgttacgggggtaacccgttaacttttccgaacccttccgtttacccaaccctacgttacccgaagtcccaacggtccccgttgggacccgtaagggccttaagggaaacgtagttcgggtacggtactttaaggtttttaacttacgtacgttaccaacgtacctaaacgttacttttaacttacctttttccgttttaccgtcttaaccgggttttcggggaaccgggtacgggtaaacccgtaaggggttaggaaccgttaagtaacccggaaaaacggtaccggtttagggtccggtaccgttacgggaccctaacccgtactttcccgttacggtttcctttcccgttaacccg

SEQ ID NO: 63374 - DNA, 549 bp, Homo sapiens
  misc_feature: GYAE6OF01AH24T.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagccctacctaaactcctgatttactgggcttctacccgggcagtcccggggttcctaaccgattcattggcagcgggtctgggacctatttcactctcaccatcagcagcctgcaggctgaagatgtgctagtttatactgtcagacaactatttactactttctttcgtctacgtttcgggacggtacgggtaccaagggtggagtactacgaaaacgtactggtcggacttgacctaaccattccgtgtccttcgtacc

SEQ ID NO: 63375 - DNA, 612 bp, Homo sapiens
  misc_feature: GYAE6OF01EEZXI.31.78.H01.1.454.CMB.1.raw
tcagcagtagacgtcacgaccggtgctcgatttagtgtgagtagtttgggtttgggggagctacaacaggcaggcaggggcagcaagatggtgtttcagacccaggtcttcatttctctgttgctctggatctctggtgcctacggggacatcgtgatgagccagtttccagactccctggctgtgtctctgggcgagagggccaccatcaactgcaagtccagccagagtgtttattggccccacaataacaactacttagcttggtaccagcagaaagtaggacagcctcctaactcctgatttactggcttctacccgggcatcccggggttcctaaccgtactactatgcgacgcggtcgtcggacgtactctactctactaccactacacgacacgtccgtcgcgacggacgtagaagtagtggtaggtacgtagtttacgttacgtacgtacgtacgactaactaacttaacttactttccgtttacgttaccgttacgttacggtacgggtaacgggtaacggtaacgggtacggtacgtaacgtaacgtaaacgtaacgtacggtcggtacgtcgacgtacctacttacgttcgttcgttctac

SEQ ID NO: 63376 - DNA, 552 bp, Homo sapiens
  misc_feature: GYAE6OF01A5EL3.31.78.H01.1.454.CMB.1.raw
  modified_base (424)..(424): a, c, t, g, unknown or other
  misc_feature (424)..(424): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacaactacttagcttggtaccagcagaaagtaggacagcctacctaaactcctgatttacgtgggtccttccgtacccggggcacgttcccggggttacctaaccgattcattggcaggcgggtctgggaccgtatttcactctcaccatcagcagcctgcaggctagaagntggtgctagtttatactgtcagcaactattacttacttctttcgtctacgtttcggacggaggaccaagggtgagtatacgaaacgtatggtcggctaggacctacctatcctcgttccttacgtacc

SEQ ID NO: 63377 - DNA, 557 bp, Homo sapiens
  misc_feature: GYAE6OF01C2MIZ.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtacccagcagaaagtaggacagcctcctaaactcctgtatttactgggcctttctaccccgggctagtcccggggttcctaacccgattcatttggcaggcgggtctgggaccgatttcactctcaccatcagcagcctgcaggctagaagatgtgctagtttatactgtcagcactattattacttctttcgtctacgtttcggtacggacgggaccgaagggtaggagtacgtacgaaaacgtaacgtggtcggacgtgacgtaccctattctacgtccttctaccg

SEQ ID NO: 63378 - DNA, 535 bp, Homo sapiens
  misc_feature: GYAE6OF01C5E17.31.78.H01.1.454.CMB.1.raw
  modified_base (525)..(525): a, c, t, g, unknown or other
  misc_feature (525)..(525): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggccccaccaataacaactacttagcttggtaccagacagaaagtaggacagcctacctaaactctgatttactgggctttcacccgggcacgtccggggtcctaaccgattcattggcagcgggtctgggaccgtattcactctcaccatcagcagcctgcaggctagaagatggtggctagtttattactgtacagacaactattaattactttctttcgtctactttcgggcggtagggacctaagggtgagatacaaaacgtatgtggctgactacattntgtcttctac

SEQ ID NO: 63379 - DNA, 773 bp, Homo sapiens
  misc_feature: GYAE6OF01EZEYN.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagacgggccaccatcaactgcaagtccagccagagtgttttattcggccccacaaataacaactacttagcttggtaccagacaagaaagtaggacagccctacctaaactcctagtactttacgtgggtccttccgtacccggggctacggttacccggggtttaccctaaacccggtatttaccgaagtttcgggacctaacgggtccgggggttaccgttacgggggaacccgttacttttcccaaccgttcctaccaacccattccgaacggtaccaacggcccttaggccgagggtccttaaggaaagtacgttgggtacggtacgttaagttttaacgttacgttacgtacaacgtacctaaactaactttaacttaccttttccgttttaccggttaccttaccggttttaccggggaccggggtaacggggtaacccgtaaaggggttacggtaaacggtaaacgttaaccggtaaaaaccggtaacgttacgggttacgggtaccgttacggtaaccccgtaacccgttaacgtttcccggttacggtttcccttacccgttacccg

SEQ ID NO: 63380 - DNA, 562 bp, Homo sapiens
  misc_feature: GYAE6OF01CVLJQ.31.78.H01.1.454.CMB.1.raw
  modified_base (316)..(316): a, c, t, g, unknown or other
  misc_feature (316)..(316): n is a, c, g, or t
  modified_base (425)..(425): a, c, t, g, unknown or other
  misc_feature (425)..(425): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagtgttttattcggccccacaataacaactacttagcttggtaccagcaagaaagtaggacagcctacctaaactcctgtatttacngggctttcgtacccgggctacgtcccggggttacctaaccgtattcagttggcacggcgggtctgggaccgtatttcactctcaccatcagcagcctgcagctagaagntgtgactagtttatactgtcagctaactattactactttctttacgtctacgtttcggacggacggtaaccaagggtggatacgtacgaaacgtacgtggtcggcttgcctaaccgtattcgttcgtccttcgtacc

SEQ ID NO: 63381 - DNA, 629 bp, Homo sapiens
  misc_feature: GYAE6OF01B2AP2.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagtttccagacctccctggctgtgtctcgtgggcgaggagggccaccatcaactgacaagtccagccagtagttgttttattcggaccccacaaataacaactacttagcttaggtaccagacaagaaagtaggacagccctacctaaactcctagtatttacgtggtcttccgtacccgggctacgttcccggggttacctaaccgtattccgtagttcggactaagggtcgggttacgtacggggacccgtagtttccacttcctacaacctatcaacgtcacgtcctgaccgagctagaagatggtggactagtttattacgtgactagacaacttattacttacctttctttacgtcttaaccggtttcgggacgggtacgggaaccgtaagggtaggaagtaactaacgaaaacggtactggtcggtactcggacctacctatcgttcgttcttctaccg

SEQ ID NO: 63382 - DNA, 541 bp, Homo sapiens
  misc_feature: GYAE6OF01CH4YN.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggccccacaataacaactacttagcttggtaccagcagaaagtaggacagcctacctaaactcctgatttactgggcttcgtacccgggctacgtcccggggttcctaaccgattcattggcagcgggtctgggaccgtattcactctcaccatcagcagcctgcaggctgaagagtgtgctagtttatactgtcagcaactattactacttctttcgtctacgtttcggacggaggtaccgaagggtcgagtactacgaaacggtatggtggcgtgacctacctatctgtccttgtacc

SEQ ID NO: 63383 - DNA, 520 bp, Homo sapiens
  misc_feature: GYAE6OF01ADB1V.31.78.H01.1.454.CMB.1.raw
  modified_base (329)..(329): a, c, t, g, unknown or other
  misc_feature (329)..(329): n is a, c, g, or t
  modified_base (484)..(484): a, c, t, g, unknown or other
  misc_feature (484)..(484): n is a, c, g, or t
  modified_base (513)..(513): a, c, t, g, unknown or other
  misc_feature (513)..(513): n is a, c, g, or t
  modified_base (517)..(517): a, c, t, g, unknown or other
  misc_feature (517)..(517): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactccctgatttactgggcttcgtacccgggnactccggggttcctaaccgattcattggcagcgggtctgggaccgtatttcactctcaccatcagccagcctgcaggctgaagatgtggctagtttatactgtcagacaacattatacttctttcgtctacgtttcggcggaggaccaaggtganagtacaaacgtatggtgctgccacatctntctntac

SEQ ID NO: 63384 - DNA, 561 bp, Homo sapiens
  misc_feature: GYAE6OF01E2S91.31.78.H01.1.454.CMB.1.raw
  modified_base (231)..(231): a, c, t, g, unknown or other
  misc_feature (231)..(231): n is a, c, g, or t
  modified_base (552)..(552): a, c, t, g, unknown or other
  misc_feature (552)..(552): n is a, c, g, or t
  modified_base (556)..(556): a, c, t, g, unknown or other
  misc_feature (556)..(556): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgaggagggccaccatcaactgcaagtccagccagngttgtttattggccccacaataacaactacttagcttgtaccagcagaaagtaggacagcctacctaaactcctgatttacgtgggctttccgtacccgggctacgtccggggttaccctaaccggatttccagtttcggctaggccgggttcgtggggtacccgtatttccactcctcaccatcagcagcctgcaggctgaagatggtgacttagtttatactgtacagacaatattatacttctttcgtactacgtttcggacggtacggaccgtaagggtgtagactacgaaacgtagtggtgctgacctacatcctntctntaccg

SEQ ID NO: 63385 - DNA, 584 bp, Homo sapiens
  misc_feature: GYAE6OF01DPX36.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggccccacaaataacaactacttagcttggtaccagcaagaaagtaggacagcctacctaaaactcctagtatttactgggccttcgtaccccgggcacgttcccggggttacctaaaccggattcattggcaggcgggtctgggaccgtatttcactctcaccatcagcagcctgcaggctagaagagtgtggctagtttattactgtcagacaactattatacttctttcgtctacgtttcggacggtagggtacccgaagggtggaacgtataaccgaaaacggtaacttggtcggacctcggacctaacccaagttccttacggttccttccgtaaccg

SEQ ID NO: 63386 - DNA, 597 bp, Homo sapiens
  misc_feature: GYAE6OF01DGMD9.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggccccaccaataacaactacttagcttggtaccagcaagaaagtaggacagcctacctaaaactcctagtaacttttacgtgggcctttccgtacccgggtctaacgttcccggggtttacctaaaccggattacagtttcggactacggcgggtcgtcggggaacccgtagttttccaacttctccaacctatcagcacgcctgcaggctagaagatgtggctagttttatactgtacagacaactatttactacttcttttacgtactacgttttcggacggtagggaccgtaagggtcggagtactacgaaaacgtactggtcggctgccacgtactctcgttcgttctacg

SEQ ID NO: 63387 - DNA, 620 bp, Homo sapiens
  misc_feature: GYAE6OF01EDITG.31.78.H01.1.454.CMB.1.raw
  modified_base (384)..(384): a, c, t, g, unknown or other
  misc_feature (384)..(384): n is a, c, g, or t
  modified_base (432)..(432): a, c, t, g, unknown or other
  misc_feature (432)..(432): n is a, c, g, or t
  modified_base (582)..(582): a, c, t, g, unknown or other
  misc_feature (582)..(582): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagacctcctggctgtgtctcgtgggcgaggacgggccaccatcaactgacaagtccagccagtagttgttttacttcggacccccaactaataacaacttacttagcttaggtaccagacaagtaaagtcggacacgtccctacctaaacttcctagtactttacgcgggtccttccgtacccgggctacgttcccgggttacctaaccgtnttcgagttcggcgtaggccgggtgtcggggaccctatttccacttccnccaaccatcaacgcacgcctagcaggctaggagagtgtgtacttagtttatacgtgtcaagtactaacgtatttacttacttttccgttaccgttacgtaccgtttcgggacgggtacgacggtaggtcgaagtacgtaacgaaacggtnttacggcgactacgactaccagttctcgttctctaccg

SEQ ID NO: 63388 - DNA, 599 bp, Homo sapiens
  misc_feature: GYAE6OF01DL35M.31.78.H01.1.454.CMB.1.raw
tcagcagtagacgtcacgaccggtgctcgatttagtgtgagtagtttgggttgggggaggctacaacaggcaggcaggggcagcaagatggtgttgcagacccaggtcttcatttctctgttgctctggatctctggtgcctacggggactatcgtgatgagccagtttccagactcctggctgtgtctcgtgggcgaggaggggccaccatcaactgacaagtccagccagtagttgttttattcggccccacaataacaactacttagcttggtaccagcagaaagtaggacacgcctacctaaactccgtagtactttacgtcgggtcttcgtacccgggctacgtccggggttacctaaaccggtatttaccagtttggcgtaggtcgggtcgtacggggaccgtatttccactctacaccatcagcacgcctgacaggctagaagatggtacgactagtttacttactgtacagacaagtattaattacttactttcgttactacgtttcggacggtagggtaaccgaagggtaggagtagtacgaaacggtacgttggtcggactcggacctactactcctgttcttctaccg

SEQ ID NO: 63389 - DNA, 594 bp, Homo sapiens
  misc_feature: GYAE6OF01B22Q5.31.78.H01.1.454.CMB.1.raw
  modified_base (320)..(320): a, c, t, g, unknown or other
  misc_feature (320)..(320): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagactccctggctgtgtctcgtgggcgagagggccaccatcaactgcaagtccagccagagttgttttattcggccccacaataacaactacttagcttggtaccagcaagaaagtaggacagccctacctaaactcctgactttacgngggtcttccgtacccgggctacgttcccgggggttaccctaaaccggtattcgacgttcggccagggtccgggtctacggggacccgtatttccgacttctaccaccatcagcacgcctgcaggctagaagtatggtggactagtttattactgtcagtacaactattatacttctttcgtctacgtttcggacggacggaccgtaagggtggaagtactaaccgaaacgtacgttggtcggctcgacctacctattccttcgtccttcgtacc

SEQ ID NO: 63390 - DNA, 535 bp, Homo sapiens
  misc_feature: GYAE6OF01BMAE7.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagaggccaccatcaactgcaagtccagccagagtgtttattggccccacaataacaactacttagcttggtaccagcagaaagtaggacagcctacctaaactcctgtatttactgggcttctacccgggcactccggggttcctaaccgattcattggcagcgggtctgggaccgtatttcactctcaccatcagcagcctgcaggctagaagatgtggctagtttatacgtgtcagtcaactattatacttctttacgtctacgtttcgggcggagggacctaaggtggagtactacgaaacgtataggtgctgacctacctagtctgtcttctacg

SEQ ID NO: 63391 - DNA, 523 bp, Homo sapiens
  misc_feature: GYAE6OF01DZHIN.31.78.H01.1.454.CMB.1.raw
  modified_base (312)..(312): a, c, t, g, unknown or other
  misc_feature (312)..(312): n is a, c, g, or t
  modified_base (326)..(326): a, c, t, g, unknown or other
  misc_feature (326)..(326): n is a, c, g, or t
  modified_base (517)..(517): a, c, t, g, unknown or other
  misc_feature (517)..(517): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgtttattcggccccacaataacaactacttagcttggtaccagcaagaaagtaggacagcctactaaactcctgatttacnggcttcacccgggnatccgggttctaaccgattcattggcagcggtctgggaccatttcactctcacatcagcagcctgcaggctgaagatgtggctagtttatactgtcagcaaacattataacttctttcgtctactttcggacggaggtaccaaggttggacgaataccgaaaacgaactgtcggcctagccaccatctctnttcacg

SEQ ID NO: 63392 - DNA, 542 bp, Homo sapiens
  misc_feature: GYAE6OF01DAB7N.31.78.H01.1.454.CMB.1.raw
  modified_base (313)..(313): a, c, t, g, unknown or other
  misc_feature (313)..(313): n is a, c, g, or t
  modified_base (347)..(347): a, c, t, g, unknown or other
  misc_feature (347)..(347): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagtgttttattggccccacaataacaactacttagcttggtaccagcaagaaagtaggacagcctcctaaactcctgatttacngggcttcacccgggcagtccgggttcctaaccgnttcattggcagcgggtctgggacctattcactctcaccatcagcagcctgcaggctagaagatgtggctagtttatactgtcagcaactattaattactttctttacgtctacgtttcgggacggtagggaacctaagggtggaatagtaacgaaacgattggtaggcttaggacctaccatcctgttcttctac

SEQ ID NO: 63393 - DNA, 513 bp, Homo sapiens
  misc_feature: GYAE6OF01EY1JY.31.78.H01.1.454.CMB.1.raw
  modified_base (328)..(328): a, c, t, g, unknown or other
  misc_feature (328)..(328): n is a, c, g, or t
  modified_base (428)..(428): a, c, t, g, unknown or other
  misc_feature (428)..(428): n is a, c, g, or t
  modified_base (432)..(432): a, c, t, g, unknown or other
  misc_feature (432)..(432): n is a, c, g, or t
  modified_base (502)..(502): a, c, t, g, unknown or other
  misc_feature (502)..(502): n is a, c, g, or t
  modified_base (506)..(506): a, c, t, g, unknown or other
  misc_feature (506)..(506): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaaactcctgatttactgggcttctacccgggnagtccggggttctaacgattcattggcagcgggtctgggaccattcactctcaccatcagcagcctgcaggctgaagatgtggctagtttatactgtcancaanattatacttctttctactactttcggacggagggaccaagggtgagatacgaaacgatgtgctgcctacntctntctctac

SEQ ID NO: 63394 - DNA, 542 bp, Homo sapiens
  misc_feature: GYAE6OF01D5D6J.31.78.H01.1.454.CMB.1.raw
  modified_base (352)..(352): a, c, t, g, unknown or other
  misc_feature (352)..(352): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcaagaaagtaggacagcctacctaaactcctgatttacgtgggcttcgtacccgggcagtcccgggttacctaaccgnttcattggcagcgggtctgggaccatttcactctcaccatcagcagcctgcaggctagaagatgtgctagtttattactgtacagcaaactattaatacctttctttccgtctaccgtttcgggacggtagggaccaaagggtggaataagtacgaaaacgtagtgtggctgaccacatctgtcttctac

SEQ ID NO: 63395 - DNA, 531 bp, Homo sapiens
  misc_feature: GYAE6OF01EHINL.31.78.H01.1.454.CMB.1.raw
  modified_base (350)..(350): a, c, t, g, unknown or other
  misc_feature (350)..(350): n is a, c, g, or t
  modified_base (524)..(524): a, c, t, g, unknown or other
  misc_feature (524)..(524): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctacctaaactcctgatttactgggcttcgtacccgggcacgtccggggttacctaacgnttcattcggcagcgggtctgggacctatttcactctcaccatcagcagcctgcaggctagaagatgtggctagtttattacgtgtcagacaactattatacttctttcgtctactttcggacggtacgggaccaaggtggagatacgaaacgtatggtggctgactaccatctntctctac

SEQ ID NO: 63396 - DNA, 529 bp, Homo sapiens
  misc_feature: GYAE6OF01B5RBA.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctacctaaactcctgatttactgggcttctacccgggcagtccggggttcctaaccgattcattggcagcgggtctgggaccgatttcactctcaccatcagcagcctgcaggctagaagatgtggctagtttatactgtcagcaactattatactttctttcgtctacgtttcggcggtacgggaccaagggtggagatacgaaacgatggtgctgacaccatacctgttcttctacg

SEQ ID NO: 63397 - DNA, 554 bp, Homo sapiens
  misc_feature: GYAE6OF01BLROG.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgtttattcggccccacaataacaactacttagcttggtaccagcagaaagtaggacagcctacctaaactcctagtatttacgtgggcttccgtacccgggctacgttcccgggggttacctaaaccggattccagttcggcaggcgggtctggggacctatttcactctcaccatcagcagcctgcaggctagaagtatggtgctaagtttatactgtcagacaactattactactttcttcgtactacgtttcggacggtacggacgtagggtgagatacgaaacgtatggtgctgacctacacttctcgtccttctaccg

SEQ ID NO: 63398 - DNA, 566 bp, Homo sapiens
  misc_feature: GYAE6OF01CZ01E.31.78.H01.1.454.CMB.1.raw
  modified_base (410)..(410): a, c, t, g, unknown or other
  misc_feature (410)..(410): n is a, c, g, or t
  modified_base (512)..(512): a, c, t, g, unknown or other
  misc_feature (512)..(512): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagactccctggctgtgtctctgggcgagaggccaccatcaactgcaagtcagccagtagttgtttattcgccctacaataacaactacttagcttgtaccagacaagaaagtaggacagcctacctaaactcctgatttacgtggtcttcgtacccggctacgtccggggttacctaacgtattcgattggcagtcggtctgggacctattcactctcaccatcagcagcctgcaggcngaaggactggtgacttagtttattactgtacagactaaactatttaatacctttcttttcgtactacgtttcggacggtacggtaactaacgggtgaagtanacgtaaaacgacgttggacggctaggacctacctaatcttacgtcttcgtaacc

SEQ ID NO: 63399 - DNA, 591 bp, Homo sapiens
  misc_feature: GYAE6OF01A5DWP.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagttgttttattcggccccacaataacaactacttagcttggtaccagacaagaaagtaggacagccctacctaaactcctagtactttacgtgggtccttaccgtaccccggggctacggttccccggggttaccctaaaccggtatttccagtttcggcagggtcggggttctggggaacccgtatttccaccttctccaacctatcagccacgccctgcaggctagaagatggtggactagtttacttactgtcagacaactattatactttctttcgtctacgtttcggacggacggaccgaagggtggagtatacgaaacgtaagtggtggctagacctactactctcgtcttctac

SEQ ID NO: 63400 - DNA, 605 bp, Homo sapiens
  misc_feature: GYAE6OF01D4C75.31.78.H01.1.454.CMB.1.raw
tcagcagtagacgtcacgaccggtgctcgatttagtgtgagtagtttgggtttgggggtaggctacaacaggcaggcagggcagcaagatggtgttgcagacccaggtcttcatttctctgttgctctggatcctctggtgccgtacggggacatcgtgtatgagcctagtttccagactccctggctgtgtctctgggcgagagggccaccgatcaactgacaagtccgagccagacgttgttttattcggccccacaataacactacttagcttaggtaccagcaagaaagtaggacagtcccgtcctaaactcctgtactttacgtgggcttcgtacccgggctacgtcccggggttacctaaaccgtattcgaagtttggacgtaggacggttctgggaccgtatttccactctcgaccatcaagcacgcctgacacggactagaaatatagtgtactagtttaactactagtcagtcaacgtattaacgtctttacgttaccgtacgtacgttttcgggaggtacggtaaccgtaagtgggtaacgagtacgtaaaacgtactggtaggacttgactacctattacctgttcctcgtacg

SEQ ID NO: 63401 - DNA, 698 bp, Homo sapiens
  misc_feature: GYAE6OF01CNFZO.31.78.H01.1.454.CMB.1.raw
  modified_base (479)..(479): a, c, t, g, unknown or other
  misc_feature (479)..(479): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagactccctggctgtgtctcgtgggcgagacgggccacatcaactgcaagtccagccagtagttgttttacttcggaccccaacaaataacaacttacttagcttaggtaccagacaagaaagtaggacacgaccctacctaaactcctagtactttacgtcgggtcctttccgacccgggctaccggttcccggggttaccctaaaccggtattacacgttggaccaggtcggggttcgtcggggtaaccgtattttccgaccttcctaccaaccatccgagccagccctggccgagggctagaagngtcggtggactaagttttactacgtgtacaagtacaaaccttattaattacctttcctttcgtaccttacggtttcgggaccgggtaacgggtaaccgaaaggggttcgggaaacgtaacgtaaacccgtaaaaaccgggtaaccgttgggtacggggttaccctcggtaacccctaacccgtaattccccgtttggttacccgtttaccttaaccccg

SEQ ID NO: 63402 - DNA, 773 bp, Homo sapiens
  misc_feature: GYAE6OF01D88UX.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagttgttttattcggccccaacaataacaactacttagcttggtaccagacaagaaagtagacagcctacctaaactcctagtactttacgtgggtccttccgtacccgggtctacgttccccggggttaccctaaaccggtatttccgaagtttcggaccgtacgggtccggggttccgttacgggggaacccgttattttccaaccgttcctaccaaccctaacttccgaacggtacctaacggtccccttaggaccgtacgggtaccttaggaaaacggtagttgggttacgggtacctttaaggtttttaactttaaccgttggttaccaacggtaacctaaacttaattttaacttaccttttaccgttttaccggttacctttaaccggttttccggggaccggggtaaacgggtaacccgtaaaggggtcgggtaaacgtaacgttaaccggtaaaaaccggtaccgttacgggttcgggaccttacggaacccgtaacccgttacgttccgttacggtttcccttaccgtaacccg

SEQ ID NO: 63403 - DNA, 623 bp, Homo sapiens
  misc_feature: GYAE6OF01D2QJT.31.78.H01.1.454.CMB.1.raw
  modified_base (438)..(438): a, c, t, g, unknown or other
  misc_feature (438)..(438): n is a, c, g, or t
  modified_base (452)..(452): a, c, t, g, unknown or other
  misc_feature (452)..(452): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgaggacgggccaccatcaactgacaagtccaagccagtagttgttttattcggaccccaacaataacaactacttagcttggtaccagacaagaaagtaggacagccctacctaaactcctagtactttacgtgggtccttccgtacccgggctacgttcccggggttacctaaccgtattcgagttcggcacggtcgggtcgtacgggacctatttcgactctaccaccatcagcacgccngcgaggctagaagntggtcggtctagtttatacgtgtacagactaatattacttaacctttctttaccgttaccgttaccgtttcgggaccgggtacgggtaacccgtaaagggtggaacgtaacgtaaccgaaaacgtacgttaggtcggacctgaccctaacctacttcttcgttctctaccg

SEQ ID NO: 63404 - DNA, 595 bp, Homo sapiens
  misc_feature: GYAE6OF01DF3FG.31.78.H01.1.454.CMB.1.raw
  modified_base (333)..(333): a, c, t, g, unknown or other
  misc_feature (333)..(333): n is a, c, g, or t
  modified_base (357)..(357): a, c, t, g, unknown or other
  misc_feature (357)..(357): n is a, c, g, or t
  modified_base (431)..(431): a, c, t, g, unknown or other
  misc_feature (431)..(431): n is a, c, g, or t
tcagcagtagacgtcacgaccggtgctcgatttagtgtgagtagtttgggtttggggagctacaacaggcaggcaggggcagcaagatggtgttgcagacccaggtcttcatttctctgttgctctggatctctggtgcctacggggacatcgtgatgagccagtttccagacctccctggctgtgtctcgtgggcgagagggccaccatcaactgcaagtccagccagagttgttttattcggcccacaataacactacttagcttggtaccagcaagaagtaggacagcctacctaaactcctagtattacgtggtccttccgacccgggntacgttccgggttaccaaccggtnttcagttcggcgtaggcgggtctgggacctagtttcactctaccacactcagtcacgtcctgcaggctagaagntggtgactagttttactagtcgtactagactaatattacttaactttcgtttacgtacctacgtttccggacggtacgggaactaagggttggacgtaacgtaacgaaaacgtacgttgggtcgtccgtacgaccgtactacgttcttcgttccttcgtacccg

SEQ ID NO: 63405 - DNA, 609 bp, Homo sapiens
  misc_feature: GYAE6OF01BNW8V.31.78.H01.1.454.CMB.1.raw
  modified_base (605)..(605): a, c, t, g, unknown or other
  misc_feature (605)..(605): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgaggagggccaccatcaactgcaagtccagccagagttgtttattcggccccacaataacaactacttagcttggtaccagcaagaaagtaggacagccctacctaaactcctagtatttacgtcgggtcttccgtacccgggctacgttcccgggggttaccctaaaccggtattaccagttcggccagggtccggggtcgtcggggacccgtatttccgaccttcctccaaccatccagccacgcctgcgacggctagaagtagtggtggtactagtttacttactgtacacgactaactatttacttactttccttcgttacttacgtttcgggacgggtacgggaccgtaagggtggagtaatacgaaacgtacgtggtcggctgacctactactactcgtccttntacc

SEQ ID NO: 63406 - DNA, 568 bp, Homo sapiens
  misc_feature: GYAE6OF01EH5HO.31.78.H01.1.454.CMB.1.raw
  modified_base (425)..(425): a, c, t, g, unknown or other
  misc_feature (425)..(425): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattggccccacaataacaactacttagcttggtaccagcagaaagtaggacagcctactaaactcctgatttactgggtcttccgtacccgggctacgttcccggggttaccctaaccggactttcaagttggcaggcgggtcgtgggaccgtattcactctcacatcagcagcctgcaggctgaagntggtgctagtttatactgtcagacaatattattaacctttctttccgttctacgtttcgggacggacgggaccgtaagggtggaagtaatacgaaaacggtattggtcggactagtaccgtaccattcttcgtcttcgtaccg

SEQ ID NO: 63407 - DNA, 529 bp, Homo sapiens
  misc_feature: GYAE6OF01CC837.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctacctaaactcctgatttactgggcttctacccgggcatccggggttcctaaccgattcattggcagcgggtctgggaccgattcactctcaccatcagcagcctgcaggctgaagatgtggctagtttatactgtcagactaacattaactactttctttcgtctaccttttcggcggtagggtaccaagggtgagataccgaaacgtactgtggctgcgacatctgttccttgtac

SEQ ID NO: 63408 - DNA, 553 bp, Homo sapiens
  misc_feature: GYAE6OF01DI07W.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcaagaaagtaggacagcctactaaactcctgatttactgggccttcgtacccgggctacgtcccggggttccctaaaccggattccattcggcaggcgggtctggggacctatttcactctcacatcagcagcctgcaggctgagagtgtgctagtttatacgtgtcagctaactatttaactactttcgtttcgtctacgtttcgggacggtacgggtaccaagggtggagtagtacgaaaacgtagtggtcggctggactaccatctcgtcttctac

SEQ ID NO: 63409 - DNA, 763 bp, Homo sapiens
  misc_feature: GYAE6OF01CFAU4.31.78.H01.1.454.CMB.1.raw
tcagcagtagacgtcacgaccggtgctcgatttagtgtgagtagtttgggttgggggagctacaacaggcaggcaggggcagcaagatggtgttgcagacccaggtcttcagtttctctgttgctctggatctctggtgccgtacggggacatcgtgatgacgcctagtttccagacctccctggctgtcgtctcgtgggcagcgggccacatcaactgacaacgtccagccaggtacgttgttttagtcggaccccaacctaaattaaccaacttacttacgtcttaggtaacctagacaagaaagtacggaacaacggacccttaacctaaaccttccgttagtaacttttacgcgggtacctttaccgacccgggctacggttccccggggttacctaaacggtacttcgtaacgttcggacctaagggtccggggttacgtacgggggacccttagtttcccgaacgttccgtacctaacctacttaccgacggaccgtacggtccctacggacgtaacggtccgttaaggaaagtacgtaggtacggtacttaaggttttaacttaccgtacggtacctaacggtacctaaaccgttaattttaaccttaaccgttttaccgtttaccgttacttaaccgtttcggggaccgggtacggtaacccgtaagggttacggaacgtaacgtaaccgtaaacggtagtacgggtcggaccgtacgaccgtaaccgtagttccgtacgttccgttcgtaaccg

SEQ ID NO: 63410 - DNA, 547 bp, Homo sapiens
  misc_feature: GYAE6OF01CEB6J.31.78.H01.1.454.CMB.1.raw
  modified_base (544)..(544): a, c, t, g, unknown or other
  misc_feature (544)..(544): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggcccaccatcaactgcaagtccagccagagttgttttattcggccccaacaataacaactacttagcttggtaccagcaagaaagtaggacagccctacctaaactcctagatttactgggccttcgtacccgggcacgtcccggggttcctaaccgattcattggcaggcgggtctgggaccgtatttcactctcacctatcagcacgcctgcaggctagaagatgtgctagtttatactgtcagctaactatttactactttcttcgtactacgtttcggcggtaggacctaagggtggaagtatacgaaacgtaatggtcgctgacctacatctgtcttntac

SEQ ID NO: 63411 - DNA, 540 bp, Homo sapiens
  misc_feature: GYAE6OF01CT0V1.31.78.H01.1.454.CMB.1.raw
  modified_base (419)..(419): a, c, t, g, unknown or other
  misc_feature (419)..(419): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctacctaaactcctgatttactgggccttctacccgggcacgttcccggggttaccctaaccggattcatttggcaggcgggtctgggaccgtattcactctcaccatcagcagcctgcaggctgaagntgtggctagttttatactgtcagcaactatttactactttctttcgtctactttcgggcggtagggacctaagggtggagatacgaaacgactggtggctgactacctatctgtcttctac

SEQ ID NO: 63412 - DNA, 526 bp, Homo sapiens
  misc_feature: GYAE6OF01A0YYJ.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacaactacttagcttggtaccagcagaaagtaggacagcctcctaaactcctgatttactgggcttctacccgggcacgtccggggttcctaaccgtattcattggcagcgggtctgggaccgatttcactctcaccatcagcagcctgcaggctagaagatgtggctagtttatactgtcagcaactatttaatacttctttcgtctacgtttcggacggacggaccaaggtgagatacgaaacgtagtggtgctgacaccatctgtctgtac

SEQ ID NO: 63413 - DNA, 546 bp, Homo sapiens
  misc_feature: GYAE6OF01AI8DO.31.78.H01.1.454.CMB.1.raw
  modified_base (540)..(540): a, c, t, g, unknown or other
  misc_feature (540)..(540): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattggccccacaataacaactacttagcttggtaccagcagaaagtaggacagcctcctaaactcctgatttactgggcttctacccgggcacgtccggggttcctaaccgtattcattggcaggcgggtctggggaccgtatttcactctcaccatcagcacgcctgcaggctgaagatgtggctagtttattactgtcagacaactattaaaatctttctttcgtctacgtttcggacggtacgggaccgtaggtggagatacgaaacgtactaggtcgcgtgtacctatctgtcttcgtnttcccg

SEQ ID NO: 63414 - DNA, 819 bp, Homo sapiens
  misc_feature: GYAE6OF01BC0RG.31.78.H01.1.454.CMB.1.raw
  modified_base (382)..(382): a, c, t, g, unknown or other
  misc_feature (382)..(382): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctcgtgggcgagagggccaccatcaactgaccaagtccagccagagttgttttattcggaccccaacaataacaactacttagcttaggtaccagacaagaaagtggacagccctacctaaactcctagtactttacgtgggtcctttccgtaccccgggctaacgttccccgggggtttaccctaaaccggtnttaccgagtttcggacgtaacgggtccggggttccgtacggggtaccctaatttccgaccttcctaccgtaacccagttccgaacgccgtaacggtcccgttcggaccgtacgggtaccgttaaggaaacggtacgttacgggttacgggtaaccgttaaggttttttaacgttaccgtttacggttaccgtaaacggtacccttaaaacttacgttttaaaccttttaacccgttttacccgttttaccggttaacccgtttaaccgggttttccggggaaccggggttaacgggtaacccgggtaaaggggttacgggtaaacggtaaaccgttaaccgaaaaacccgggttaagttacggggttaccggaccggttaaccgacccgttaaaccgtaccgtttaccgtttcggttaccttttaccggttaacccg

SEQ ID NO: 63415 - DNA, 606 bp, Homo sapiens
  misc_feature: GYAE6OF01BNQIB.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagacctccctggctgtgtctcgtgggcgaggacgggccaccatcaactgcaagtccagccagtagttgttttattcggacccccaacaataacaactacttagcttggtaccagcaagaaagtaggacagccctacctaaactcctagtactttacgtgggtccttcgtacccgggctacggttcccggggttaccctaaccgtattcagttcggctacggtcgggtctacggggaccctatttccacttctcaccatcagcacgcctgcaggctagaagtgtggtcggactagtttatacgtgtacagactaactatttacttactttcgtttcgtacttaccgtttcgggacggtacggaaccgaggtacggagtactacgaaacgtagtggtcggactcgacctaacctattaccgtcgttccttctaccg

SEQ ID NO: 63416 - DNA, 761 bp, Homo sapiens
  misc_feature: GYAE6OF01C4NQ8.31.78.H01.1.454.CMB.1.raw
  modified_base (244)..(244): a, c, t, g, unknown or other
  misc_feature (244)..(244): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctcgtggatctcgtggtgccgtacggggacagttcgtggatggacgtcctagtttccagacctcccgtggctgtcgtctcgtgggcaggacggccacatcaactgctaagtccagcctagngttgtttacgtccggaccctaacgtaaataaccgtaacgttacgttacgccttggaacctaggtccgtaaggtaaacgtcggacctacggtaccctaaccgtaaacgtccgttagtaacgttttaccgcgggtacctttacccggtacccgggtctaacggttaccccgggggtttaccctaaaccggttacgttccgttaagttacgggaccgtaacgggtccgggggttacttaccgggggtaaccttaccggtttcaaccgtttccgtaccgtaaccgtgtacccgaggtcccgtacggtccgttacggacgtacggtcttacggtaagtacgtggtaacgtcgttaagtttacgaccgtgtaccgtacgtactaaccgtactttcgttaaccttccggttacgtacgttaccgttcggaaccggtaggtaccgtaggtcgaacgtagtaaccgtaacggtagtcggttacggctactaccgtacgttacgttacgcgttacgttcgtacccgg

SEQ ID NO: 63417 - DNA, 679 bp, Homo sapiens
  misc_feature: GYAE6OF01CTYDJ.31.78.H01.1.454.CMB.1.raw
  modified_base (317)..(317): a, c, t, g, unknown or other
  misc_feature (317)..(317): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaatgcaagtccagccagagttgtttattcggcccaacaataacaactactagcttaggtaccagcagaaagtggaacagaccctacctaaactcctagactttacngggtactttccgaacccgggctaacgtcccgggggttacctaaaccggtacttactagttggtactaaggttgggggtctaggggaacccgtattttccgaacttccgtacacctatcaacggtccacgtccctagcgacggtaccgagtaaagtacgttggtcggtacttaaggtttaattaacgtggttcaaggactaaactatttaacttacctttcttttaccgtaccgttaacgtttccgggacgggtaacgggtaacccgtaaagggttaggacggtaactaacggaaaaccgttaacggtacggtgggtacctaggaccctaacctaacttccggtacgttccgttccttaaccg

SEQ ID NO: 63418 - DNA, 850 bp, Homo sapiens
  misc_feature: GYAE6OF01C4K92.31.78.H01.1.454.CMB.1.raw
  modified_base (325)..(325): a, c, t, g, unknown or other
  misc_feature (325)..(325): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctcgtgggcgaggacgggccaccatcaactgcaagtccagccagagttgttttattcggccccaacaataacaacttacttagcttggtaccagcaagaaagtaggacagccctacctaaactcctgtactttacgngggtcctttaccgacccgggtctaacggttcccggggtttaccctaaaccggtactttcgtaagtttcggacctacgggtccggggttccgtacggggtaaccctagtttaccgaccttccttacccaacctagttccgaacgtccgaacggtcccctaggaccgtacgggtaccttaagggaaacgttacggttaggggttacggtaccgtttaaaggttttttaaccgttaaccgtacggtttaacccgaacggttaacccttaaaacctttaagtttttaacctttaacccgttttttccctttttaccgggttacccgttaaccgggtttttcccgggggaaccggggttaaccggggtaaacccggttaaaggggttaacgggaaacggttaaacgtaaacccggttaaaaaccgggtaaccggttttacggggtacgggttaaccccgttacggaaccccgttaaccccgttaacgtttacccggttttccgttacccgtttacccgtttaaaccccgg

SEQ ID NO: 63419 - DNA, 850 bp, Homo sapiens
  misc_feature: GYAE6OF01A6U4O.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagtgttttattcggcccacaataacaactacttagcttggtaccagcaagaaagtaggacacgcctacctaaactcctagtactttacgtgggtccttccgtacccgggctaacgttcccgggggttaccctaaaccggtacttacgtacgtttacgggaccgtaacgggtccggggttccgttacggggaaccccggttacgttttacccgaacccgtttcccgttacccgaaacccccgtaagtttacccgaacgggtcccgtaaaccgggtcccccgttagggtaccccggtaacggggttacccgtttaagggtaaaaccgggtaaggtttcgggttacggggttacccttaaacggggtttttttaactttaaaccggttacggttaccgtaaacgggtaacccttaaaacttaacgttttaacctttaacccgttttttccgttttaccgggtttaaccgttaccggttttaccggggtaccgggtaacgggtacccggttaaagggtgggtaaaccgtaagtacccgtaaaaacggttaacgttcgggttacgggaccgtttaacggaccgttaacccgtaacgtttaccgttcggttcccttacggttaaccc

SEQ ID NO: 63420 - DNA, 585 bp, Homo sapiens
  misc_feature: GYAE6OF01AKS3J.31.78.H01.1.454.CMB.1.raw
  modified_base (317)..(317): a, c, t, g, unknown or other
  misc_feature (317)..(317): n is a, c, g, or t
  modified_base (438)..(438): a, c, t, g, unknown or other
  misc_feature (438)..(438): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggccccacaataacaactacttagcttggtaccagcagaaagtaggacagcctacctaaactcctgtactttacgngggtcttccgtacccgggctacgttcccggggtttaccctaaccggtattcaagttcggcctaggccggggtctgggacccgtatttcactctcaccatcagcagcctgcaggctagaagntggtgctagtttatacgtgtcagacaactatttactactttcgtttacgtctaccgtttcgggacggtaacgggaccgtaagggtgacgtactacgaaacgtagtggtcggactcgacctaccgtattccgtcgttccttctacccg

SEQ ID NO: 63421 - DNA, 599 bp, Homo sapiens
  misc_feature: GYAE6OF01BILNW.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagtagttgttttattcggaccccaacaataaccaactacttagcttggtaccagcaagaaagtaggacagccctacctaaactcctagtatttacgtgggcctttccgtacccgggcaacgttccccgggggttaccctaaaccggtatttcaagtttggaccgaggtccggggttcctggggaacccgtattttccaccttctccacctatccagcacgcctgcaggctagaagtatggtggtactagtttattacgtgtcagacaactattattacttctttcgtcttacgttcggcggaggtaccgaggtcggagtactacgaaacgtatggtcggactcgactaccattccgtagttcgttctacccg

SEQ ID NO: 63422 - DNA, 543 bp, Homo sapiens
  misc_feature: GYAE6OF01ESH1M.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagttccagactccctggctgtgtctctgggcgagagggccaccatcaactgcaagtccagccagagttgttttattcggccccacaataacaactacttagcttggtaccagcaagaaagtaggacagcctacctaaactcctagtatttactgggccttccgtacccgggcacgttcccggggttacctaaccgattcagttcggcaggcgggtctgggacctatttcactctcaccatcagcagcctgcaggctagaagatgtggactagtttatactgtacagacaatattatactttcttacgtctacgtttcggacggacgggaccaaggtgacgatacgaaacgtatggtggctgcctacatcgtgttctctac

SEQ ID NO: 63423 - DNA, 675 bp, Homo sapiens
  misc_feature: GYAE6OF01DEIFC.31.78.H01.1.454.CMB.1.raw
  modified_base (314)..(314): a, c, t, g, unknown or other
  misc_feature (314)..(314): n is a, c, g, or t
  modified_base (328)..(328): a, c, t, g, unknown or other
  misc_feature (328)..(328): n is a, c, g, or t
  modified_base (366)..(366): a, c, t, g, unknown or other
  misc_feature (366)..(366): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagtcagtttccagacctccctggctgtgtctcgtgggcgaggacgggccaccatcaactgcaagtccagccagtagttgttttattcggccccaaccaataacaactacttagtcttaggtaccagcaagaaagtaggacacgcctacctaaacncctagtatttacgnggtccttcgacccgggctacgtccgggttaccaacgtnttacagttcggcgaggcgggtcgtcgggaccgtactttcgacctctccaaccactacagccacgtccctagacctaggctaaggaacgtagtacggtcggtacttaagttttacttacgtgtacctaagtactaaactagtttaactaccttttccgtttaccgttaccttaccggtttcgggaccgggtaacggggtaacccgtaagggtacggaacgtaacgttaaccgtaaaaacgggtaacgttaggtcgggtacccgttgacccgtaacctacgttaccgttaccgtttaccttccgttacccg

SEQ ID NO: 63424 - DNA, 602 bp, Homo sapiens
  misc_feature: GYAE6OF01BJBK4.31.78.H01.1.454.CMB.1.raw
  modified_base (432)..(432): a, c, t, g, unknown or other
  misc_feature (432)..(432): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgaggagggccaccatcaactgcaagtccagccagagtgttttattcggccccacaataacaactacttagcttaggtaccagcaagaaagtaggacagccctacctaaactcctgtatttacgtgggtccttcgtacccgggcacgtccggggttaccctaaccgattcattggcaggtcgggtcgtagggaccgtattccactctcaccatcagcacgcctgcaggctagaagtntggtgctagttttatactgtacagacaactattattacctttctttcgtactaccgtttcggggaccggagggtaaccgtagggtacggacgtaactaaccgtaaaaccggtaacgttggtcgggtcctaggaccctaaccgtattcccgttgttccctttactaacccg

SEQ ID NO: 63425 - DNA, 554 bp, Homo sapiens
  misc_feature: GYAE6OF01BSIPV.31.78.H01.1.454.CMB.1.raw
  modified_base (430)..(430): a, c, t, g, unknown or other
  misc_feature (430)..(430): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgtttattcggccccacaataacaactacttagcttggtaccagcagaaagtaggacagcctacctaaactcctgactttacgtgggtcttcgtaccccgggctacgttcccggggttacctaaccgattccatttggcacggcggggtctggggaccgtatttcactctcaccatcagcacgcctgcgaggctagaagngtgtggctagtttatactgtcagcaactattactacttctttcgtctacgtttcggacggacggtaccaagggtcgagtatacgaaacgtactggtcggctcgaccactatctcgttctctacc

SEQ ID NO: 63426 - DNA, 615 bp, Homo sapiens
  misc_feature: GYAE6OF01ESGM0.31.78.H01.1.454.CMB.1.raw
  modified_base (429)..(429): a, c, t, g, unknown or other
  misc_feature (429)..(429): n is a, c, g, or t
  modified_base (449)..(449): a, c, t, g, unknown or other
  misc_feature (449)..(449): n is a, c, g, or t
  modified_base (600)..(600): a, c, t, g, unknown or other
  misc_feature (600)..(600): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagacctccctggctgtgtctcgtgggcgaggcggccaccatcaactgacaagtccagccagtagttgtttttacgttccgaccccaacaataaaccaacttacttagcttaggaccagacaagaaagtaggacacgccctacctaactcctagtactttacgtcgggtcctttaccgtacccgggctaccggttcccggggttaccctaacgtacttcagttcggcgaggtcgggtctcgggacctacttcacttcncactatcagcacgtcctgcngactaggaagtagtggtagtacgttagttacttcgtcgtacacgtactaactatttacttacctttcttcgttactacggtttcgggacggtacggtaccgtaggtacgagtaacgtacgaaacgtagttcggtgcctagacctactactnttcgttctccgtacc

SEQ ID NO: 63427 - DNA, 662 bp, Homo sapiens
  misc_feature: GYAE6OF01CO1QT.31.78.H01.1.454.CMB.1.raw
  modified_base (323)..(323): a, c, t, g, unknown or other
  misc_feature (323)..(323): n is a, c, g, or t
  modified_base (340)..(340): a, c, t, g, unknown or other
  misc_feature (340)..(340): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagacctccctggctgtgtctcgtgggcgagagggccaccatcaactgcaagtccagccagtagttgttttatcggccccacaaataacaactacttagcttaggtaccagacagaaagtaggacagcctacctaaactcctagtattacgnggtccttaccgaccggntacggtccgggttacctaacgtacttctacgttcggcaggtcggtcgtacgggaccgtattccactcctacgacctatcacgcacgtcctgacgaggctagaacgtgtgtgtacttaggtttaactcgtcgtacaacgtactaaacttagtttaacttaccgttttcgttaccgtacttaccggtttcgggacgggtaacgggtaacctaaaggggttcgtaaacgtaactaaaccggtaaaaccggtaggttacgggtcggtaccctaacggacccgtaaacccttagttcccgtttacggttacccttacgttaaccccg

SEQ ID NO: 63428 - DNA, 753 bp, Homo sapiens
  misc_feature: GYAE6OF01EMKEW.31.78.H01.1.454.CMB.1.raw
  modified_base (357)..(357): a, c, t, g, unknown or other
  misc_feature (357)..(357): n is a, c, g, or t
  modified_base (387)..(387): a, c, t, g, unknown or other
  misc_feature (387)..(387): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctcgtgggcgaggagggccaccatcaactgacaagtccagccagtagttgttttatcggacccccaacaataaacaactaacttagcttggtaaccagacaagtaaaagtcggacacgtccctacctaaactcctagtactttacgcgggtccttaccgtacccggggntacgttccccggggttaccctaaaccggtntttaccaagtttcgggacgtagggtcccggggtacgtacgggggtaacccttattttccgaacctttccgtaccaaccctaagttcccgaacgtccgtacgtcccgttcggaccgtaagggtccttaaggaacgtaagttggtacgggttaccttaaggttttacttaccgtggtaccaagtacctaaactatttaactttacctttccgtttaccgtacctttaccggtttaccgggacgggtaacgggtaacccgtaagggtacggtaagtaacgttaaccgtaaaaacggtaaccgttgggtacggtaccgtacggaccctaaaccgtacgtttacccgtttacgttccttcccggttaaccc

SEQ ID NO: 63429 - DNA, 576 bp, Homo sapiens
  misc_feature: GYAE6OF01CX04X.31.78.H01.1.454.CMB.1.raw
  modified_base (435)..(435): a, c, t, g, unknown or other
  misc_feature (435)..(435): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagtagttgttttattcggccccacaaataacaactacttagcttggtaccagcaagaaagtaggacagcctacctaaactcctagtatttacgtgggcctttcgtacccgggctacgtcccggggtttaccctaaaccggtattcagtttggcgaggcgggtcgtgggacctattcactctcaccatcagcagcctgcagctagaagntgtggctagtttatctgtcagctaactatttactactttctttacgtctacgtttcgggacggtagggaccgtaaggtggagtacgtaacgaaacggtaactggtacggctcgacctaccgtatccttgtccttctaaccg

SEQ ID NO: 63430 - DNA, 554 bp, Homo sapiens
  misc_feature: GYAE6OF01CAIU2.31.78.H01.1.454.CMB.1.raw
  modified_base (446)..(446): a, c, t, g, unknown or other
  misc_feature (446)..(446): n is a, c, g, or t
  modified_base (551)..(551): a, c, t, g, unknown or other
  misc_feature (551)..(551): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagtgttttattcggccccacaataacaactacttagcttggtaccagcagaaagtagacagcctacctaaactcctgactttacgtgggtcttcgtacccgggctacgtcccggggttacctaaccggatttccaatttcgggccgtaacggccggggtccgtacggggaacccgtatttccacctctccaccatcagcagcctgcaggctagaagntgtggctagtttatactgtcagtcaatattatacttctttcgtctacgtttcggacggacggaccaggtgagatacgaaacgtactgtggctgcacatctctctntac

SEQ ID NO: 63431 - DNA, 632 bp, Homo sapiens
  misc_feature: GYAE6OF01DYTIJ.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagttccagactccctggctgtgtctctgggcgagagggccaccatcaactgcaagtccagccagagttgttttattcggccccacaataacaactactagcttggtaccagcaagaaagtaggacacgcctacctaaactcctagtactttacgtgggtcttccgtacccgggctacgttcccggggttacctaaccgattcagttggcaggtcgggtcgtcgggaccgtacttcactctacacatcgagcacgcctgacgaggctagaacgtagtggtgtacttagtttacttacgtagtacaagtactaacgttattaacttacctttcgtttaccgtacttaccgtttacgggaccgggtacgggtaaccgtaagggtaggacgtaacgtaacccgtaaaacgtaacgttaggtacggtaccgttcggaacctaccgtacttaccgttcgttccttccgtaacccg

SEQ ID NO: 63432 - DNA, 534 bp, Homo sapiens
  misc_feature: GYAE6OF01AQYME.31.78.H01.1.454.CMB.1.raw
  modified_base (415)..(415): a, c, t, g, unknown or other
  misc_feature (415)..(415): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagccctacctaaactcctgatttactgggtcttctaccccgggcagtcccggggttacctaaccgattcattggcagcgggtctgggaccgtatttcactctcaccatcagcagcctgcagctgaagntgtggctagtttatactgtcagcaactatttactacttctttcgtctacgtttcggcggagggaccaagggtggagatacgaaacgtatggtggctgccacctatctgttcttctaccg

SEQ ID NO: 63433 - DNA, 538 bp, Homo sapiens
  misc_feature: GYAE6OF01CEC87.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggccccacaataacaactacttagcttggtaccagcagaaagtaggacagcctcctaaactcctagatttactgggcttctacccgggcacgttcccggggttacctaaccgattcattggcaggcgggtctggggacctatttcactctcaccatcagcagcctgcaggctagaagatgtggctagtttatactgtcagctaactattattacttctttacgtctacgtttcggcggtacgggaccagggtgacgatacgaaacgtatggtcggctgaccacatctctcttctacg

SEQ ID NO: 63434 - DNA, 578 bp, Homo sapiens
  misc_feature: GYAE6OF01DOZWO.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacaactacttagcttggtaccagcaagaaagtaggacagcctacctaaactctagtatttactgggtcttcgtacccgggctacgtcccggggttcctaaccgtattcattggcagcgggtctgggaccgatttcactctcaccatcagcacgcctgcaggctagaagagtgtggctagtttattacgtgtcagactaatatttaactactttctttcgtctaccgtttcggcggtacggacgtaaggtggaagtactacgaaaacggtaaccttggtcggtacgtcgacctacccgtagttccgttacgttcctttccgtaaccg

SEQ ID NO: 63435 - DNA, 566 bp, Homo sapiens
  misc_feature: GYAE6OF01BT6OX.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacaactacttagcttggtaccagcagaaagtaggacagcctcctaaactcctgatttacgtgggcttccgtacccgggcacgtcccggggttacctaaccgtattcattcggcacggcgggtctgggaccgtatttcactctccacatcagccagtcctgcgaggctagaagtagtggtggctagtttattacgtgtcagcaactattactactttctttcgtcctacgtttcgggacggtacgggaccgtaagggtcggaagacgtaacgaaacgtaattggtggctgcctacctatctcgttccttcgtacc

SEQ ID NO: 63436 - DNA, 602 bp, Homo sapiens
  misc_feature: GYAE6OF01A25CR.31.78.H01.1.454.CMB.1.raw
  modified_base (454)..(454): a, c, t, g, unknown or other
  misc_feature (454)..(454): n is a, c, g, or t
  modified_base (590)..(590): a, c, t, g, unknown or other
  misc_feature (590)..(590): n is a, c, g, or t
  modified_base (598)..(598): a, c, t, g, unknown or other
  misc_feature (598)..(598): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctcgtggtgccgtacggggacatcgtgatgagccagtttccagactccctggctgtgtctcgtgggcgaggagggcccaccatcaactgcaagtccagccagagttgttttattcggccccaacaaataacaactacttagcttggtaccagcaagaaagtagacagccctacctaaactcctagtactttacgtgggtccttcgtaacccgggctaacgttccccgggggtttacctaacccggtattctagttcggcaggtcggggtctggggaccctatttcactcctcaacctatcagcacgccgtgcaggctagaagntggtggctaagttttactactgtcaagactaatatttatacctttctttcgtcttacgtttcgggacgggagggaacctaagggtgaagacttaaccgaaacgtaacgtggtacggctagcctaacctataccgtnttccgttntacc

SEQ ID NO: 63437 - DNA, 728 bp, Homo sapiens
  misc_feature: GYAE6OF01D3RXD.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagacctcccgtggctgtgtctcgtgggcgaggcgggccacatcaactgacaagtccagccagtagttgttttattcggacccctaacaaataacaactacttagcttaggtaccagacaagaaagtaggacacgcctacctaaactcctagtactttacgtgggtccttccgtacccgggctacgttcccggggttacctaaccgtacttccagttcggacgacgggtcgggttcgtacggggtacctacgtttccaccttccgtacctaacctacgttaccgaacggtacctaccggtcccgtaggaccgtacgggtaccttaggaaacgtacggttggtacggtactttaaggttttacgttaccgttggtacaacggtaactaacgttaactttacttaccttttaccgtttaccgtaccttaccggtttcgggaccgggtaacgggtaaccggtaagggttacggtaacggtaactaaccggtaaaaccgttaggttacggtcggtaccgttacgaccctaacgtacttaccgttacgttccttacttacccg

SEQ ID NO: 63438 - DNA, 521 bp, Homo sapiens
  misc_feature: GYAE6OF01BHYIL.31.78.H01.1.454.CMB.1.raw
  modified_base (410)..(410): a, c, t, g, unknown or other
  misc_feature (410)..(410): n is a, c, g, or t
  modified_base (438)..(438): a, c, t, g, unknown or other
  misc_feature (438)..(438): n is a, c, g, or t
  modified_base (514)..(514): a, c, t, g, unknown or other
  misc_feature (514)..(514): n is a, c, g, or t
  modified_base (518)..(518): a, c, t, g, unknown or other
  misc_feature (518)..(518): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacaactacttagcttggtaccagcaagaaagtagacagcctctaaactcctgactttactggcttcgtacccgggcacgtccggggttcctaaccgattcattggcagcgggtctgggaccgatttcactctcaccatcagcagcctgcagctgaagntgtggctagtttattactgtcagcaatnttaatactttcttcgtctacgtttcggcggagggtaccaaggtgagatcgaaacgactggtgctgacacgtatctntctntac

SEQ ID NO: 63439 - DNA, 622 bp, Homo sapiens
  misc_feature: GYAE6OF01DLEEM.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagtgttttattcggccccacaataacaactacttagcttggtaccagacagaaagtaggacagcctacctaaactcctgatttacgtggtcttctacccgggctacgtacccggggtttcctaaaccggatttccgaagtttcggcaggtccggggtctaggggacccgtatttccactcgtcaacctatcagcagcctgcgaggctagaagatggtggtacctaggttttactacgtggtcacggcaaactatttaacttacttctttcgtactaccgtttacgggcggtaacgggtacctaaacggggtggtaacgtaacgttacgaaaaccgtacgttggtacggtccgttacggaccgtaaccgtaagttcgttacgtattcctaaccg

SEQ ID NO: 63440 - DNA, 536 bp, Homo sapiens
  misc_feature: GYAE6OF01CULI3.31.78.H01.1.454.CMB.1.raw
  modified_base (229)..(229): a, c, t, g, unknown or other
  misc_feature (229)..(229): n is a, c, g, or t
  modified_base (314)..(314): a, c, t, g, unknown or other
  misc_feature (314)..(314): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagngttgttttattcggccccacaataacaactacttagcttggtaccagcagaaagtaggacagcctacctaaactcctgatttacngggtccttcgtacccgggcacgtcccggggttcctaaccgattcattggctaggcgggtctgggacctattcactctacaccatcagcagcctgcaggctagaagatgtggctagtttattacgtgtcagcaatattactacttctttcgtactacgtttcggcggtaggaccgtaagggtgagatacgaaacgatgtggctagccacctatctgtctgtac

SEQ ID NO: 63441 - DNA, 637 bp, Homo sapiens
  misc_feature: GYAE6OF01DE3TF.31.78.H01.1.454.CMB.1.raw
  modified_base (302)..(302): a, c, t, g, unknown or other
  misc_feature (302)..(302): n is a, c, g, or t
  modified_base (315)..(315): a, c, t, g, unknown or other
  misc_feature (315)..(315): n is a, c, g, or t
  modified_base (330)..(330): a, c, t, g, unknown or other
  misc_feature (330)..(330): n is a, c, g, or t
  modified_base (351)..(351): a, c, t, g, unknown or other
  misc_feature (351)..(351): n is a, c, g, or t
tcagcagtagacgtcacgaccggtgctcgatttagtgtgagtagtttgggtttggggagctacaacaggcaggcaggggcagcaagatggtgttgcagacccaggtcttcatttctctgttgctctggatctctggtgccgtacggggacatcgtgatgagccagtttccagactccctggctgtgtctcgtgggcgagacgggccaccatcaactgacaagtccagccagagttgtttattcggacccacaataacaactactagcttggaccagcaagaagtgacagtcctacctaaacncctagatttacgnggcttccgtaccggntacgttccgggttaccaacgnttcgagttcgctaggtcggtctacggggacctatttccgacgttctaccaaccgtactcgaacgccgaacgtccgcgacgacggtcctaggtaaagacgttggtacggtaccgttaaggtttttactaccgtgttacgaacggtactaacgttaatttacctaacgtttcctttaccgtacgttaccgtttcggacggtaacggacccgtaaagggtggaacgtagtaacgtaaaccgggtatgggtcgtacgtacgactaccctattcgtcttccgttctacccg

SEQ ID NO: 63442 - DNA, 645 bp, Homo sapiens
  misc_feature: GYAE6OF01CZWVU.31.78.H01.1.454.CMB.1.raw
  modified_base (472)..(472): a, c, t, g, unknown or other
  misc_feature (472)..(472): n is a, c, g, or t
tcagcagtagacgtcacgaccggtgctcgatttagtgtgagtagtttgggtttgggggagctacaacaggcaggcaggggcagcaagatggtgtgcagacccaggtcttcattctctgttgctctggatctctggtgccgtacggggacatcgtgatgagcctagttccagactccctggctgtgtctcgtgggcgagacgggccaccatcaactgcatgccagccagtagttgtttattcggaccccaacaaataaaccaactactagacttaggtaccagacaagaaagtaggacacgccctacctaaactcctagtattacgtgggtccttaccgtacccgggctacgttcccggggttacctaaaccggtattccgtaagttcgggacgtacggtccggggtcgttacgggaccgttactttaccaccttccgactaccatcaacgcacgcctgcacggctagaagtntggtcgacttaagtttactacgtgacaagtaccaacttatttaacttacctttccttacgtaccttacggtttacgggacgggtaacgggaaccgtaagggtacggaagtacgtaaaccgaaacgtacgtggtacgtacgtacgacctaacctagttcccgtgttccttaccg

SEQ ID NO: 63443 - DNA, 560 bp, Homo sapiens
  misc_feature: GYAE6OF01D6JXZ.31.78.H01.1.454.CMB.1.raw
  modified_base (357)..(357): a, c, t, g, unknown or other
  misc_feature (357)..(357): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacaactacttagcttggtaccagcagaaagtaggacagcctacctaaactcctgtatttacgtgggcttcgtacccgggctagttcccggggttacctaaccgtnttcattggcagcgggtcgtgggaccgtatttcactctcaccatcagcagcctgcaggctagaagatgtggactagtttatacgtgtcagacaactattaactactttctttacgtctacgtttcgggacggtagggaccgaggtaggaacgtagtacgaaacggtactggtcgacgtgaccctactatcttcgttctctaccg

SEQ ID NO: 63444 - DNA, 535 bp, Homo sapiens
  misc_feature: GYAE6OF01EJZCI.31.78.H01.1.454.CMB.1.raw
  modified_base (331)..(331): a, c, t, g, unknown or other
  misc_feature (331)..(331): n is a, c, g, or t
  modified_base (527)..(527): a, c, t, g, unknown or other
  misc_feature (527)..(527): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgtttattcggccccacaataacaactacttagcttggtaccagcaagaaagtaggacagcctacctaaactcctgatttacgtgggcttcgtacccgggnacgttcccgggttacctaaccgattccattcggcaggcgggtctgggaccgtatttcactctcaccatcagcagcctgcagctagaagatgtggctagtttattactgtcagacaatattatacttctttcgtctacgtttcggcggaggaccaaggtggagagtacgaaacgtaatggtgcgtgactacattctnttctctac

SEQ ID NO: 63445 - DNA, 535 bp, Homo sapiens
  misc_feature: GYAE6OF01A1HYA.31.78.H01.1.454.CMB.1.raw
  modified_base (530)..(530): a, c, t, g, unknown or other
  misc_feature (530)..(530): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacaactacttagcttggtaccagcagaaagtaggacagcctcctaaactcctgatttactgggcttctacccgggcatccggggttcctaaccgattcattggcagcgggtctgggaccgatttcactctcaccatcagcagcctgcaggctgaagatgtggctagtttatactgtcagcaactatttatactttctttcgtactacgtttcgggcggtagggacctaaggtggagatacgaaacgtactggtggctgccaacctatcctgttccttntaccg

SEQ ID NO: 63446 - DNA, 532 bp, Homo sapiens
  misc_feature: GYAE6OF01BIXB0.31.78.H01.1.454.CMB.1.raw
  modified_base (388)..(388): a, c, t, g, unknown or other
  misc_feature (388)..(388): n is a, c, g, or t
  modified_base (417)..(417): a, c, t, g, unknown or other
  misc_feature (417)..(417): n is a, c, g, or t
  modified_base (506)..(506): a, c, t, g, unknown or other
  misc_feature (506)..(506): n is a, c, g, or t
  modified_base (524)..(524): a, c, t, g, unknown or other
  misc_feature (524)..(524): n is a, c, g, or t
  modified_base (529)..(529): a, c, t, g, unknown or other
  misc_feature (529)..(529): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgtttattcggccccacaataacaactacttagcttggtaccagcagaaagtaggacagcctacctaaactcctgatttacgtgggcttcgtacccgggctacgtccggggttcctaaccgattcattggcagtcgggtctgggacctatttcactcncaccatcagcagcctgcacggctgaaagntggtgctagtttatacgtgtcagcaatattactactttctttcgtcgttacttcgggcggacggacctaaggtgagatacgaaacgtanggtgctgcctactatctntcctntac

SEQ ID NO: 63447 - DNA, 683 bp, Homo sapiens
  misc_feature: GYAE6OF01EDW8J.31.78.H01.1.454.CMB.1.raw
  modified_base (317)..(317): a, c, t, g, unknown or other
  misc_feature (317)..(317): n is a, c, g, or t
  modified_base (359)..(359): a, c, t, g, unknown or other
  misc_feature (359)..(359): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggccccacaataacaactacttagcttggtaccagcaagaaagtaggacagccctactaaactcctagatttacgngggcttccgtacccgggctagttccggtcggttacctacgtnttactagtcgacgtcggtcggtcgtacggaccgttattactacctctaccaacctactacgacgacgaccgtccgtagaccgaggtacgtaacggaagtgttggtacgtagtttaacgtttacgttacgtcgtacgaactacctaaactttaacgtttaactttaccgttttccgtttaccgttaccgtttaccggtttaccggggacggggtaacccgggtaaacggtaaggggtacggtaagttaaccgtaaaccgtaaacggtacggttcgggtacggtacttaccggaaccctaacgttacttccgttcgttccttaccg

SEQ ID NO: 63448 - DNA, 701 bp, Homo sapiens
  misc_feature: GYAE6OF01DIPX5.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctcgtgggcgagagggccaccatcaactgacaacgtccagccagtagttgttttattcggccccaacaataacaactacttagcttggtaccagcaagaaagtaggacagcctacctaaactctgtaactttacgtgggtcttcgtacccggctacgttcccggggttaccctaacgtacttcagttcggctaggtccgggtcgtacggggtacccgtatttccgaacttccgtaccaacctatccgaagcctacgtacccgtggaccgtacggcctaggaaagtacgttggtacggtacttaggtttaacttaccgtgtaccgtaagacctaaacgtacttttaacttacctttccgttttaccgttaccttaccggttttacggggaccgggtaacggggtaacccgtaaaggggttaggaacgtaactaaccgtaaaacggtaacggttggtacggtacctacggacccgtaacccttagttaccgttcgtttacccgttcgttaacccg

SEQ ID NO: 63449 - DNA, 672 bp, Homo sapiens
  misc_feature: GYAE6OF01CX28B.31.78.H01.1.454.CMB.1.raw
  modified_base (324)..(324): a, c, t, g, unknown or other
  misc_feature (324)..(324): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagacctccctggctgtgtctcgtgggcgagacggccaccatcaactgcaagtccagccagagttgtttatcggcccaacaataacaactacttagcttaggtaccagacaagaaagtaggacagccctacctaaactcctagtactttacgngggtccttccgtacccgggctacggttccccggggttacctaaaccgtattcgagtttcggacctagggtccgggtcgttacggggaacccttatttccgaacttcctaccgaccctatccgagccacgtccctgaccgaggctagaagtagtggtggacttagtttacttacgtagttcgaacgtactaacgttatttaacttaccttttccgttttacgtaccttaaccggtttcgggaccgggtacgggtaacccgtaagggtacggaaagtaactaaccgaaaacggtacgttgggtacgtccgttacgaccctaacgtacttccgtacgttccttccgtaccg

SEQ ID NO: 63450 - DNA, 724 bp, Homo sapiens
  misc_feature: GYAE6OF01CZVVP.31.78.H01.1.454.CMB.1.raw
  modified_base (334)..(334): a, c, t, g, unknown or other
  misc_feature (334)..(334): n is a, c, g, or t
  modified_base (351)..(351): a, c, t, g, unknown or other
  misc_feature (351)..(351): n is a, c, g, or t
tcagcagtagacgtcacgaccggtgctcgatttagtgtgagtagtttgggtttgggggagctaacaacaggcaggcaggggcagcaagatggtgttgcagacccaggtcttcatttctctgttgctctggatctctggtgccgtacggggacatcgtgatgagccagtttccagacctccctggctgtgtctcgtgggcgaggacgggccaccgatcaactgacaacgtccagccagtagttgttttacttcggaccccacaataacaacttacttagcttaggtaccagacaagaaagtaggacacgcctacctaaactccgtagtattacgnggtccttcgacccgggntacggttcccggggttacctaaaccggtattaccagttcggacgtaggtcgggttcgtacggggtaaccttagtttcccaaccttcctaccaaaccccgtattacccggaacgcccgtaaccgtcccgtacggaccgtaacgggtactacgggtaaagtacgttagggtacggtaccgttaaggtttttaacttacgtcgtacgacgtaacctaacttaatttaacttaccgttttaccgtttaccgtacgttaacgtttccggggaacggtacggggtaaccgtaagggtaggacggtaacgtaaccgtaaaacggtcgtacgggtacgtcgtacgacctaaccgtaacttccgttacgttcctcgtacccg

SEQ ID NO: 63451 - DNA, 624 bp, Homo sapiens
  misc_feature: GYAE6OF01APB6E.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagaggccaccatcaactgcaagtccagccagagttgttttattcggaccccacaataacaactacttagcttggtaccagcaagaaagtaggacacgcctacctaaactcctagtactttacgtgggtccttccgtacccgggctacggttcccggggttaccctaaccggtattccgagttcggcgtaggtccggggtcgtcggggacccgtatttccacttcctccaacctatcacgcacgccctggccgacggctaggaagtgtggtcggtacttaggtttatacgtgtacaagtactaaacgtatttacttactttccgtttacgtactaccgtttcgggacgggtacggtaccgtagggtacgaagtacgtaacgaaacgtactggtcgctacgacctactattcgttcgtccttcgtaccg

SEQ ID NO: 63452 - DNA, 555 bp, Homo sapiens
  misc_feature: GYAE6OF01EEL4P.31.78.H01.1.454.CMB.1.raw
  modified_base (441)..(441): a, c, t, g, unknown or other
  misc_feature (441)..(441): n is a, c, g, or t
  modified_base (444)..(444): a, c, t, g, unknown or other
  misc_feature (444)..(444): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgacaagtccagccagagttgttttattcggccccaacaataacaactacttagcttggtaccagcaagaaagtaggacagcctacctaaactcctagtactttacgtgggtccttccgtacccgggctacgttcccggggttaccctaaaccggtattccagttcggcaggccgggtctggggacctatttccactctcaaccatcagcagcctgcaggctagaagntgngctagttatcgtgcagcaatattactacttctttcgtctacgttcggacggtaggaccgtaaggtgaagtatacgaaacgtatggtgctgactacctatcgttgtctctac

SEQ ID NO: 63453 - DNA, 606 bp, Homo sapiens
  misc_feature: GYAE6OF01E2XSM.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagtagttgttttacttcggccccaacaataacaactacttagcttggtaccagcaagaaagtaggacagccctacctaaactcctagtactttacgtgggcttccgaccgggctacgttcccgggttacctaaccgattcattggcaggcgggtctagggaccgtattccactctcaccatcagcagcctgcaggtctagaacgatggtacggtctagtttattactcgtacaagtacctaactatttacttacctttcgtttccgtacttaccgtttcgggacgggacgggtaaccgtaagggtcggaacgtaacgtaaccgaaacggtacgttaggtcgggactcggacaacccgtattcctcgttccttctacccg

SEQ ID NO: 63454 - DNA, 686 bp, Homo sapiens
  misc_feature: GYAE6OF01E5HU0.31.78.H01.1.454.CMB.1.raw
  modified_base (332)..(332): a, c, t, g, unknown or other
  misc_feature (332)..(332): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctcgtgggcgagacgggccaccatcaactgacaagtccagccagtagttgttttacttcggacccccaacaaataaccaactacttagtcttaggtaccagacaagaaagtggacagccctacctaaactctagtactttacgngggtcctttccgacccgggtctacggttcccggggttacctaacgacttcgagttcggcgaggcgggttcgtagggacccgtatttccacttccaccaccatcacgcacgccctagcgacggctagaagtgtgtaggtcttaaggtttactacgtcgtacaagtaccctaaagttactttaccgttaacttttacctttccgttaccggttaaccgtttccggggtacgggaacggggaacccgtaaagggtacggtacggaaaccttaacggtaaaacccggtacgttacggtagggtccctacgttacccggaaccttaacgtcggtttacccgtttctacccgtttacccg

SEQ ID NO: 63455 - DNA, 568 bp, Homo sapiens
  misc_feature: GYAE6OF01BILK8.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgaggagggccaccatcaactgcaagtccagccagagttgtttattcggccccacaataacaactacttagcttggtaccagcagaaagtaggacagcctacctaaactcctgatttactgggcttcgtacccgggcacgttccggggttacctaaccgattcattcggcagcgggtctcggggacctattcactctcaccatcagcacgctgcaggctagagatgtgactagtttattacgtgtcagctaactattacttactttctttacgtactacgtttcgggacggtacggtaccgagggttcgaagtactacgaaacggtaatcggtcgcgtaggaccctacgtacttcgttcgttccttcgtacccg

SEQ ID NO: 63456 - DNA, 537 bp, Homo sapiens
  misc_feature: GYAE6OF01A0R8K.31.78.H01.1.454.CMB.1.raw
  modified_base (311)..(311): a, c, t, g, unknown or other
  misc_feature (311)..(311): n is a, c, g, or t
  modified_base (416)..(416): a, c, t, g, unknown or other
  misc_feature (416)..(416): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttacngggcttctacccgggctacgtcccggggttcctaaccgattccagttggcaggcgggtctgggaccgtatttcactctcaccatcagcagcctgcaggctgaagntgtggctagtttatactgtcagcaactattaactacttctttcgtctacgtttcggcggtaggaccaagggtggagatacgaaacgtatggtggactgacctaccgatctgttcttctacg

SEQ ID NO: 63457 - DNA, 570 bp, Homo sapiens
  misc_feature: GYAE6OF01DGQMQ.31.78.H01.1.454.CMB.1.raw
  modified_base (356)..(356): a, c, t, g, unknown or other
  misc_feature (356)..(356): n is a, c, g, or t
  modified_base (405)..(405): a, c, t, g, unknown or other
  misc_feature (405)..(405): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgaggagggccaccatcaactgcaagtccagccagagttgttttattcggccccacaataacaactactagcttggtaccagacaagaaagtaggacagccctacctaaactcctgtattactgggcttcgtacccgggcagtcccggggttcctaaccgtnttccattggcgagcgggtctcgggaccgtattcactctcacctatcgancacgcctgcaggctagagatggtcggactagtttactacgtgtacagactaactattaacttacctttctttccgtcttaccgttcggacgggtagggtaaccgtaagggtgagtagtacaaaacggtattggtcggctagacctacattcgttcttcttctacc

SEQ ID NO: 63458 - DNA, 556 bp, Homo sapiens
  misc_feature: GYAE6OF01C7FLR.31.78.H01.1.454.CMB.1.raw
  modified_base (313)..(313): a, c, t, g, unknown or other
  misc_feature (313)..(313): n is a, c, g, or t
  modified_base (381)..(381): a, c, t, g, unknown or other
  misc_feature (381)..(381): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatccctggtgcctacgggacatcgtgatgagccagtttccagactccctggctgtgtctctgggcgagagggccaccatcaactgcaagtccagccagagttgttttattcggccccacaataacaactactagcttggtaccagcaagaaagtaggacagcctactaaactcctagatttacnggcttctaccgggctagtcccgggttacctaaccgattcattggcagcgggtctggaccattcactcncacatcagcagcctgcaggctagaagatgtggctagtttattactgtcagacaactatttactactttctttcgtctacgtttcggacggtagggaccgtaagggtggagtacgtacgaaaacgtacgtggtaggtcctcggaccaccgtatccttagttaccttctacttcccg

SEQ ID NO: 63459 - DNA, 563 bp, Homo sapiens
  misc_feature: GYAE6OF01EFOE0.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggccccaacaataacaactacttagcttggtaccagcagaaagtaggacagcctacctaaactcctagtatttacgtgggcttccgtacccgggcacgttcccggggttaccctaaccgattcattcggcaggcgggtcgtgggacctatttcactctcaccatcagcacgcctgcaggctagaagtagtggtcggtactaggtttatactgtacagcaactattattacttctttcgtctacgtttcgggacggtacgggaccaaggtacggagatacgaaacgtagtggtggactcgacctactatctcgttcttctacg

SEQ ID NO: 63460 - DNA, 554 bp, Homo sapiens
  misc_feature: GYAE6OF01BFMDI.31.78.H01.1.454.CMB.1.raw
  modified_base (422)..(422): a, c, t, g, unknown or other
  misc_feature (422)..(422): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctacctaaactcctagatttactgggtctttcgtacccgggcacgtcccggggttcctaaccgtattccagttggcaggcgggtctgggaccgtatttccactctcaccatcagcagcctgcaggctgaagntgtggctagtttatactgtcagacaactattacttactttctttcgtctaccgtttcgggacggtacgggaccgtaaggtggaacgtataccgaaacggtatggtcggctgacctacatctgtcttctaccg

SEQ ID NO: 63461 - DNA, 813 bp, Homo sapiens
  misc_feature: GYAE6OF01E6INU.31.78.H01.1.454.CMB.1.raw
  modified_base (122)..(122): a, c, t, g, unknown or other
  misc_feature (122)..(122): n is a, c, g, or t
  modified_base (769)..(769): a, c, t, g, unknown or other
  misc_feature (769)..(769): n is a, c, g, or t
tcagcagtagacgtcacgaccggtgctcgatttagtgtgagtagtttgggtttgggggagctacaacaggcaggcagggcagcaagatggtgttgcacgacccagtcttcatttctctgttncggggggtctggatctcgtggtcgccgtacgggacagtcgtagatgacgtcctacgttccacgtcctccgtggtctgtcgtcgtcggtcgggacgacggaccggacccaaccactaccaactcgactaacgtccgacgtaccgtaggttacgtttacgtttaccgtacccgaacccctaaactaaactaacctaaccgttacgttacgtaccgtacggtaaccagaaccgaaagtaacgtacgacctaccgtaccctacctaactcgtacgttacgtacgtcggtccttaccggaccggtcgtaccggttaccggtacctacgtacttcgacgtcggacggcggtcggtacgtacggtaccttacttaccaccttaccactaacctacgtccgaacgccgtacgtaccgtacggtacggtaacggttacgtaaagggttacgtttcgtacgggtttaaacgttaacgttttaaccgtttaacgttacccgtaaccggtacttaaaccgttaaccttaactttaacgtttttccgtttaacccggtttccgttaccgggtaacccgttaacggggtccgggaaacgggtaacgtaaccggtaaggtaccgaactaaaccgtaacggtacgtacggttcgtccgtaccncgttacctaccgttacttccgttacccttaccgccttaccccgg

SEQ ID NO: 63462 - DNA, 527 bp, Homo sapiens
  misc_feature: GYAE6OF01A2L7Y.31.78.H01.1.454.CMB.1.raw
  modified_base (412)..(412): a, c, t, g, unknown or other
  misc_feature (412)..(412): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttatttggccccacaataacaactacttagcttggtaccagcagaaaagtaggacagcctacctaaactcctgatttactgggcttctacccgggcatccggggttacctaaccgattcattcggcagcgggtctgggaccatttcactctcaccatcagcagcctgcaggctgaagntgtgctagtttattacgtgtcagcaactattactactttcttcgtctactttcggcggaggacctaaggtgagactacgaaacgtatcggtggctgactacatctgttctcgtac

SEQ ID NO: 63463 - DNA, 516 bp, Homo sapiens
  misc_feature: GYAE6OF01A4W1R.31.78.H01.1.454.CMB.1.raw
  modified_base (505)..(505): a, c, t, g, unknown or other
  misc_feature (505)..(505): n is a, c, g, or t
  modified_base (513)..(513): a, c, t, g, unknown or other
  misc_feature (513)..(513): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgtttattggccccacaataacaactacttagcttggtaccagcagaaagtaggacagcctcctaaactcctgatttactgggcttctacccgggcatccggggttccaacgattcattggcagcgggtctgggaccgatttcactctcaccatcagcagcctgcaggctgaagatgtggctagtttatactgtacagcaacattactacttctttcgtctactttcggcggtagggaccaaggtggagatacgaaacgactgtggctgcacatntcgtcttntac

SEQ ID NO: 63464 - DNA, 575 bp, Homo sapiens
  misc_feature: GYAE6OF01CO860.31.78.H01.1.454.CMB.1.raw
  modified_base (312)..(312): a, c, t, g, unknown or other
  misc_feature (312)..(312): n is a, c, g, or t
  modified_base (418)..(418): a, c, t, g, unknown or other
  misc_feature (418)..(418): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctacctaaactcctgatttacngggccttcgtacccgggcaacgttccggggttcctaaccgattcattggcagcgggtctgggacctatttcactctcaccatcagcagcctgcaggctgaagatgnggctagtttatacgtgtacagcaaactattattacctttctttcgtctaacgttttcgggacggtacgggaaccgtaagggtggaacgtataccgaaaacggtacttgggtacgggtctacggacctaccgtattccttacggttccttcgtaaccg

SEQ ID NO: 63465 - DNA, 725 bp, Homo sapiens
  misc_feature: GYAE6OF01BVBT7.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagttgttttattcggccccacaataacaactacttagcttggtaccagcaagaaagtaggacacgccctacctaaactcctagtatttacgtgggtcctttaccgtaccccggggctaacgttccccgggggtttaccctaaaccggtacttccgaagtttcgggccaagggtccggggttccgtacggggtaacccgtactttccgaaccttcctaccaacctacttaccgacgtccgaacggtccctggtccgaggtcctaggaaagtagtgggtacggtcctaaggtttttattaaccgttggtaccaacggtactaaaccgttaattttaaccgttaacctttttccgttttaccgttacctttaccggttttaccggggacgggtaacgggtaacccgtaagggtacggtaagtaacttaaccgaaaacgtacgttagggtcggtaccgttcggaccctaacctattaccgttcggttccttccgtaaccc

SEQ ID NO: 63466 - DNA, 563 bp, Homo sapiens
  misc_feature: GYAE6OF01CR3M0.31.78.H01.1.454.CMB.1.raw
  modified_base (372)..(372): a, c, t, g, unknown or other
  misc_feature (372)..(372): n is a, c, g, or t
  modified_base (409)..(409): a, c, t, g, unknown or other
  misc_feature (409)..(409): n is a, c, g, or t
  modified_base (523)..(523): a, c, t, g, unknown or other
  misc_feature (523)..(523): n is a, c, g, or t
  modified_base (535)..(535): a, c, t, g, unknown or other
  misc_feature (535)..(535): n is a, c, g, or t
  modified_base (557)..(557): a, c, t, g, unknown or other
  misc_feature (557)..(557): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagactccctggctgtcgtctcgtgggcgaggacgggcccaccatcaactgcaagtccagccagagttgtttattcggaccccaacaataacaactacttagcttaggtaccagacaagaaagtcggacagccctacctaaactcctgtactttacgtcgggcttcgtacccgggctacgtcccggggttacctaaccggtnttacagttcggacacgggtcgggtcgtcgggaacctntttcactctcaccatcagcagcctgcgaggctagaagctggcggactagtttactactgtacagacaactattatacttcttcgtctacgttgggacgaggtaccaggtgaganacgaaacgatgngctcgactacctatcctcgttntcgtac

SEQ ID NO: 63467 - DNA, 751 bp, Homo sapiens
  misc_feature: GYAE6OF01DKDI9.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagactccctggctgtgtctcgtgggcgaggacgggccacatcaactgacaacgtccagccagagttgttttatcggaccccaacaataacaactactagcttggtaccagcaagaagtaggacagtccctacctaaactcctagtactttacgtcgggtcctttaccgacccgggtctacggttcccggggttaccctaaccggtactttacgtaacgtttcgggaccgtacgggtccggggttaccgtacgggggaacccgttacttttaccgaacctttccgttaaccctaacccgtacttaccgaaccggtccgtaaccggtccccgttaggacccgtaaacggggttcccgtaagggtaaacggttacgggttacgggttacgggtaccgtttaaggtttttaaacgttcccgtaggtacgtaacggtactaaactaagtttacttaaccgtttccgtttaccgtacttaccggtttcgggacggtacgggaccgtaagggtgaacgtactaaccgtaaacgtagttacggtcgtacctgacccgtacctacgttacgttcgttctccgttacccg

SEQ ID NO: 63468 - DNA, 629 bp, Homo sapiens
  misc_feature: GYAE6OF01BOFM8.31.78.H01.1.454.CMB.1.raw
  modified_base (458)..(458): a, c, t, g, unknown or other
  misc_feature (458)..(458): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctcgtgggcgagacgggccaccatcaactgcaagtccagccagagttgttttattcggccccaacaaataacaactacttagcttggtaccagcaagaaagtaggacacgcctacctaaactcctagtatttacgtgggcttccgtacccgggctacgttcccggggttacctaaccggtacttcgtaagttcggctacgggccggggtctaggggacccgtatttcaactccgtacacctatcgacgcacgcctgcgaggctagaagtntaggtcggtactaggttttactacgttcgtacagtactaaactagtttacttactttcctttcgtacttaccgtttcgggacgggtacggtaccgtaaagggtcgaagtacgtaacgaaaacggtagttacggtcggactcgacctactataccgttagtccttactaccg

SEQ ID NO: 63469 - DNA, 540 bp, Homo sapiens
  misc_feature: GYAE6OF01A1LTB.31.78.H01.1.454.CMB.1.raw
  modified_base (413)..(413): a, c, t, g, unknown or other
  misc_feature (413)..(413): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgtttattcggccccacaataacaactacttagcttggtaccagcagaaagtaggacagcctacctaaactcctgatttactgggcttctacccgggcatccggggttcctaacgattcattggcaggcgggtctgggaccgatttcgactctcaccatcagcagcctgcaggctgaagatgnggctagtttatactgtcagctaactatttactactttctttcgtcgtacttttcgggcggtagggtaccaaggttaggacgataccgaaacgtaactggtggctgaccactactactgtctctaccg

SEQ ID NO: 63470 - DNA, 522 bp, Homo sapiens
  misc_feature: GYAE6OF01DHFXT.31.78.H01.1.454.CMB.1.raw
  modified_base (345)..(345): a, c, t, g, unknown or other
  misc_feature (345)..(345): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacactacttagcttggtaccagcagaaagtaggacagcctcctaaaactcctgatttactgggcttcacccgggcatccggggttcctaaccgnttcattggcagcgggtctgggaccgatttcactctcaccatcagcagcctgcaggctgaagatgtggcagtttatactgtcagcaatattaatacttctttcgtctacgtttcggacggtagggacctaagggtggagatacgaaaacgatggtgctgactaccatctgtcttctac

SEQ ID NO: 63471 - DNA, 560 bp, Homo sapiens
  misc_feature: GYAE6OF01AS30A.31.78.H01.1.454.CMB.1.raw
  modified_base (318)..(318): a, c, t, g, unknown or other
  misc_feature (318)..(318): n is a, c, g, or t
  modified_base (426)..(426): a, c, t, g, unknown or other
  misc_feature (426)..(426): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagttgtttattcggccccacaataacaactacttagcttggtaccagcagaaagtaggacagccctacctaaactcctagtatttacgngggcttccgtacccgggctacgtcccggggttacctaaccgattcagttcggcaacgggtctgggacctatttcactctcaccatcagcacgcctgcaggctagaagntgtgactagtttactactgtcacgtcaactattactactttcttacgtcttacgttcggacggtacgggaccaagggtcggagactaacgaaacgtactggacgtctcgacacctactctgtcttctactcccg

SEQ ID NO: 63472 - DNA, 654 bp, Homo sapiens
  misc_feature: GYAE6OF01B4BEN.31.78.H01.1.454.CMB.1.raw
  modified_base (345)..(345): a, c, t, g, unknown or other
  misc_feature (345)..(345): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagacctccctggctgtgtctcgtgggcgaggaggccaccatcaactgcaagtccagccagtagttgttttagttcggaccccaacaaataacaactactagcttaggaccagcaagaagtacgacagcctacctaaactcctagtactttacgtgggtccttccgtacccgggntacggttccccggggtttacctaaaccgtattacgtagttcggacgtacgggtcggggttcgtacgggacccgtatttccgactctacaacctatcacgcacgcctgcaggctagaagtgtgtcgtacttagtttactacgtcgtacacgtacaactatttaacttcctttcgtttaccgtaccttaccgtttcgggacgggtaacgggaaccgtaagggtcgaaacgtacgtaaacccgaaacggttaacgtggtcggtaccgtacggaaccctaccgtacttaccgttcgttcctttaccgtacccg

SEQ ID NO: 63473 - DNA, 579 bp, Homo sapiens
  misc_feature: GYAE6OF01EXD3P.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagtagtgttttattcggccccaacaataacaactacttagcttggtaccagcaagaaagtaggacagcctcctaaaactcctgtactttacgtgggtccttccgtacccgggcacgttcccggggttacctaaccgtattcattcggcaggcgggttctgggacctatttccacttctccaacctatccgacgtcacgtccctagccaggcgtagaagatggtgacttaagtttacttacgtgtacagtacaactattacttactttcgtttcgtccttacgtttcggacggacgggaccaaggtggagatacgaaacgtatggtgctgacctaccattctcgtcttcgtac

SEQ ID NO: 63474 - DNA, 704 bp, Homo sapiens
  misc_feature: GYAE6OF01AF58V.31.78.H01.1.454.CMB.1.raw
  modified_base (561)..(561): a, c, t, g, unknown or other
  misc_feature (561)..(561): n is a, c, g, or t
tcagcagtagacgtcacgaccggtgctcgatttagtgtgagtagtttgggtttgggggtaggtcgtacgaacaggcgaggcgaggggcgagcgaagatggtgttgcagaccacggtcttcattctctgttgctctggatctctggtgcctacggggacatcgtgatgagccagttccagacctccctggctgtgtctcgtgggcgaggagggccaccgatccaactgccaagtccaggcccagagttgttttattggcccccacaataccaactcttagcttaggtaccagctaagaaagtaggacaagccctaccaaacgtccctgtactttactcggggctttccgtaacccgggctaactcccggggggtttcccaaacggtcttctaacgttcgggcaaggcggggtcctgggaaccccggtatttcgactccgtacaccgaattcccaagtcacgacccgtcgtaccaaggggtcccttaggaacggtagttacggttcgggaccgtaggttttaacgttaccgtttaacggtctacgtacgtaacctaacgtttnttaaccttctttccgggtaaccttacgttttccgggacgggtaccgggtaaccgtaacgggttcggtaggaacgttacccgaaaggttaaccgtacgggtcgtaccgtggacctaccaaacgttctacggttacgttcctacc

SEQ ID NO: 63475 - DNA, 768 bp, Homo sapiens
  misc_feature: GYAE6OF01C7CGP.31.78.H01.1.454.CMB.1.raw
  modified_base (316)..(316): a, c, t, g, unknown or other
  misc_feature (316)..(316): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggccccacaataacaactacttagcttggtaccagcagaaagtaggacagcctacctaaactcctgtatttacgngggtcctttcgtacccggggctacgttcccggggttacctaaaccggtatttcgaagtttcggaccgtagggtccggggttccgttacggggtaacccgttatttccgaaccttcctaccgaaccctataccaacggccaacggtcccgttaggaccgtaacgggccttaaggaaacggtagttggtagggtaccttaaggtttttaacttaccgtgttacctaacggacctaaaacgttacttttaacgttaacctttttccgttttaccggttaccttaaccggtttttccggggaaccggggttacggggtaaacccgttaaacgggggttacggaaacggttaacgttaaaccggtaaaaaaccggttaacgttacgggtacgggttaccgttacggaccctaaacccgttaacgttccgtttaacggttcctttaccgttaaccccg

SEQ ID NO: 63476 - DNA, 553 bp, Homo sapiens
  misc_feature: GYAE6OF01AXKZ8.31.78.H01.1.454.CMB.1.raw
  modified_base (432)..(432): a, c, t, g, unknown or other
  misc_feature (432)..(432): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagttccagactccctggctgtgtctctgggcgagagggccaccatcaactgcaagtccagccagagtgtttattcggccccacaataacaactacttagcttggtaccagcaagaaagtggacagcctacctaaactcctgtactttacgtgggtaccttccgtacccgggctacgttcccggggttacctaaccgtattcagttcggccacggcgggtctcgggtaccgtatttcactctcaccatcagcagcctgcaggctagaagngtgtgctagtttatactgtcagcaatattactacctttcttacgtctacgtttcggacggtacggaccaaggtgagatacgaaacgtacgtaggtcgctagcctactactctcgtcttcac

SEQ ID NO: 63477 - DNA, 613 bp, Homo sapiens
  misc_feature: GYAE6OF01C3LZQ.31.78.H01.1.454.CMB.1.raw
  modified_base (414)..(414): a, c, t, g, unknown or other
  misc_feature (414)..(414): n is a, c, g, or t
tcagcagtagacgtcacgaccggtgctcgatttagtgtgagtagtttgggttggggaggctacaacaggcaggcgaggggcgagcaagatggtgttgcagacccacggtcttctatttctctgttgctctggatctctggtcgcctacggggacatcgtgatgagccagtttccagactccctggctgtgtctcgtgggcgagagggccaccatcaactgcaagtccagccagagttgtttattcggaccccaaccaataacaactacttagcttggtaccagcaagaaagtggacagcctacctaaactcctgactttactgggccttctacccgggctaacgtcccggggttccctaaacgtattcagttacggcaggccgggtactggggaacccgtatttccaacgttcnccgtaacccatcacgtcacgcctgaccgagctagaagactggtggctagtttagtactgtcagacaaacctatttatacctttgtttccgtacttaccgtttcgggaccggagggtaaccctaagggttaggagtaactaccgaaaacggtaccgtggtcgggactggaacctacctattactcgtacctttcgtaacc

SEQ ID NO: 63478 - DNA, 535 bp, Homo sapiens
  misc_feature: GYAE6OF01EU14J.31.78.H01.1.454.CMB.1.raw
  modified_base (240)..(240): a, c, t, g, unknown or other
  misc_feature (240)..(240): n is a, c, g, or t
  modified_base (318)..(318): a, c, t, g, unknown or other
  misc_feature (318)..(318): n is a, c, g, or t
  modified_base (401)..(401): a, c, t, g, unknown or other
  misc_feature (401)..(401): n is a, c, g, or t
  modified_base (428)..(428): a, c, t, g, unknown or other
  misc_feature (428)..(428): n is a, c, g, or t
  modified_base (528)..(528): a, c, t, g, unknown or other
  misc_feature (528)..(528): n is a, c, g, or t
tcagcagtagacgtcacgaccggtgctcgatttagtgtgagtagtttggggtttgggggagctacaacaggcaggcaggggcagcaaagatggtgttgcagacccaggtcttcatttctctgttgctctggatctctggtgccgtacggggacatcgtgatgagcccagtttccagacctccctggctgtgtctcgtgggcgaggagggccaccatcaactgcaagtccagccagagttnttttattcggcccccacaactaacaactactagcttgtaccagcaagaaagtaggacacgcctcctaaactcctacgnttttactgggcttctacccggggcactccggggttcctaaccggatttcgattggctagcgggtctgggaccgatttcactcncaccatcagcagcctgcaggctgaagntgtggcagtttatacgtgtcagtcaacattatacttctttcgtctactttcggcgtaggaccaaggtcggagatcaaacgataggtgctgcactatactntctctac

SEQ ID NO: 63479 - DNA, 526 bp, Homo sapiens
  misc_feature: GYAE6OF01ENAN9.31.78.H01.1.454.CMB.1.raw
  modified_base (345)..(345): a, c, t, g, unknown or other
  misc_feature (345)..(345): n is a, c, g, or t
  modified_base (408)..(408): a, c, t, g, unknown or other
  misc_feature (408)..(408): n is a, c, g, or t
tcagcagtagacgtcacgaccggtgctcgatttagtgtgagtagtttgggtttggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtggacagcctacctaaactcctgatttactgggcttcctaccgggcagttccgggttcctaacgnttcattggcagcggtctgggaccgatttcactctcacatcagcagcctgcaggctgaagatgngctagtttatactgtcagcaactattatacttctttcgtctacgtttcggcggtaggaccaaggtcggagtatacgaaacgtacgtggtcgcgtgacctacatctcgttcgttctacg

SEQ ID NO: 63480 - DNA, 550 bp, Homo sapiens
  misc_feature: GYAE6OF01D76K2.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacaactacttagcttggtaccagcagaaagtaggacagcctacctaaactcctagtactttactgggccttcgtacccgggcaacgttccgggggttacctaaaccgattccaagtttggcaggtcgggtctggggaccgtatttcactctcacatcagcagcctgcaggctagaagatgtggctagtttacttactgtcagacaatattatacttcttcgtctactttcggacggtaggaccaaggtggagtatacgaaacgtactaggtcggactgactaccatctgtcttctacg

SEQ ID NO: 63481 - DNA, 617 bp, Homo sapiens
  misc_feature: GYAE6OF01B0W23.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgacaagtccagccagagttgttttattcggccccacaataacaactacttagcttggtaccagcaagaaagtaggacagcctacctaaactcctagtactttacgtgggtccttccgtacccgggctacgttcccggggttacctaaccgtattcagttcggctaggcgggtcgtcggggacctatttccactctacacctattagcacgcctgcaggtctaggaacgtagtggtggtctaagttttacttacgtgtacagtactaactattattactttctttcgtcttacgtttcgggacggtaacggtaccgaagggtggaacgtacgtaaccgaaacggtacgttggtacggtctacgacccaaccgtacttccgtagttccttccgtacgttccccg

SEQ ID NO: 63482 - DNA, 878 bp, Homo sapiens
  misc_feature: GYAE6OF01DXUX3.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctcgtgggcgagacgggccaccgatcaactgacaaatccagccagagttgttttattcggccccacaataacaactacttagcttggtaccagcaagaaagtaggacagcctacctaaactcctagtatttacgtgggcctttcgtaccccgggctacgttccccgggggttaccctaaacccggtatttaccgaagtttcgggacgaacgggtccggggttccgttacgggggaacccgttaacgttttccaaccgttccctttaccaaacccctaagtttacccgaaacggtcccgaacgggtaccccgttacggacccggtaacgggtacccgttaagggaaacggtaaggtttcggggttacggggttaccctttaaagggttttttttaaacgttttaaccccgtttacgggttaacccgtaaacgggtaacccttaaaaccgtttaacgtttttaaacttttaacccgttttttacccgttttttaccgttaccgtttaacccgggtttttacccggggtaccgggggtaacggggtaaaccccgttaaaggggggttgggtaaaaccgggtaacgtttaaacccggtaaaaacccggtaaacggtttacgggttacgggtaccgtacggaacccgtaacccgttaacgtttccgtttacggttccctttaccgtttaaccccg

SEQ ID NO: 63483 - DNA, 677 bp, Homo sapiens
  misc_feature: GYAE6OF01CU1VN.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctcgtgggcgagagggccaccatcaactgcaagtccagccagtagttgttttatcgccccacaataacaactacttagcttagtaccagacaagaaagtaggacagcctacctaaactcctgtacttacgtgggtcctttacgaccgggctacgttcccggggttaccctaaacgattacattggacaggtcgggtctcggggacctattcactctacacctatcagtcacgtcctgaccgtaggactaggaaacgtagttcggtacggtacttaaggttttattaaccgtgttaacctaaggtacctaaaactacgttttaaacttacccttttaccgttttaccggttaccttaacgggttttaccgggaacggggtacggggtaacccgtaagggggttagaacgggtaacttaaccgaaaaacggtaacttcgggtacggccgtacgtaccacccgttaacttcgttcggttaccttcctaaccg

SEQ ID NO: 63484 - DNA, 694 bp, Homo sapiens
  misc_feature: GYAE6OF01CNWH5.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagacctcccgtggtctgtgtctcgtgggcgagcggccaccatcaactgacaacgtccagcagtgttgttttactcggacccacaataacaactactagcttaggtaccagacaaggaaagtacggacagaccctacctaaactctagtactttacgcggtcttaccgacccggtactacggttcccgggtacctaaccgtacttacgtacgttcggcgacggtcgggtcgtacgggtaccgttactttcgaccttactaccaacctatacgaacgtccaacggtcccgtaggaccgtaggtcctaaggaaacgtagtcggtagggtaccttaaaggttttacttacgtacgtaccgtaagtaacctaactttaacttttaacttacccgtttttacgtttaccgttaccgttaaccggtttccggggaacggggtaacggaaccgttaagggtagtaaacgtacgtaaacgaaacggttatgggtcgacgtcaactacctattcgttacgtccttggtaccc

SEQ ID NO: 63485 - DNA, 521 bp, Homo sapiens
  misc_feature: GYAE6OF01EP8CJ.31.78.H01.1.454.CMB.1.raw
  modified_base (518)..(518): a, c, t, g, unknown or other
  misc_feature (518)..(518): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttatttggccccacaataacaactacttagcttggtaccagcagaaagtaggacagcctcctaaactcctgatttactgggcttctacccgggcagtccggggttcctaaccgattcattggcagcgggtctgggaccgatttcactctcaccatcagcagcctgcaggctagaagatgtggctagtttatactgtcagcaacattatacttctttcgtctacgtttcggcggagggaccaaggtggagatacaaacgtaatgtggctgcactatactgtcctntac

SEQ ID NO: 63486 - DNA, 845 bp, Homo sapiens
  misc_feature: GYAE6OF01BXNU8.31.78.H01.1.454.CMB.1.raw
  modified_base (322)..(322): a, c, t, g, unknown or other
  misc_feature (322)..(322): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctcgtgggcgagaggccaccatcaactgacaagtccagccagagttgttttattcggaccccacaataacaactacttagcttggtaccagacagaaagtaggacagcctacctaaactcctagtactttacgngggtccttaccgtaccccgggctacgttcccggggttaccctaaacccggtatttccgaacgtttcggaccacgggtccggggttacgtcggggtaacccgtattttccgaacctttcctaccaacccgtattacccgaacggtacctaccggtacccgtacggaccgtaacgggtaccgttaaggtaaaggtagttacgggtacgggtaccgttaaggtttttaacgtttacgtttacggttaaccgtaacggtaaccctaaacctttaacgttttaactttaacccgtttttaccgttttacccggtttaccgttaacccgggtttttaccggggaaccgggggttaaaccggggtaaacccggttaaacgggggttaacgggtaaacggttaaaaccgtaaccggtaaaaaaccgggttaaacggtttaccgggttaccgggttaccgttaacgggtaaccccgtaaacccgttacgtttaacccggtttccggtttaaccgtttcccgtttaaaccccg

SEQ ID NO: 63487 - DNA, 550 bp, Homo sapiens
  misc_feature: GYAE6OF01CBJYT.31.78.H01.1.454.CMB.1.raw
  modified_base (542)..(542): a, c, t, g, unknown or other
  misc_feature (542)..(542): n is a, c, g, or t
  modified_base (547)..(547): a, c, t, g, unknown or other
  misc_feature (547)..(547): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggccccacaataacaactacttagcttggtaccagcagaaagtaggacagcctacctaaactcctgtatttacgtgggtcttcgtacccgggctacgtcccggggttacctaaccgattcaatttcggcaggtcgggtctgggaccgtattcactctcaccatcagcacgcctgcagctgaagatgtggctagtttattactgtacagacaactattaactacttctttcgtactacgtttcggacggtaggaccgaagggtggagatacgaaacgtactaggtggctagactaccatctntcttntac

SEQ ID NO: 63488 - DNA, 738 bp, Homo sapiens
  misc_feature: GYAE6OF01C8XSK.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagacgggccaccatcaactgcaagtccagccagagttgttttattcggccccacaaataaactaactacttagcttcggtaaccagacaagaaagtaggacagtcctacctaaactctgtatttacgtgggtccttcgtacccgggctacgttcccggggttaccctaaaccggtacttcatttcggcaaggtccggggtcgtacggggaccctaagtttccgacctccgtacaaccctataccacgtcgaacgtcccgtacggaccgtaagggccgtaggaaagtacgttgggtacggtacgttaacggttttaattaccgtttgtaccgtaacgaccgtaaactttaactttaacttttaaccgttttccgtttttacgttacccgtttaccggttttccggggtacccgggggtaacggggtaaccccgttaaaggggttacgggaaacgtacgttaacccgtaaaaacgggtacgttacggtcgggaccgttacgaccctaaccgtacttcccgttacggttccctttcgtaacccg

SEQ ID NO: 63489 - DNA, 746 bp, Homo sapiens
  misc_feature: GYAE6OF01DRJMB.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacactacttagcttggtaccagcagaaagtaggacagcctacctaaactcctagtatttacgtgggtcctttccgtaccccggggctaacgttcccgggggtttaccctaaacccggtatttccgaagtttcgggcctaagggtccggggttcgtcgggggacccgtaattttccaaccgttcctaccaaccctaattccaagtccaacggtccctggaccgacgggtctaggaaacggtagttcggtcgggtacttaaggtttttaactttacgttggtaccaaggtacctaaacgttaattttaactttacccgttttacgtttttccgtaccgttaaccggttttccggggaccggggtaacggggtaacccgtaaaaggggttgggaacgtaaacgttaacccgtaaaaaccgggtaaccgttgggttaccgggaccgttacggaccctaacccgtaactttccgtttacggttccctttcgtaaacccg

SEQ ID NO: 63490 - DNA, 585 bp, Homo sapiens
  misc_feature: GYAE6OF01BLZ0J.31.78.H01.1.454.CMB.1.raw
  modified_base (404)..(404): a, c, t, g, unknown or other
  misc_feature (404)..(404): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgaggagggccaccatcaactgcaagtccagccagagttgttttattcggccccaacaataacaactacttagcttggtaccagcaagaaagtaggacacgccctacctaaactcctgtatttacgtgggtccttcgtacccgggctacgtccggggttacctaaccgtattcattggcaggcgggtcgtcgggaccgtatttcactcncacatcagcagcctgcgaggctagaagagtgtgctagtttattacgtgtcacgtactaactattacttactttctttcgtcttaccgtttcgggacgggtacggtaccgaagggtacggagtaacgtacgaaacgtaacgtggtcggctagacctacctataccttgttccttcgtacccg

SEQ ID NO: 63491 - DNA, 587 bp, Homo sapiens
  misc_feature: GYAE6OF01BEWK1.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagactccctggctgtgtctcgtgggcgagagggccaccatcaactgcaagtccagccagagttgttttattcggcccccaacaataacaactacttagcttggtaccagcagaaagtaggacagcctacctaaactcctgtatttacgtgggcttccgtacccgggctacgttcccggggttacctaaccgtattcagttggcaggcgggtcgtcggggaccgtatttccactctcaccatccagcacgcctgcgaggctagaagagtggtggactagtttattacgtgtcagtcaatattattactttctttcgtactacgtttcggacggtacggaccgtaagggtggagtaagtaccgaaacgtacgtaggtcggacgtacgacctaccgattacgtcgttcgttacgtaccg

SEQ ID NO: 63492 - DNA, 793 bp, Homo sapiens
  misc_feature: GYAE6OF01B74CV.31.78.H01.1.454.CMB.1.raw
  modified_base (334)..(334): a, c, t, g, unknown or other
  misc_feature (334)..(334): n is a, c, g, or t
tcagcagtagacgtcacgaccggtgctcgatttagtgtgagtagtttgggtttgggggggagactacaacaggcacggtcgagggggcagcaagatgggtgttgcagacccaggtcttcatttctctgttgctctggatctcgtggtgccgtacggggacatcgtgatgagccagttccagactccctggctgtgtctcgtcgggcgagacgggccacatcaactgacaacgtccagccaggtagttgttttacttcggaccccacaataacaactactagcttggaccagacaagaaagtaggacagcctacctaaactcctagtatttacgngggtccttaccggacccgggctacggttcccggggttacctaaccggtattcgtaacgtttcggacgtacgggtccggggttcgtacggggtaacccgttactttccaccttcctaccaacctaactccgaagcctaacggtcccgtacggaccgagggtaccgttaaggaaaggtaacgttcgggtacgggtaccttaaagggtttttaacttaaccgttcgtaaccgaacggtaacctaaacttaattttaacgttaaccttttccgttttacggttaacccgttaccggttttaccgggggaaccggggtaacgggtaacccggtaaaggggttacgggtaaacggttaacgttaaacccggtaaaaaccggtaaccggttacgggtacgggtaccgtaacgggtacccctaaaccgtacgtttaccgttacggtttacccttaccgttaaccccg

SEQ ID NO: 63493 - DNA, 581 bp, Homo sapiens
  misc_feature: GYAE6OF01AJP7H.31.78.H01.1.454.CMB.1.raw
  modified_base (320)..(320): a, c, t, g, unknown or other
  misc_feature (320)..(320): n is a, c, g, or t
tcagcagtagacgtcacgaccggtgctcgatttagtgtgagtagtttgggtttgggggatctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggccccacaataacaactacttagcttggtaccagacaagaaagtaggacagccctacctaaactcctagtatttacgngggtcttccgtaccccgggtcacgttcccggggttaccctaaccgtattcagttggcaggtcgggtctggggacctatttcactctccaccatcacgcacgcctgcaggctagaagagtgtggactagtttattacgtgtacagtacaactatttactactttctttcgtacctacgtttcgggacggtacggtaccgtaagggtggaagacgtaccgaaacgtacgtggtcggacctgacctacctatctgtcttctacg

SEQ ID NO: 63494 - DNA, 858 bp, Homo sapiens
  misc_feature: GYAE6OF01AYAAQ.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggaccccaacaataacaactacttagcttggtaccagcaagaaagtacggacagccctacctaaactcctagtatttacgtgggtacctttccgtacccgggctacgttccccggggtttacctaaaccggtatttcctaacgttcgggccgtaagggtccggggttaccgtacggggtaacccgtacgttttccaaccgttcctaccgaacccctaacgttaccgacggtaccaacggtcccgttacggaccgtacgggtaccgttacggaaacggtacgttacggtaggtaccgtttaaggtttttaactttacggttacggttaccgtaacggtaaccctaaaaccgtttaagttttaaaccgttttaaccgttttttacccgtttttaccccgggttttaaccggtttaacccgggttttttacccgggggaaccgggggttaaaccggggtaaacccgggttaaaccgggggttagggtaaaccgggttaaacgttaaccccggtaaaaaccgggttaacccggttacgggttaccgggttacccgttacggaaccccgttaaccgttacccgtttaccgtttacggttacccgttttaccggttaaccccg

SEQ ID NO: 63495 - DNA, 541 bp, Homo sapiens
  misc_feature: GYAE6OF01EWFA4.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggccccacaataacaactacttagcttggtaccagcagaaagtaggacagcctacctaaactcctgatttactgggcttcgtacccgggcacgtccggggttcctaaccgattcattggcaggcgggtctgggaccgatttcactctcaccatcagcagcctgcaggctaggaagatgtgctagttttattactgtcagtacaatatttattacttctttcgtctacgtttcggcggacgggtaccgtaagggtggagatacgaaacgtagtagtcggactgacactatctcgtctctac

SEQ ID NO: 63496 - DNA, 527 bp, Homo sapiens
  misc_feature: GYAE6OF01E234Y.31.78.H01.1.454.CMB.1.raw
  modified_base (413)..(413): a, c, t, g, unknown or other
  misc_feature (413)..(413): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgtttattggccccacaataacaactacttagcttggtaccagcaagaaagtaggacagcctcctaaactcctgatttactgggcttcgtacccgggcatcccggggttcctaaccgattcattggcagcgggtctgggaccatttcactctcaccatcagcagccctgccagggctggaagntgtggctagtttattactgtcagcaactattatacttctttcgtctacgtttcgggcggtacgggaccaagggtgagatacgaaacgtactggtgctgcaccatctgtcttcac

SEQ ID NO: 63497 - DNA, 910 bp, Homo sapiens
  misc_feature: GYAE6OF01DPLTT.31.78.H01.1.454.CMB.1.raw
  modified_base (317)..(317): a, c, t, g, unknown or other
  misc_feature (317)..(317): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacaactacttagcttggtaaccagcaagaaagtaggacagcctacctaaactcctgtatttacgngggtccttccgtacccgggctacgttcccggggttaccctaaaccgtattccaagtttcggaccgtaagggtccggggttccgtacgggggtaacccgtacgttttccaaccttccgttacccaaaccccgtaattccgaacggtcccgtaaacggtccccgttacgggaccgtaacggggtacccgttagggtaaaaggtaacgtttacggggttacggggtacccgtttaaagggtttttttaaaccgtttaaccgtttcgggtttaacccgtaacgggtaacccttaaaaaccgtttaacgtttttaaaccttttaacccgtttttaccccggtttttttacccggttaacccgtttaacccgggtttttttacccggggggaacccgggggttaaaccgggggttaaaccccggttaaaaaggggggtttacggggaaaaccggttaaacggttaaaccccggtaaaaaaccgggttaaaacccgtttacggggttaacccgggtaccgtttaccgggaacccctaaaccccggtttaaacgtttcccggtttaaccggttttccccttttaacccgtttaaaccccgg

SEQ ID NO: 63498 - DNA, 687 bp, Homo sapiens
  misc_feature: GYAE6OF01D7ZQT.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctcgtgggcgagacgggccaccatcaactgacaagtccagccagagttgttttattcggaccccaacaataacaactacttagcttaggtaccagacaagaaagtaggacacgcctacctaaactcctagtactttacgtcgggtccttccgtacccgggctacggttcccggggtttaccctaaaccggtatttccgagtttcggaccgacggtccggggttctcgggggaccctacttttccaccgttcctaccgaaccctagttcccgaagtccaacggtccctggaccgagggtcctaggaaacgtagtggtacggtacttaagttttacttacgtcggtcaacgtactaactactttacttaacctttccgttttacgtaccttacggtttccgggacgggtaacgggtaaccgtaagggtaggaacgtaacgtaacgaaaccggtagtggtcggtacgtcgacctaaccgtattccgttcgttcctcgtaccg

SEQ ID NO: 63499 - DNA, 567 bp, Homo sapiens
  misc_feature: GYAE6OF01C3KBC.31.78.H01.1.454.CMB.1.raw
  modified_base (553)..(553): a, c, t, g, unknown or other
  misc_feature (553)..(553): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgaggagggccaccatcaactgcaagtccagccagagttgttttatcggccccacaataacaactacttagcttggtaccagcaagaaagtaggacagcctacctaaactctgtactttacgtgggcctttcgtaccccgggctacgtcccggggttacctaaccgtattcattggccaggtcgggtctgggaccgtatttcactctcacctatcagcagcctgcgaggctagaagtagtggtggctaagtttacttacgtgtcagacaactatttaactactttctttcgtctacgtttcgggacggtagggtaccgaaggtggagtatacgaaacgtagtggtgctagcctacatntacgtcttcgtacc

SEQ ID NO: 63500 - DNA, 539 bp, Homo sapiens
  misc_feature: GYAE6OF01DZVCV.31.78.H01.1.454.CMB.1.raw
  modified_base (309)..(309): a, c, t, g, unknown or other
  misc_feature (309)..(309): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtagacagcctctaaactcctgatttacngggcttctacccgggcatccggggttcctaaccgattcattggcaggcggtctgggaccatttcactctcaccatcagcacgcctgcaggctgaagtatgtggctagtttattactgtcagcaacatttataactttctttcgtctacgtttcgggacggtagggacctaagggtggagtagtaccgaaaacgtaacttggtgcgtgcctaccatcttcgtcttctaacg

SEQ ID NO: 63501 - DNA, 622 bp, Homo sapiens
  misc_feature: GYAE6OF01DENHA.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacactactagcttggtaccagcaagaaagtaggacagcctacctaaactcctagtattttacgtgggtcctttccgtaccccgggctacgttccccggggttacccttaaaccggtatttccaagtttcggacctaggtccggggttccgtggggaacccgtattttccaccttctccaaccatcagcacgcctgcaggctagaagatgtaggtctagtttactacgtgtacagactaactattacttactttcctttcgtcttaccgtttcgggacggtacgggtaccgtaagggtcggaagtacgtaccgaaaacggtatggtcggtacctagacccgtacctacttactcggttccttcgtaacccg

SEQ ID NO: 63502 - DNA, 829 bp, Homo sapiens
  misc_feature: GYAE6OF01BTMEE.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagtttccagacctccctggctgtgtctcgtgggcgaggagggcccaccatccaactgacaagtccagccagtagttgttttagttcggaccccaacaaataaccaactacttagcttacggtaccagacaagaaagtaggacagccctactaacctcctagtactttacgtgggtccttcgacccgggtctacgttcccggggttacctaaccggtattacgagttcggctacgggtccgggttcgtacggggtaacccgttaatttcccgtaaccgttcctaccgaaccctaacgttccgaacgtcccgtaaccggtccccgtacgggaaccgtaacgggtcccgttaaagggaaaccggttaggtacgggttacgggtaaccgttttaaggtttttaacgttaaccgtttacggtaccgtaacggtaaccttaaaacgttacttttaaccgtttaaccttttcccgttttaccgttaccgtttaaccgggtttccgggtaaccgggggtaacgggtacccggtaaagggggttacggtaaacggtaaaccgttaaaccgggtaaaaccgttaaccgggtagggttacccgggtaccgttaaccggaacccgttaacccggttacgttaaccggtttcccgtttaccttacccggttaaccccg

SEQ ID NO: 63503 - DNA, 637 bp, Homo sapiens
  misc_feature: GYAE6OF01CLPEO.31.78.H01.1.454.CMB.1.raw
  modified_base (322)..(322): a, c, t, g, unknown or other
  misc_feature (322)..(322): n is a, c, g, or t
  modified_base (391)..(391): a, c, t, g, unknown or other
  misc_feature (391)..(391): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagactccctggctgtgtctcgtgggcgagaggccaccatcaactgacaagtccagccagtagttgttttatcggaccccacaaataacaactacttagcttaggtaccagcaagaaagtaggacagcctactaaactcctgacttttacgngggtcttccgtacccgggctacgtcccggggttaccctaaccgtacttcagttcggcaggtccggggtntcgggaccgtagtttccactctacacctatcacgcacgcctgaccgtaggctaggaaagtatggtgactagtttactacgtgtacagtactaactatttactacctttcgtttaccgtacttaccgtttcggacgggtaacgggtaccgtaagggttcggaacgtaacgtaaccgtaaaacggtaccgttaggtcggtacctacgactaaccccgtaattcccgtttcgtacccgtttcgtaaccc

SEQ ID NO: 63504 - DNA, 539 bp, Homo sapiens
  misc_feature: GYAE6OF01BG356.31.78.H01.1.454.CMB.1.raw
  modified_base (314)..(314): a, c, t, g, unknown or other
  misc_feature (314)..(314): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacaactacttagcttggtaccagcagaaagtaggacagcctacctaaactcctgtatttacngggtcttcgtacccgggcacgttcccggggttcctaaccgtattccagttcggcaggcgggtctggggaccgtatttcactctcaccatcagcagcctgcaggctagaagatgtggctagtttattactgtcagacaactattactacttctttcgtctacgtttcggcggtacggaccgaaggtgagagtacgaaacgtatgtgctgacacatctctcttctac

SEQ ID NO: 63505 - DNA, 557 bp, Homo sapiens
  misc_feature: GYAE6OF01D94RK.31.78.H01.1.454.CMB.1.raw
  modified_base (319)..(319): a, c, t, g, unknown or other
  misc_feature (319)..(319): n is a, c, g, or t
  modified_base (338)..(338): a, c, t, g, unknown or other
  misc_feature (338)..(338): n is a, c, g, or t
  modified_base (359)..(359): a, c, t, g, unknown or other
  misc_feature (359)..(359): n is a, c, g, or t
  modified_base (397)..(397): a, c, t, g, unknown or other
  misc_feature (397)..(397): n is a, c, g, or t
  modified_base (424)..(424): a, c, t, g, unknown or other
  misc_feature (424)..(424): n is a, c, g, or t
  modified_base (454)..(454): a, c, t, g, unknown or other
  misc_feature (454)..(454): n is a, c, g, or t
  modified_base (553)..(553): a, c, t, g, unknown or other
  misc_feature (553)..(553): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccaacaataacaactacttagtcttggtaccagcaagaaagtaggacacgcctacctaaactcctagtatttacngggtcttccgtacccgggnacgtcccgggttcctaaccgnttcagttggcaggcgggtctgggaccgtatttcactcncaccatcagcagcctgcagctagaagntgtgtctagtttatacgtgtcagacaactnttaacttactttcgtttcgtcttacgttcgggacggacggtaaccgtagggtgagtactacgaaacgtagtgtcggctagccacctactcttcgttctntacg

SEQ ID NO: 63506 - DNA, 561 bp, Homo sapiens
  misc_feature: GYAE6OF01CHAEI.31.78.H01.1.454.CMB.1.raw
  modified_base (428)..(428): a, c, t, g, unknown or other
  misc_feature (428)..(428): n is a, c, g, or t
  modified_base (456)..(456): a, c, t, g, unknown or other
  misc_feature (456)..(456): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggccccacaataacaactacttagcttggtaccagcagaaagtaggacagcctacctaaactcctgatttactgggcttcctacccgggctacgtcccggggtttcctaaccgtattcaacgttggccaggcggggtctggggaccgtatttcactctcaccatcagcacgcctgcaggctagaagntggtgctagtttatactgtcagcaactnttatacttctttcgtctactttcggacggtacgggaccaagggtggagtaacgtacgaaacgtaagtggtcggctacgcctaacctatcctagttccttcgtacc

SEQ ID NO: 63507 - DNA, 769 bp, Homo sapiens
  misc_feature: GYAE6OF01DL5MC.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagttccagactccctggctgtgtctcgtgggcgagaggccaccatcaactgcaagtccagccagagttgttttattcggccccaacaataacaactacttagcttaggtaccagacaagaaagtaggacagcctacctaaactcctgtactttacgtcgggtctttccgaccccgggctacgttcccggggttaccctaaaccgtacttcaacgtttcggctacggtccgggtcgtacggggtaacccgtactttccgaaccttccgttacccaacccgtattccgaagtcccgtacggtaccccttcggaccgtacgggtaccgttaggtaaacggtaagttcggtacgggtacgttaacgttttaacgtttaaccgttcggttaccgtaacggtaacctaaaccgttaatttaaccgtttaaccttttaccgttttaccgtttaccgttaccgttttaccgggaccgggtacggggtaacccgtaaagggttacgggaaacgtaacgtaaccggtaaaaacggtaaccgttagggttacggaccgttaccggtaaccctaacccgttaacttaccggtttacgtttcctttacccgttaacccg

SEQ ID NO: 63508 - DNA, 802 bp, Homo sapiens
  misc_feature: GYAE6OF01C79PQ.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcattctctgttgctctggatctctggtgccgtacgggacatcgtgatgacgcctagttccagacctccctggctgtgtctcgtgggcgaggacggccaccgatacaactgacaacgtccagccagtagttagttttacgtccggacccctaaccaaataaacctaacttaacttacgacgtttacggtaaccacgacgaaagtaaacgtacggaacacgtacccttaaccctaaaccttaccgtagttaactttaccgtcgggtaccttaccggtacccgggtactaaccggttaccccggggttaccctaaaccgtacttacgtacggttacggtaccgtacgggtccggggtacggttaccggggtaaccggttaacttccgtaaccctccctaccaacctacgtaccacggccaacggtccctaggaccgacgggtaccgtaaggtaaagtacgttagggtaccggtacttaagggttttaacttaccgtcgttacaacggtaactaaacttacgtttaacttacctttccgtttacgtacccgttaacggtttccggggaaccgggtacgggtaaccgtaaagggtacgggaaacgtaacgtaacccggtaaaaacggtacggttacggtacgggtaccgtacggtaccctaaccgttaacttccgtacgtttccctacgttaacccc

SEQ ID NO: 63509 - DNA, 520 bp, Homo sapiens
  misc_feature: GYAE6OF01A1J9I.31.78.H01.1.454.CMB.1.raw
  modified_base (411)..(411): a, c, t, g, unknown or other
  misc_feature (411)..(411): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctacctaaactcctgatttactgggcttctacccgggcactccggggttcctaaccgattcattggcagcggtctgggaccgatttcactctcaccatcagcagcctgcagctgaagatgnggctagtttatactgtcagcaatattatacttctttacgtctactttcggacggtacggaccaggtgagatacgaaacgtatggtgctgactaccattctgtcttctac

SEQ ID NO: 63510 - DNA, 559 bp, Homo sapiens
  misc_feature: GYAE6OF01A17ZQ.31.78.H01.1.454.CMB.1.raw
  modified_base (441)..(441): a, c, t, g, unknown or other
  misc_feature (441)..(441): n is a, c, g, or t
  modified_base (469)..(469): a, c, t, g, unknown or other
  misc_feature (469)..(469): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacaactacttagcttggtaccagcaagaaagtaggacagccctacctaaactcctgactttacgtgggtccttccgtacccgggctacgttcccgggggtttaccctaaaccgtattccaagtttcggctaggcgggtctggggacccgtatttccactctcaccatcagcagcctgcaggctagaagntgtggctagtttatactgtcagcaactnttaattacttcttcgtactacgtttcggcggacggaccgaaggtgacgatacgaaacgtactggtcgctgacctacatctcgtcttctac

SEQ ID NO: 63511 - DNA, 614 bp, Homo sapiens
  misc_feature: GYAE6OF01EH7HD.31.78.H01.1.454.CMB.1.raw
  modified_base (440)..(440): a, c, t, g, unknown or other
  misc_feature (440)..(440): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagttgttttattcggccccaacaataacaactacttagcttggtaccagcaagaaagtaggacagccctacctaaactcctagtactttacgtgggcttccgtacccgggctacgttccggggttacctaaccggattcagttcggcaggcgggtcgtacgggaccgtatttccactctccaaccatcagcagccctgcaggctagaaagngtggtacgctagttttacttactgtcaagtaccaatattaattacctttctttccgttacttaccgtttcgggacgggtaacgggtaccgtaaagggtggaaagtacgttaacgaaaacggtacgttggtcggacgtcgaacctacctacttaccgtcgttccttcgtaacccg

SEQ ID NO: 63512 - DNA, 755 bp, Homo sapiens
  misc_feature: GYAE6OF01ACCRT.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacaactacttagcttggtaccagcagaaagtaggacagcctcctaaactcctgtatttacgtggggtcctttccgtaccccgggctaacgttcccgggggtttaccctaaaccggtatttccaagtttcgggcctaagggtccggggttcttacggggacccgtacttttccgaaccttcctaccgaaccctattcccgaaggtcccgaacggccccgttaggaccgtaacgggtccgttaggaaaggtagttcggttacgggaccttaaggtttttaacttaccgttggttaccaaggtacctaaaccgttacttttaacttaacccttttaccgttttaccggttacccttaaccggtttttcccggggacggggtaacggggtaacccgtaaggggttcgggtaaacgtaacgttaaccgaaaaccggtaacgttcgggttacgggtaccgttacggacccgtaacccgtagttacccgttcggttcctttccgtaaccg

SEQ ID NO: 63513 - DNA, 553 bp, Homo sapiens
  misc_feature: GYAE6OF01ASZ5Z.31.78.H01.1.454.CMB.1.raw
  modified_base (537)..(537): a, c, t, g, unknown or other
  misc_feature (537)..(537): n is a, c, g, or t
  modified_base (543)..(543): a, c, t, g, unknown or other
  misc_feature (543)..(543): n is a, c, g, or t
tcagcagtagacgtcacgaccggtgctcgatttagtgtgagtagtttgggtttgggggagctacaacaggcaggcaggggcagcaagatggtgttgcagacccaggtctccatttctctgttgctctggatctctggtgcctacggggacatcgtgatgagccagtttccagactccctggctgtgtctcgtgggcgagagggccacatcaactgcaagtccagccagagttgttttattcggccccaacaataacaactacttagcttggtaccagcagaaagtaggacagcctacctaaactcctagatttactgggcttccgtacccgggctacttcccggggttacctaaccgattcattggcaggcgggtctgggaccgtatttccactctcacctatcagcagcctgcgaggctacggaagtagtgtggactagtttattactgtacagctaactattactactttcttcgtctacgtttcggcggaggaccgtaaggtgagtatacgaaacgtatggtcgctagctaccntacctntcttctaccg

SEQ ID NO: 63514 - DNA, 863 bp, Homo sapiens
  misc_feature: GYAE6OF01DYDUJ.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagacgggccaccatcaactgacaagtccagccagagttgttttatcggccccacaataacaactacttagcttggtaccagcaagaaagtaggacagcctacctaaactcctagtactttacgtgggtctttccgtacccgggctacggttcccggggttaccctaaaccggtatttccaagtttcgggacctaagggtccggggttcgtacgggggtaacccgtaattttccgaaccttccgtaccaaccccgtaattccgaaacggtccaacggtccccgttacggaccgtaacggggtaccgttaagggtaaacggtaacgttgggttacgggtacgtttaacggttttttaaacgttttaaccgtttacggttacccgtaaacggtaacctaaaaccgttaaactttttaaacgttttaaccctttttacccgttttttacccggttaaccgtttaacccgggttttttacccgggggaacccgggggttaaccggggggtaaaccccggtaaaacgggggtttaacggggtaaaacggttaaaccggttaaacccggtaaaaaacccggttaaaccggtttaggggttaccgggtaccgttacggtaacccgtaacccgttaacgttacccgtttacgggtttccctttaccgttaacccg

SEQ ID NO: 63515 - DNA, 686 bp, Homo sapiens
  misc_feature: GYAE6OF01BGMYO.31.78.H01.1.454.CMB.1.raw
  modified_base (322)..(322): a, c, t, g, unknown or other
  misc_feature (322)..(322): n is a, c, g, or t
  modified_base (337)..(337): a, c, t, g, unknown or other
  misc_feature (337)..(337): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgaggacgggccaccatcaactgacaagtccagccagtagttgttttattcggaccccaacaataacaactactagcttggtaccagacagaaagtggacagcctactaactcctagtactttacgnggtccttcgaccggntacgtcccgggttacctaaccgtattcgagttcggacacgggtcgggtcgtacggggaccgtatttccgaccttccgtaccaacctactaccgacgtccgtacgtccctaggccgtagggtctacggaaagtacgttggtcggtacttaagttttacttacgtcgtacacgtactaactactttacttactttcgtttaccgtaccgttaccggtttacgggaccgggtaacgggtaaccgtaaggggtacggtaacgtaacgtaaaccgtaaacggtaaccggttcggtacggtacctcggaaccctaaccgttacgttaccgttaccgttccgtttaccgtaccccg

SEQ ID NO: 63516 - DNA, 580 bp, Homo sapiens
  misc_feature: GYAE6OF01D3HUF.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagttccagactccctggctgtgtctctgggcgagagggccaccatcaactgcaagtccagccagtagtgttttattcggccccacaataacaactacttagcttggtaccagcaagaaagtaggacagccctacctaaactcctagtatttacgtcgggtccttccgtaccccgggctacgttcccgggggtttaccctaaccggtattccagttcggcacggcggggttctggggaccgtatttccactctcaccatcagcacgcctgacgaggctagaagagtggtacggtacttaggttttacttacgtgtacagactaactattacttactttctttcgtctacgtttcggcggaggaccgtaagggtagagtatacgaaacgtatggtcgctcgactacatctgttctctac

SEQ ID NO: 63517 - DNA, 782 bp, Homo sapiens
  misc_feature: GYAE6OF01EE07X.31.78.H01.1.454.CMB.1.raw
  modified_base (374)..(374): a, c, t, g, unknown or other
  misc_feature (374)..(374): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgaggacgggccaccatcaactgacaagtccagccagtagttgttttattcggaccccaacaataacaactacttagcttggtaccagcaagaaagtaggacagtcctactaaactcctagtactttacgtgggtccttccgtacccgggctacgttcccggggttacctaaaccggtntttaccgagtttcggacgtacgggtccggggttctacgggggaaccctattttccgaacctttccgtacctaaccccgtaattcccgaacggtcccgtaacggtaccccgttacggacccgtaacgggtaccgttaaggtaaacggtaacgttacgggtacgggtaccgtttaacggtttttaactttaccgttacggttaccgtaacggtaacccttaaaccttaacgttttaactttaaccgttttaccgttttaccggttaccgttaaccggtttttaccgggacgggtaaccggggtaaccgtaaggggttacggtaacgtaacgttaaccgtaaaaccggttaacgttcgggtacggtacgtcggaccgtacctacgttaccgttcggttccttacgtacccg

SEQ ID NO: 63518 - DNA, 530 bp, Homo sapiens
  misc_feature: GYAE6OF01A90FK.31.78.H01.1.454.CMB.1.raw
  modified_base (349)..(349): a, c, t, g, unknown or other
  misc_feature (349)..(349): n is a, c, g, or t
  modified_base (411)..(411): a, c, t, g, unknown or other
  misc_feature (411)..(411): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttactgggtcttctacccgggcacgtccggggttcctaaccgnttcattggcagcgggtctgggaccgatttcactctcaccatcagcagcctgcaggctgaagntgtggctagtttattctgtcagcaactattattacttctttcgtctacgtttcggcggtacgggaccaagggtcggagatacgaaacgtatggtcggctcgcaccattctgtcttctac

SEQ ID NO: 63519 - DNA, 696 bp, Homo sapiens
  misc_feature: GYAE6OF01C044J.31.78.H01.1.454.CMB.1.raw
  modified_base (374)..(374): a, c, t, g, unknown or other
  misc_feature (374)..(374): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgacgcctagtttccagacctcccgtggctgtcgtctcgtgggcgaggacggccaacatcaactgacaagtccagcagtagttgtttatcggacccaacaataacaactacttagcttacggtacagacaagaaacgtaggacacgacctacctaaactcctagtacttacgtggtcttaccgtaccggctacgtcccggggttacctaaaccgtnttacgtagttcggacgacggtccggggtacgtacggggtaacccttactttccaacgtcctaccgaacctaacgtacaacggccgacgtccctaggccgaacgggacgtaaggaaacgtaggtggtaggtactttaagttttaagtactcgtacaacgtaactaacgttaactttagttaacctttcgtttaccgtacgttaaccgtttacgggaacgggtaacgggaacccgtaagggtacggaaactacgtaaacggaaacgttaacggtcggtacgggtctacgaacccgtaactacgttacgtcgttcgttctacccg

SEQ ID NO: 63520 - DNA, 637 bp, Homo sapiens
  misc_feature: GYAE6OF01BC7LW.31.78.H01.1.454.CMB.1.raw
  modified_base (333)..(333): a, c, t, g, unknown or other
  misc_feature (333)..(333): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagacctccctggctgtgtctcgtgggcgaggacgggccaccatcaactgacaagtccagccagtagttgttttattcggaccccaactaataacaactacttagcttaggtaccagacaagaaagtaggacacgccctacctaaactcctagtactttacgnggtccttccgtacccgggctacggttcccggggttacctaaccgtattcgagttcggacgaggtccggggtcgtacggggaccctatttccgacttcctacaacctagtacacgccacgtcctgcgaggctaggaagtgtggtcggtacttagtttactacgtgtactaagtacctaactatttacttacctttcgtttacgtccttacggttcgggacggtacggtaccgtaagggtcgaagtacgtaacgaaacgtacgttggtcgcgtacgacctaactcgttacttcgttcctctacccg

SEQ ID NO: 63521 - DNA, 524 bp, Homo sapiens
  misc_feature: GYAE6OF01CQUN2.31.78.H01.1.454.CMB.1.raw
  modified_base (311)..(311): a, c, t, g, unknown or other
  misc_feature (311)..(311): n is a, c, g, or t
  modified_base (326)..(326): a, c, t, g, unknown or other
  misc_feature (326)..(326): n is a, c, g, or t
  modified_base (410)..(410): a, c, t, g, unknown or other
  misc_feature (410)..(410): n is a, c, g, or t
  modified_base (518)..(518): a, c, t, g, unknown or other
  misc_feature (518)..(518): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttacngggcttctacccggnacgtccgggttcctaacgattcattggcaggcggtctgggaccgtattcactctcaccatcagcagcctgcaggctgaagatgnggctagtttattactgtcagcaactattactactttctttacgtctacgtttcggacggtaggacctaaggtggagatacgaaacgagtggtgctgcacatctcgttntctacg

SEQ ID NO: 63522 - DNA, 577 bp, Homo sapiens
  misc_feature: GYAE6OF01EBAJ5.31.78.H01.1.454.CMB.1.raw
  modified_base (429)..(429): a, c, t, g, unknown or other
  misc_feature (429)..(429): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagttgttttattcggccccacaataacaactacttagcttggtaccagcaagaaagtaggacagcctacctaaactcctagtatttacgtgggccttccgtacccgggctacgttcccggggttacctaaccgattcagttggcaggcgggtctgggaccgtatttcactctcaccatcagcagcctgcaggctagaagntgtggctagtttatactgtacagacaactatttacttactttctttcgtcttacgtttcgggacggtacgggacctaagggtcggaagtatacgaaaacgtacgttggtcggcgtaggaccctaaccgattccgtcgttccttctacc

SEQ ID NO: 63523 - DNA, 537 bp, Homo sapiens
  misc_feature: GYAE6OF01CTEOZ.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacaactacttagcttggtaccagcagaaagtaggacagcctcctaaactcctgtatttactgggcttcgtacccgggctacgttccggggttcctaaccgattcattggcagcgggtctgggaccgtattcactctcaccatcagcagcctgcaggctgaagatgtggctagtttattactgtcagcaactatttatacttctttcgtctacgtttcgggacggtagggaccaagggtggagtatacgaaacgtatggtggctgacctaccatctcgtcttctac

SEQ ID NO: 63524 - DNA, 801 bp, Homo sapiens
  misc_feature: GYAE6OF01E6CAV.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgacaagtccagccagtagttgttttattcggaccccaacaataacaactacttagcttggtaccagacaagaaagtaggacacgcctacctaaactcctagtactttacgtcgggtcctttccgtaccccgggtcctacgttccccgggggtttaccctaaaccggtactttaccgtacgtttcgggaccgtaacgggtccgggggttaccgttacgggggtaaccccgtacttttaccgaaccttccttacccaacccctaagttaccgaacggtccaacggtcccgtaggaccgtaagggtcctagggaaagtacgttcggttacgggtaccttaaggttttaacttaaccgttacggttaccaacggtacctaaacttaacttttaactttaaccttttaccgttttccgttaccgttaaccggttttccggggaccggggtaacggggtaacccgtaaaggggttacgggtaaacggtaaacgttaaccgtaaaaccggtaacggttcgggttacgggtaccgttacggaccctaacccgtacgtttacccgttcggtttacccgtttacccgttaaccccg

SEQ ID NO: 63525 - DNA, 663 bp, Homo sapiens
  misc_feature: GYAE6OF01B9RNP.31.78.H01.1.454.CMB.1.raw
  modified_base (178)..(178): a, c, t, g, unknown or other
  misc_feature (178)..(178): n is a, c, g, or t
  modified_base (297)..(297): a, c, t, g, unknown or other
  misc_feature (297)..(297): n is a, c, g, or t
  modified_base (325)..(325): a, c, t, g, unknown or other
  misc_feature (325)..(325): n is a, c, g, or t
  modified_base (340)..(340): a, c, t, g, unknown or other
  misc_feature (340)..(340): n is a, c, g, or t
tcagcagtagacgtcacgaccggtgctcgatttagtgtgagtagtttgggtttgggggagctacaacaggcaggcagggcagcaagatggtgttgcagacccaggtcttcatttctctgttgctctggatcgtctggtgccgtacgggacagtcgtgatgagccagtttcagactccnggctgtgtctcgtgggcgagagggccaacgatcgaaacgtgacaagtccagccagtgttgtttactcggccctacaagtaacaacttactagcttggtaccagacaagaaagtcggacncgacctactaaactcctagactttacgngggctttcgaccggntagttccgggtacaacgtattcgattggctaggtccgggtactcggggaacccgtattttccgacgtttcctacccgaaacgtagttacccaggtacctaacgtacccgttcggaccgtacgggacgttacggaaacggtaacgttacggttacggtacgtaaggttttaacgttacgttacggtacaacggtactaacgttatttacttacgtttcgttacgttcgtacgtttcggacggtacggaactaagggtagacggacgtaccgaaacggtacgtacggtcgactcgactaccgtactcgttcgtccgtcgtaaccg

SEQ ID NO: 63526 - DNA, 650 bp, Homo sapiens
  misc_feature: GYAE6OF01ACVDA.31.78.H01.1.454.CMB.1.raw
  modified_base (377)..(377): a, c, t, g, unknown or other
  misc_feature (377)..(377): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgaggacggccaccatcaactgacaacgtccagccagagttgttttattcggaccccacaaataacaactacttagcttggaccagcaagaaagtaggacagccctacctaaactcctagtactttacgtgggtccttaccggtacccgggctaccggttccccggggttaccctaaccgtnttaccgagtttcggacgacggtcggggtccgtcggggtaaccgtacttttccaccttcctaccaaccctatccacgcacgtccgtagaccgaggcctagaagtagtggtcgtacgttagttttacgtacgtcgtacgacgactaacgttatttacttacttcgtttcgtacgttacgttcgggaacggtacgggaaccgtagggtgacgtactaacgaaacgtaggtcggtacggtcctagaccctactacttacctcgttccttcgtacccg

SEQ ID NO: 63527 - DNA, 600 bp, Homo sapiens
  misc_feature: GYAE6OF01EZ4D1.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcaagaaagtaggacagcctcctaaactcctgatttacgtgggcttcctacccgggcacgttcccggggttcctaaccggattccagttggcagcgggtctgggacctatttcactctcaccatcagcagcctgcaggctagaagatgtgctagtttacttactgtcagtactaactattagttactttccgtttcgtaccttaccgttttccgggacgggtaacgggtaccgaaacgggttggaacggtaacttaaccgaaaaccgtaacgttggtacggacctagacccgtaacctacgttaccgttcgttccgttcttaacccg

SEQ ID NO: 63528 - DNA, 567 bp, Homo sapiens
  misc_feature: GYAE6OF01B48J6.31.78.H01.1.454.CMB.1.raw
  modified_base (311)..(311): a, c, t, g, unknown or other
  misc_feature (311)..(311): n is a, c, g, or t
  modified_base (412)..(412): a, c, t, g, unknown or other
  misc_feature (412)..(412): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtggacagcctcctaaactcctgatttacgngggcttcgtacccgggcacgtccggggttcctaaccgattcattggcagcgggtctgggaccgatttcactctccaccatcagcagcctgcaggctgaagntgtggctagtttatactgtcagcaatattactacttcttcgtctacgtttcgggacggtacggaccgtaagggtacggagtattaccgaaacggtaacgttaggtcgggacctcggaccctaaccctacgttaccgttcgttcccttcgttaccg

SEQ ID NO: 63529 - DNA, 590 bp, Homo sapiens
  misc_feature: GYAE6OF01A6VOV.31.78.H01.1.454.CMB.1.raw
  modified_base (324)..(324): a, c, t, g, unknown or other
  misc_feature (324)..(324): n is a, c, g, or t
  modified_base (342)..(342): a, c, t, g, unknown or other
  misc_feature (342)..(342): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagactccctggctgtgtctcgtgggcgaggacgggccaccatcaactgcaagtccagccagagttgttttattcggaccccaacaataacaactacttagcttggaccagcaagaaagtggacagaccctcctaaactcctagtactttacgngggtcttccgtaccgggntacgttcccggggttacctaaccgtattccagttcggctaggccgggtctcggggacctatttccgacttcacaaccatcgagccacgcctcgcgacggctagaagagtggtggactagtttattacgtgtacagactaactattaacttacttctttcgtctacgtttcggacgggtacggaaccgtaaggtaggagtactaacgaaacgtacgtggtcggctcgactactatctcgtcttcgtacc

SEQ ID NO: 63530 - DNA, 539 bp, Homo sapiens
  misc_feature: GYAE6OF01ESHXV.31.78.H01.1.454.CMB.1.raw
  modified_base (230)..(230): a, c, t, g, unknown or other
  misc_feature (230)..(230): n is a, c, g, or t
  modified_base (429)..(429): a, c, t, g, unknown or other
  misc_feature (429)..(429): n is a, c, g, or t
  modified_base (527)..(527): a, c, t, g, unknown or other
  misc_feature (527)..(527): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactcccgtggctgtgtctctgggcgagagggccaccatcaactgcaagtccagccagngtgtttattggccccacaatacaactactagcttgtaccagcagaaagtaggacagtccctacctaaaactcctagtactttacgtggggcctttccgtaccccggggcacgttcccggggttcctaaaccgattccattcggcagcgggtctgggaccgtatttcactctcaccatcagcagcctgcaggctagaagntgtgctagtttatctgtcagcaactattatacttctttcgtctacgtttcggcggaggaccaaggtgagatacgaaacgtactgtcggctgacctacntctgtctcgtac

SEQ ID NO: 63531 - DNA, 882 bp, Homo sapiens
  misc_feature: GYAE6OF01BUYDQ.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctcgtgggcgagaggccaccatcaactgcaagtccagccagtagttgttttattcggccccacaataacaactacttagcttaggtaccagcaagaaagtaggacagcctacctaaactcctagactttacgtgggtccttccgtaccccgggctaacggttccccgggggtttaccctaaacccggtatttaccgaagtttcgggacctaacggggtcccgggggttaccgttacgggggtaaccccgttaagtttttcccgaaccctttcccgttaccctaaacccctaacgtttcccgaacggtacccgtaaccggtccccgttacgggacccgtaacggggtacccgttaagggtaaaacggtaacggtttacgggttacgggtaccgtttaaggtttttaaacgtttaaccgtttacggttaccgtaacggtaacctaaaaccgttaacttttaaaccttttaacccgtttttacccgtttttaccggttacccgtttaacccgggttttttacccggggaccgggggttaaccgggggtaaacccggtaaagggggttaacgggtaaacggtaaacgttaacccggtaaaaaccggtaaaccggtttacgggttaccgggtaccgttacggtaacccgtaacccgttaacgtttacccgtttaccggttccctttacccgttaacccg

SEQ ID NO: 63532 - DNA, 536 bp, Homo sapiens
  misc_feature: GYAE6OF01A3YF7.31.78.H01.1.454.CMB.1.raw
  modified_base (532)..(532): a, c, t, g, unknown or other
  misc_feature (532)..(532): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttatttcggccccaccaataacaactacttagcttggtaccagcagaaagtaggacagcctcctaaactcctgatttactgggcttctacccgggcacgtccggggttcctaaccgattcattggcagcggtctgggaccgatttcactctcaccatcagcagcctgcaggctgaagatgtggctagtttatactgtcagcaactattattaccttctttacgtctacgtttcggacgggtagggacctaagggtggagataccgaaacgacttggtggctgctacatctgtccttntacc

SEQ ID NO: 63533 - DNA, 579 bp, Homo sapiens
  misc_feature: GYAE6OF01AUO3G.31.78.H01.1.454.CMB.1.raw
  modified_base (453)..(453): a, c, t, g, unknown or other
  misc_feature (453)..(453): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacaactacttagcttggtaccagcagaaagtaggacagcctacctaaactcctagatttacgtgggtcctttccgtacccgggctacgttcccgggggtttaccctaaaccgtatttaccagtttcgggctaaggtccggggtcgtggggaacccgtatttccactcctacaccatcagcacgcctgacgaggctagaagntgtggctaagtttatacgtgtacagtacaactattatactttcttcgtctacgttcggaggacgggtacaggtgagactacgaaacgtacgtggtcgactgactactagtcttcgtccttcgtacg

SEQ ID NO: 63534 - DNA, 879 bp, Homo sapiens
  misc_feature: GYAE6OF01EJO9R.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctctgggcgagagggccaccatcaactgcaagtccagccagagtgtttattcggccccacaataacaactacttagcttggtaccagcaagaaagtaggacacgccctacctaaactcctagtactttacgtgggtcctttccgtacccgggctacgttccccggggtttaccctaaacccggtatttaccgagtttcgggaccaagggtcccgggggttaccgttagggggtaaccccgtaagtttttacccgaacccttccgttacccaaaccctaacgtttcccaacgggtaccaacggtccccttaggacccgtaacggggtcccttaagggaaaacggtagttacgggttacgggtaccgtttaaaggtttttaacctttaaaccgttgggttacccaacggtaaccctaaacctttaacttttaacgttttaccctttttacccgtttttaccgggttaccctttaacccgggtttttacccggggaacccgggggttaacgggggtaaaccccgtaaaagggggttaccgggtaaacgggttaaaccgttaaacccggaaaaaaccgggttaaacccggtttagggttaccgggggttaaccccgttaccgggaaccccgttaaacccccgtaacgtttaccccggtttaacggttttaccccgttttaacccgttaaccccgg

SEQ ID NO: 63535 - DNA, 497 bp, Homo sapiens
  misc_feature: GYAE6OF01EPW4W.31.78.H01.1.454.CMB.1.raw
  modified_base (236)..(236): a, c, t, g, unknown or other
  misc_feature (236)..(236): n is a, c, g, or t
  modified_base (242)..(242): a, c, t, g, unknown or other
  misc_feature (242)..(242): n is a, c, g, or t
  modified_base (256)..(256): a, c, t, g, unknown or other
  misc_feature (256)..(256): n is a, c, g, or t
  modified_base (286)..(286): a, c, t, g, unknown or other
  misc_feature (286)..(286): n is a, c, g, or t
  modified_base (311)..(311): a, c, t, g, unknown or other
  misc_feature (311)..(311): n is a, c, g, or t
  modified_base (326)..(326): a, c, t, g, unknown or other
  misc_feature (326)..(326): n is a, c, g, or t
  modified_base (345)..(345): a, c, t, g, unknown or other
  misc_feature (345)..(345): n is a, c, g, or t
  modified_base (348)..(348): a, c, t, g, unknown or other
  misc_feature (348)..(348): n is a, c, g, or t
  modified_base (354)..(354): a, c, t, g, unknown or other
  misc_feature (354)..(354): n is a, c, g, or t
  modified_base (360)..(360): a, c, t, g, unknown or other
  misc_feature (360)..(360): n is a, c, g, or t
  modified_base (368)..(368): a, c, t, g, unknown or other
  misc_feature (368)..(368): n is a, c, g, or t
  modified_base (376)..(376): a, c, t, g, unknown or other
  misc_feature (376)..(376): n is a, c, g, or t
  modified_base (387)..(387): a, c, t, g, unknown or other
  misc_feature (387)..(387): n is a, c, g, or t
  modified_base (389)..(389): a, c, t, g, unknown or other
  misc_feature (389)..(389): n is a, c, g, or t
  modified_base (391)..(391): a, c, t, g, unknown or other
  misc_feature (391)..(391): n is a, c, g, or t
  modified_base (393)..(393): a, c, t, g, unknown or other
  misc_feature (393)..(393): n is a, c, g, or t
  modified_base (395)..(395): a, c, t, g, unknown or other
  misc_feature (395)..(395): n is a, c, g, or t
  modified_base (397)..(397): a, c, t, g, unknown or other
  misc_feature (397)..(397): n is a, c, g, or t
  modified_base (399)..(399): a, c, t, g, unknown or other
  misc_feature (399)..(399): n is a, c, g, or t
  modified_base (410)..(410): a, c, t, g, unknown or other
  misc_feature (410)..(410): n is a, c, g, or t
  modified_base (417)..(417): a, c, t, g, unknown or other
  misc_feature (417)..(417): n is a, c, g, or t
  modified_base (419)..(419): a, c, t, g, unknown or other
  misc_feature (419)..(419): n is a, c, g, or t
  modified_base (421)..(422): a, c, t, g, unknown or other
  misc_feature (421)..(422): n is a, c, g, or t
  modified_base (473)..(473): a, c, t, g, unknown or other
  misc_feature (473)..(473): n is a, c, g, or t
  modified_base (479)..(479): a, c, t, g, unknown or other
  misc_feature (479)..(479): n is a, c, g, or t
  modified_base (489)..(489): a, c, t, g, unknown or other
  misc_feature (489)..(489): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagtttccagacctccctggctgtgtctctggcgcggcggtcggaccaaggtccactgtacgagccagcaagngtgttntcgacccacaatanaactattagcttgaccagcaagaagtgacngacctctaaactccagtacttacgngggccttacgccggntacgtccgggtactaacgntcntgcagnggtacngggaactnttcattcncgacagtccancncncncncngnagagatgtgtntattatntntnnatatatatacttcttctctcgtcgacgagagtagtagagagacgacgtagngtcgcncactacactntctctctc

SEQ ID NO: 63536 - DNA, 523 bp, Homo sapiens
  misc_feature: GYAE6OF01A9NS0.31.78.H01.1.454.CMB.1.raw
  modified_base (515)..(515): a, c, t, g, unknown or other
  misc_feature (515)..(515): n is a, c, g, or t
  modified_base (521)..(521): a, c, t, g, unknown or other
  misc_feature (521)..(521): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttactgggcttctacccgggcactccggggttcctaaccgattcattcggcagcgggtctgggaccgtatttcactctcaccatcagcagcctgcaggctgaagatgtggctagtttatactgtcagcaacatttatactttctttcgtcctactttcggcggtaggaccaagggtgagatacgaaacgactgtgctgacctaccatcngtcttnac

SEQ ID NO: 63537 - DNA, 619 bp, Homo sapiens
  misc_feature: GYAE6OF01B5E2A.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggccccaacaataacaactacttagcttggtaccagcaagaaagtaggacagccctacctaaactccctgtacttttacgtggggtcctttccgtaccccgggctacgttccccgggggtttaccctaaacccggatttccgaagtttcggacgtaacggtccggggttctacggggaacccgtattttccgaacttctaccgaaccctatccacgcagcccgtgccagggctaggaaacgagtggtggactaggttttattacgtgtcagcaaactatttaactacctttcgtttcgttactacgtttcgggcggtaggaccgaaggtggagactacgaaacgtacgtggtcgctgctaccattctgttcttctacg

SEQ ID NO: 63538 - DNA, 770 bp, Homo sapiens
  misc_feature: GYAE6OF01D5JEQ.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacgggacatcgtgatgagcctagttccagacctccctggctgtgtctcgtgggcgagacgggccaccatcaactgacaagtccagccagtattgttttacttcggaccccaacaataacaactacttagcttggtaccagacaagaaagtacggacacgtccctactaaactctagtacttacgtggtcttccgaccggctacggttcccggggttacctaacccgtattctacgttcggacgtacgggtcggggttacgtcggggtaacccgttacttttaccgacccgttcctaccctaccctaacgttccgaacgtccacggtacccgtacggaccggaaggtaccgttaaggaaacggtagttcgggtacggtacgttaagttttaaccgttacgtacggtaacgaacgtaaccgtaaacttaacgtttaactttaccttttaccgtttaccgttaccgtttaacccggttttcggggaccgggttaacgggggtaaccccgtaaaggggttacgggtaaactaaccggtaaaccgtaaaccgggtaaccgttagggtaccggaccgttacggaacccctaaccggtacgtttaccttcgggtttccctttacgttaaccccg

SEQ ID NO: 63539 - DNA, 612 bp, Homo sapiens
  misc_feature: GYAE6OF01C3JVR.31.78.H01.1.454.CMB.1.raw
  modified_base (325)..(325): a, c, t, g, unknown or other
  misc_feature (325)..(325): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagaggccaccatcaactgcaagtccagccagtagttgttttattcggacccctaaccaataaaccaactacttagcttggtaccagacaagaaagtaggacagcctacctaaactcctgtatttacgngggtccttccgacccgggctacggttcccggggttacctaaccggtattcaagttcggcaggtcgggtcgtagggaccgtatttcgacctctcaccatcacgcacgcctgccgagctagaagactggtcggactagtttacttacgtgtacagactaactatttactactttcttacgtctacgtttcggacgggtaggaccgtaaggtcggaagtacgtaacgaaaacggtaacgttggtacggcgttacgacctaccgtacttccgttcgttcttaccgtacccg

SEQ ID NO: 63540 - DNA, 919 bp, Homo sapiens
  misc_feature: GYAE6OF01C3VGR.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagacctcccgtggctgtgtctcgtgggcgaggacgggccaccatcaactgacaacgtccagccagtacgttgttttacttccggaccccaaccaataaaccaacttacttagcgttaggtaaccagacaagaaagtacggacacgtccctacctaaactcctatactttacgtcggtccttaccgtacccgggctaccggttcccggggttaccctaaccggtacttacgtacgttcggaccgtacggggtcccgggttaccgtacggggtaaccccgttagttttcccgaaccctttcccgtaaccctaacccgtaacgttaccggaacggacccgtaacgtccccggttaggacccggtaacggggtacccttaagggaaacggttacgttacggggttacgggtaacccgttttaaaggttttttaaccgttaccggttacggttaacccgtaacggttaacccttaaaaccgttttaaactttttaacccgtttaaccgttttttacccccggtttttaaccgggttacccgtttaacccggggttttcccggggggaaacccgggggttaaccggggttaaacccggttaagggggttaccgggaaacggttaaaacccgttaaacccgggtaaaaaaccgggttaccggttacggggttaaccgggtaccttacccgggaaaccccttaacccgttaccgtttacccggtttaccgttacccgttttacccgtaacccccgg

SEQ ID NO: 63541 - DNA, 798 bp, Homo sapiens
  misc_feature: GYAE6OF01A0RBM.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgaggcgggccaccatcaactgcaagtccagccagagttgttttattcggccccacaataacaactacttagcttggtaccagacaagaaagtaggacacgccctacctaaactcctagtactttacgtcgggtccttaccgtaccccgggctacggttcccggggtttaccctaaaccggtacttactagttcggaccaacgggtccggggttcgtcgggggacccgttacgttttccaccttccgtaccaaccctattccgacggtcctacgcccgttcggaccgaacggtccgtaaggaaacggtagttcgggttacgggacctttaaggttttaacgttaaccgttcggttaaccgtaagtaccgtaaacgttaacgttttaactttaacccgtttttaccgttttacccggttaccttaccgggtttttaccggggaaccggggtaaccgggttaaccggtaaacgggggttacgggaaaccggttaaacgttaaacccgggtaaaaccggttaaccgttacggggttaccggtaccgttaccggaacccgttaaccgtaacgtttaccgtttaccggttaccctttaccgttaacccg

SEQ ID NO: 63542 - DNA, 549 bp, Homo sapiens
  misc_feature: GYAE6OF01EWU9X.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttgtaccagcagaaagtaggacagcctcctaaactcctgatttactgggcttcgtacccgggcagtccggggttcctaaccgattcattggcagcgggtctgggacctatttccactctcaccatcagcagcctgcaggctgaagatgtggctagtttattactgtcagacaatatttatactttcgtttcgtctaccgtttcggcggtacgggacctaagggtcggaacgataccgaaacgtaacgtggtcggctacgactaccgtattctcgttccttctacc

SEQ ID NO: 63543 - DNA, 551 bp, Homo sapiens
  misc_feature: GYAE6OF01CY6VJ.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactcctggctgtgtctcgtgggcgagagggccaccatcaactgcaagtccagccagagttgttttattcggccccacaataacactacttagcttggtaccagcagaaagtaggacacgcctacctaaactcctgtatttactgggccttcgtacccgggcacgttccggggttaccctaaccgattctattcggcgacgcgggtctgggaccgtattcgactctcaccatcacgcagcctgcgacgcgtagaacgatgtggctagtttattactgtcagacaactattatacttactttcgtctacgtttcggcggaggacgtaaggtggatagtacgaaacgtatcggtggctagacctacactctcgtcttctacc

SEQ ID NO: 63544 - DNA, 676 bp, Homo sapiens
  misc_feature: GYAE6OF01AZSDE.31.78.H01.1.454.CMB.1.raw
  modified_base (326)..(326): a, c, t, g, unknown or other
  misc_feature (326)..(326): n is a, c, g, or t
  modified_base (343)..(343): a, c, t, g, unknown or other
  misc_feature (343)..(343): n is a, c, g, or t
  modified_base (366)..(366): a, c, t, g, unknown or other
  misc_feature (366)..(366): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagacctccctggctgtgtctcgtgggcgagacgggccaccatcaactgcaagtccagccagtagttgttttattcggccccaacaataacaactacttagctagtaccagcaagaaagtaggacacgccctacctaaactcctgtactttacgnggtcttccgacccgggnacgttcccgggttaccaaccgtnttcgagttcggctaggcgggtcgtcgggaccgtatttccgacttcctaccgaacctatccgaagccgacgtccctacgcgacggtctaggaaacgtagttggtcggtacttagttttaacttaccgtgtacgaactactaaactatttacttaacctttccgtttaccgttaccgttaccgttttaccgggaccgggtaacggggtaaccgtaaggggtaggtaaacggtaacgtaaccggtaaaaccggtaacgttacgggtacggtcgtacgaccctacctacgttcttaccgttcccttcgtacccg

SEQ ID NO: 63545 - DNA, 611 bp, Homo sapiens
  misc_feature: GYAE6OF01D11VF.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgaggagggccaccatcaactgcaagtccagccagagttgttttattcggccccacaaataacaactacttagcttggtaccagcaagaaagtaggacagccctacctaaactcctagtatttacgtcgggtctttccgacccgggctacgttcccgggggttacctaaaccgtattcaagtttcggctaggcgggtctggggacctagtttcactctcaccatcagcagcctgcaggctagaagatgtggtctagttttactacgtcgtacagtactaaactatttattaccttttcgtttaccgtcttacggtttccgggacggtaacgggtaaccgtaagggtcgaaggtaactaacgaaaacgtaccgtggtcggactcggacctaccgtattcgttacgtcttacgtaccg

SEQ ID NO: 63546 - DNA, 751 bp, Homo sapiens
  misc_feature: GYAE6OF01CA3Q3.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagaggccaccatcaactgcaagtccagccagtagtgttttattcggccccacaataacaactacttagcttgtaccagcagaaagtagacagcctacctaaactcctagtatttacgtgggtccttaccgtacccgggtactacggttccccggggtttaccctaaaccgtatttcctaacgtttcggacgacgggtccggggtccgtggggtaacccgtagttttccgaacttccgtaccaaccctaactaccgtaacgtccacggtaccccgttggacccgtagggtacctagggtaaaagtacgttagggtacggtaacttaaggtttttaacttaccgttgtaccgtaagacccttaaactattttaacttaaccttttcccgttttacgttacccttaaccggttttaccggggaccggtaacggggtaaccccgtaaggggttacgggtaaacgtaacgtaaccggttaaaaacccggtaagttcgggttacggacgttacgaccttaaacccctagtttaccgtccggtttaccttaccgttaacccg

SEQ ID NO: 63547 - DNA, 611 bp, Homo sapiens
  misc_feature: GYAE6OF01BBHFI.31.78.H01.1.454.CMB.1.raw
  modified_base (367)..(367): a, c, t, g, unknown or other
  misc_feature (367)..(367): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggccccacaaataacaactacttagcttggtaccagcaagaaagtaggacagccctacctaaactcctagtatttacgtgggtccttcgtaccccgggctacgtcccggggttaccctaaaccgtnttccagttcggcaggcgggtctggggaccgtactttcactcctacaccatcagcagcctgcgacggtctagaaagattggtcggactaggttttactactgtcctagactaactaatttacttacctttcgtttcgttacctacgtttcgggaccgggtaacgggaccgtaagggtacggtaagacgttaccgaaacggtacgtggtacggcgttacgacctactattctcgttcttcctaccg

SEQ ID NO: 63548 - DNA, 803 bp, Homo sapiens
  misc_feature: GYAE6OF01D1XWP.31.78.H01.1.454.CMB.1.raw
  modified_base (398)..(398): a, c, t, g, unknown or other
  misc_feature (398)..(398): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgacgcctagtttccagacctccctggctgtgtctcgtgggcgaggacgggccaccatacaactgaccaagtccagccgaagtagtttcgtttttacgttccggaccccctaacaaataaacctaacttacttacgtcttacggtaaccagacaagaaagtaggacagccctacctaaactcctagtactttacgtgggtcttaccgtaccggctacggttcccgggttacctaaccgtnttcgagttcggacgacgtcgggtcgtacgggacccgttatttccaccgttacctaccgtaaccctacgttaccaacggtcccgtacggtaccccgtaggaccgtaacgggtaccgttaggtaaacggtagttacgggtacggtaccgtttaagtttttacgttacgttcgtaccgtaacggttaacctaaaccgtttaagttttaacctttaaccgttttaccgttttacccggttaaccgtttacccgggttttacggggaaccggggttaaaccggggtaccggttaaagggggtacggtaaacggaaaccgtttaaaccggaaaaccggttaacggttcgggtaccggtaccgttaccggacctaccgttaattccgtttacggtttccttccgttaacccg

SEQ ID NO: 63549 - DNA, 596 bp, Homo sapiens
  misc_feature: GYAE6OF01BCYGD.31.78.H01.1.454.CMB.1.raw
  modified_base (328)..(328): a, c, t, g, unknown or other
  misc_feature (328)..(328): n is a, c, g, or t
  modified_base (344)..(344): a, c, t, g, unknown or other
  misc_feature (344)..(344): n is a, c, g, or t
  modified_base (384)..(384): a, c, t, g, unknown or other
  misc_feature (384)..(384): n is a, c, g, or t
  modified_base (463)..(463): a, c, t, g, unknown or other
  misc_feature (463)..(463): n is a, c, g, or t
  modified_base (580)..(580): a, c, t, g, unknown or other
  misc_feature (580)..(580): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttcagactcctggctgtgtctcgtgggcgaggagggccaccagtcaactgacaagtccagccagtagttgtttattcggacccacaataactaacgtacttagcttaggtaaccagacaagaaagtagacacgcctaccgtaactcctagtactttacgnggtcttccgacccggntacgtccgggttacctaacgtattcattggcgagcggtcncgggacctatttcactctacacatcagcagccctgccaggcctaggaaagtatggtacggacttagtttactactgtanacgactaatattacttactttcttacgtacttacggtttacgggcgggtaacggacgtaagggtgaaacgtaactaccggaaaacggtactgggtacggctacgactaccgtacttntcgttcgttactaccg

SEQ ID NO: 63550 - DNA, 679 bp, Homo sapiens
  misc_feature: GYAE6OF01DHDWO.31.78.H01.1.454.CMB.1.raw
  modified_base (376)..(376): a, c, t, g, unknown or other
  misc_feature (376)..(376): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctcgtggtgccgtacggggacatcgtgatgagccagtttccagacctccctggctgtcgtctcgtgggcgaggcggccacatcaactgacaacgtccagccagtagtttgttttacgtccggaccccaacaaataacaactacttagcttagaccagcaagaagtacggacagtccctacctaaactcctagtaactttacgcgggtctttaccgaccgggatacgttcccgggttaccaacgtnttcgacgttcggcgtaggtccgggtactacgggaccctatttccgacttccgtaccaacgacttaccgagcctaacgtcccgtaggacgacggtactaacggaagtaagtcggtaggtacttaaggtttaacttacgtcgtacacgtacaaacttatttacttaactttcgtttccgtacgttaccgttcgggacggtaacggaccgtaagggttcgaagtaacctaaacggaaaccgtaagttcggtacgtaccgtagtaaccctaccgttaacgttccgttacgttcccttcgttaacccg

SEQ ID NO: 63551 - DNA, 880 bp, Homo sapiens
  misc_feature: GYAE6OF01C3NQB.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgaggagggccaccatcaactgcaagtccagccagagttgttttattcggccccacaataacaactacttagcttggtaccagacaagaaagtaggacacgcctacctaaacctcctagtatttacgtgggtcctttcgtaccccgggctacgttcccggggttaccctaaaccggtactttcaacgtttggacctacgggtccggggttccgtcgggggtaacccgttattttccgaaccttcccttaccaaccccgtaattcccgaaaggtcctaaacggtcccccgtttagggaccccgtaacgggggtccctttaagggaaaacgggttagtttacgggggtttacgggtaccctttaaagggttttttttaaacctttaacccggttgggttaaccctaacgggtacccttaaaaactttaacgtttttaaacctttacccgttttttacccgtttttacccgggttaccgtttaaacccggtttttcccgggggaaccgggggtaaacgggggttaaaccccgtaaaagggggtttgggaaacgggttaaaccttaaacccgggaaaaaaccggttaaccggtttgggggttaaccggggtaccctttaacgggaaccccttaaaccccggttaagttttcccggtttaacggtttccccttttaacccgttaaaccccg

SEQ ID NO: 63552 - DNA, 537 bp, Homo sapiens
  misc_feature: GYAE6OF01BRMXT.31.78.H01.1.454.CMB.1.raw
  modified_base (350)..(350): a, c, t, g, unknown or other
  misc_feature (350)..(350): n is a, c, g, or t
  modified_base (413)..(413): a, c, t, g, unknown or other
  misc_feature (413)..(413): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacaactacttagcttggtaccagcagaaagtaggacagcctcctaaactcctgactttactgggcttcgtacccgggcagtccggggttcctaaccgnttcattggcagcgggtctgggaccgatttcactctcaccatcagcagcctgcaggctgaaagntgtggctagttttatactgtcagcaacatttactactttctttcgtctactttcgggcggtacgggtacaagggtggacgagtacgaaacgtaagtgtggactgactacatctgttcctgtacc

SEQ ID NO: 63553 - DNA, 542 bp, Homo sapiens
  misc_feature: GYAE6OF01A4JR6.31.78.H01.1.454.CMB.1.raw
  modified_base (313)..(313): a, c, t, g, unknown or other
  misc_feature (313)..(313): n is a, c, g, or t
  modified_base (330)..(330): a, c, t, g, unknown or other
  misc_feature (330)..(330): n is a, c, g, or t
  modified_base (349)..(349): a, c, t, g, unknown or other
  misc_feature (349)..(349): n is a, c, g, or t
  modified_base (393)..(393): a, c, t, g, unknown or other
  misc_feature (393)..(393): n is a, c, g, or t
  modified_base (525)..(525): a, c, t, g, unknown or other
  misc_feature (525)..(525): n is a, c, g, or t
  modified_base (538)..(538): a, c, t, g, unknown or other
  misc_feature (538)..(538): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagtgttttattcggccccacaataacaactacttagcttggtaccagcagaaagtaggacagcctcctaaactcctgatttacngggcttcgtacccgggnagtcccgggttcctaacgnttcattggcagcgggtctggggacccgtatttcgactctcaccntcagcagccctgcaggctgaagatgtgactagtttatacgtgtcagcaactattataccttcttcgttctacgtttcgggcggaggtaaccaagggtgagatacgaaacgtatggtcgacgtagctaaccgntacttctccgttntacc

SEQ ID NO: 63554 - DNA, 682 bp, Homo sapiens
  misc_feature: GYAE6OF01DRWLM.31.78.H01.1.454.CMB.1.raw
  modified_base (377)..(377): a, c, t, g, unknown or other
  misc_feature (377)..(377): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagttccagactccctggctgtgtctcgtgggcgaggacgggccaccatcaactgacaacgtccagccagtagttgttttattcggaccccacaaataacaactacttagcttacggtaccagacaagaaagtaggaacacgcctacctaaactctagtatttacgtgggccttccgacccgggctacggttcccggggttacctaaaccgtnttaccgagtttcggacgtacggtcggggtcgtcggggaccttatttccactcctacaacctatcaagccacgcctgacgaggtctagaacgagtggtacggtacttaagtttacgttacgtgtacgagtacctaatatttaacttactttacctttaccgtacgttaccggtttcggggaccgggtaacgggtaaccgtaagggtaggtaacgaacgttaaccgtaaaaacggtaacgttcgggtacggtacctacggacccttaacccgtacgtttacgttacggttccctttacgtaaccccg

SEQ ID NO: 63555 - DNA, 732 bp, Homo sapiens
  misc_feature: GYAE6OF01AZYTH.31.78.H01.1.454.CMB.1.raw
  modified_base (329)..(329): a, c, t, g, unknown or other
  misc_feature (329)..(329): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagactccctggctgtgtctcgtgggcgaggacgggccaccatcaactgcaagtccagccagtagttgttttattcggaccccaacaataacaactacttagcttggtaccagacaagaaagtaggacacgccctacctaaactcctagtactttacgngggtccttccgtacccgggctacggttcccggggttacctaaccgtattccgaagttcggacgtacgggtccggggttcgtacggggtaacccgttatttaccgaaccttcctaccgaaccctaactccgaacggtcccaacggtcccgtacggaccgtaacgggtccttaaggaaagtagttggtacggtacttaaggtttttacttacgtagtaccgtaacgtaactaaacttatttaacctttaaccgtttccgtttacgtacccgttacgtttccgggaacgggtacggtaacgtaaggggttacgaacgtaaacgtaccgaaaacggtacgttagggttaccggtacgtacggaaccctaaccgtatttaccccgttacgttaccgtttcctaacccg

SEQ ID NO: 63556 - DNA, 737 bp, Homo sapiens
  misc_feature: GYAE6OF01DHTSS.31.78.H01.1.454.CMB.1.raw
tcagcagtagacgtcacgaccggtgctcgatttagtgtgagtagtttgggttgggggagctacaacaggcaggcaggggcagcaagatggtgttgcagacccaggtcttcatttctctgttgctctggatctcgtggtcgccgtacgggacagtcgtgatgacgcctagtttccagtacctcccgtggctgtgtctcgtgggcgaggacggccaccatcaacgtcgacaacgtccagcctaggtagtttgttttacgtccggaaccccaactaaactaaacctaacttacttacgtcttacggtaaccagacaaaggaaaggtacggacacgtaccctaactaacctcgtagtacgtttacgtcgggtacttacccgacccgggtacgtacggttcccggggttaaccctaacggtcttacgtagttcggccgtacgggtcggttcgtacggggtaacctcgtttaccaccgttccacctaaccgacgtaccgagtacccgtacgaccgtcgaccggacgtacgtagaaacgttcgtggtcggtactaggttttactgtcgtacacgtataacttattaccttcgttacgtttcgaccgttaacggttcgggaacgggtagggaaccgtaagggttgaacgttaacgaaccggtaaaccgtaggttccgtccggggttacctacgggtaccctaacgtttaccgtaccgttacgtttaacccgtcggttaacccccg

SEQ ID NO: 63557 - DNA, 626 bp, Homo sapiens
  misc_feature: GYAE6OF01BK0JU.31.78.H01.1.454.CMB.1.raw
  modified_base (369)..(369): a, c, t, g, unknown or other
  misc_feature (369)..(369): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagactccctggctgtgtctcgtgggcgagacgggccaccatcaactgcaagtccagccagagttgttttattcggccccaacaataacaactacttagcttggtaccagcaagaaagtaggacagccctacctaaactcctagtatttacgtcgggtcttccgtacccgggctacgttcccggggttacctaaccgtnttcgattggcaggcggtctgggacctattcactctacaccatcagcacgcctgacgaggtctagaacgtgttggtaggtacttaggttttactacgtgtacagtactaaacttattacttacctttcgtttccgttaccttacggtttcgggacgggtaacgggaaccgtaagggtacggagtaacgtaaccgaaaacgtacgttacggtcggaccgtacgacccgtaacctacttccgtacgttccttcgtaaccg

SEQ ID NO: 63558 - DNA, 808 bp, Homo sapiens
  misc_feature: GYAE6OF01CS81V.31.78.H01.1.454.CMB.1.raw
tcagcagtagacgtcacgaccggtgctcgatttagtgtgagtagtttgggtttgggggatctacaacaggcaggcaggggcagcaagatggtgttgcagacccaggtcttcatttctctgttgctctggatctctggtgccgtacggggacatcgtgatgagcctagtttccagactcccgtggctgtgtctcgtgggcgaggacgggccaccatcaactgacaagtccagccagagttgtttagtcgacccaacaataacaactactagacttaggaccagacaagaaagtacggacacgtacctacctaaactcctagtacttttaccgcggtacttccgacccgggctacggttcccgggttacctaaccggtacttacgtagttcggacgacggtcggggtcgtacggggacccgttatttaccgaccttacctaccgaacctagtacctacgaccgtacgtcccgtacgacgaacgggtaccgtaaggtaacggtacgttcgggtaacgggtacgtttaaacggtttttaacttaaccggttacgtaaccgtaaacgtaacctaaactttaacgttttaaccgttaacccgtttttaccccggttttaccggtaaccgtttacccggggttttaccgggggaaccggggtaacggggtaaacccgtaaggggttacgggaaaccggttaactaaaacccgggtaaaacggttaacccggttaggggttaccggtacccgttacgggaacccctaacccggttaacgtttccccgttacggttcccttttaaccgtaacccccg

SEQ ID NO: 63559 - DNA, 566 bp, Homo sapiens
  misc_feature: GYAE6OF01EYD4M.31.78.H01.1.454.CMB.1.raw
  modified_base (426)..(426): a, c, t, g, unknown or other
  misc_feature (426)..(426): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggcccccacaataacaactacttagcttggtaccagcaagaaagtaggacagccctacctaaactcctagacttttacgtgggcctttccgtaaccccggggctacggttcccgggggtttaccctaaaccgattccagttcggcaggcggggttctggggaccctatttccacttcctccaccntccagcagcctgcaggctagaagatgtggctagtttattacgtgtcagcaactattatactttctttcgtctacgtttcgggcggtagggaccaagggtgagatacgaaacgtatgtcggctgccacatctgttctctac

SEQ ID NO: 63560 - DNA, 565 bp, Homo sapiens
  misc_feature: GYAE6OF01C6E9U.31.78.H01.1.454.CMB.1.raw
  modified_base (319)..(319): a, c, t, g, unknown or other
  misc_feature (319)..(319): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctcgtgggcgagagggccaccatcaactgcaagtccagccagagttgttttattcggccccaacaataacaactacttagcttggtaccagcagaaagtaggacagcctacctaaactcctgtatttacgngggtcttcgtacccgggcacgttcccggggttacctaaccgattcattcggctaggcgggtctcggggacccgtatttcacttctccaacatcagcacgctgcaggctagaagagtggtgactagtttatacgtgtacagactaactatttactactttctttcgtacttacgtttcgggacgtacgggaccgtaagggtcgagatacgaaaacgtatggtcggctgacacctatctgtctctacg

SEQ ID NO: 63561 - DNA, 543 bp, Homo sapiens
  misc_feature: GYAE6OF01A0FOT.31.78.H01.1.454.CMB.1.raw
  modified_base (440)..(440): a, c, t, g, unknown or other
  misc_feature (440)..(440): n is a, c, g, or t
  modified_base (457)..(457): a, c, t, g, unknown or other
  misc_feature (457)..(457): n is a, c, g, or t
  modified_base (534)..(534): a, c, t, g, unknown or other
  misc_feature (534)..(534): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagactccctggctgtgtctctgggcgagagggccaccatcaactgcaagtccagccagagttgttttattcggccccacaataacaactacttagcttggtaccagcaagaaagtaggacagcctacctaaactcctgtatttactgggtcttccgtacccgggcagtccggggttcctaaccgtattcattggcagcgggtctcgggaccgtattcactctcaccatcagcacgcctgcaggctagaagatgtgctagtttatctgtnagcaatattaatacttntttcgtctacgtttcgggacggtacggaaccgaagggtggagtatacgaaacgtactggtggactgaccactatctntcgttctac

SEQ ID NO: 63562 - DNA, 577 bp, Homo sapiens
  misc_feature: GYAE6OF01ACMNQ.31.78.H01.1.454.CMB.1.raw
  modified_base (378)..(378): a, c, t, g, unknown or other
  misc_feature (378)..(378): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagctagtttccagactccctggctgtgtctcgtgggcgagacgggccaccatcaactgacaagtccagccagtagttgttttacttcggcccccaacaaataacaactacttagcttggtaccagcaagaaagtaggacagccctacctaaactcctgtatttacgtgggtccttccgtaccccggggctacggttcccggggttaccctaaaccggtnttccagttcgggcacgggtcgggtccgtacgggggaaccctattttccacttcctaccaacccatccagccacgcctgcgaggctagaagatgtggctagtttactactgtcagacaactattatacttcttcgtctacgtttcggcggtaggactaggtgagatacgaaacgtatggtgctgctacatctctctctac

SEQ ID NO: 63563 - DNA, 661 bp, Homo sapiens
  misc_feature: GYAE6OF01BKXBH.31.78.H01.1.454.CMB.1.raw
  modified_base (387)..(387): a, c, t, g, unknown or other
  misc_feature (387)..(387): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagacctccctggctgtgtctcgtgggcgaggacgggccaccatcaactgacaagtccagccagtagttgttttattcggacccacaataacaactacttagcttaggtaccagacaaggaaaagtaggacacgccctacctaaactccgtagtactttacgtcgggtaccttccggtacccgggctaacggttccccggggttacctaaaccgtnttcagttcggcacggcgggtctcggggacctatttcacctctacaccatcgagcacgcctgacgaggctaggaaacgtgtcggtggtacgttaagttttacttaccgttgtacctaagtacctaaacgttatttaacgttaccttttccgtttaccgttaccgttaccggtttcggggaacgggtaaccgggtaaccgtaaggggtcggtaacgtaactaccgaaaacggtacgtggtacgctacgacctactagttccttcgtccttcgtacg

SEQ ID NO: 63564 - DNA, 649 bp, Homo sapiens
  misc_feature: GYAE6OF01ATX4O.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccaccaataacaactacttagcttggtaccagcagaaagtaggacagccctacctaaactcctagatttacgtgggtccttctaccccggggctacgttcccgggggtttaccctaaacccggtattccagtttcgggccaggtccggggttacctacggggaacccgtatttcaccttcctaccaacccatcagcacgtcctgcgaggctaggaaagagtggtacggacttaaggttttacttacgtgtacagactaaactatttaacttacctttccgtttacgtaccgttaccgttttcgggaccgggtacgggaaccgtaagggtcggaagtaacgtaaccgaaaaccgtaacgttacggtggacctgacctaacccgtattaccgtcgttccttcgtaccg

SEQ ID NO: 63565 - DNA, 889 bp, Homo sapiens
  misc_feature: GYAE6OF01BDIRT.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagtagttgttttattcggaccccacaataacaactacttagcttaggtaccagcaagaaagtaggacagcctacctaaactcctagtattttaccgtgggtcctttccgtaaccccggggctaacggttccccggggggtttacccctaaacccggtattttaccgaacgttttcgggccgtaaggggtcccgggggttaccgtacggggggtaaccccgttaatttttcccgaacccgttacccttacccaaaccccgtaaagttcccgaaacgggtcccgaaccggtccccgttacggacccgaaggggtcccgttaagggaaaacggtagtttacgggttacgggtaccgttaaacgggttttttaactttaaaccgtttacgggttaccgtaaacggtaaccctaaaccttaacgtttttaaacctttaacccgttttttacccgttttttacccgggttacccgtttaacccggttttttacccgggggaaccgggggttaaccggggtaaaccccggtaaaggggttacgggtaaacggtaaacgttaacccggtaaaaacccgggtaaacggttacgggttacgggacccgttacggtaccccgtaaacccgttacgtttacccgtttacggtttccccgtttaccgtaaccccgg

SEQ ID NO: 63566 - DNA, 642 bp, Homo sapiens
  misc_feature: GYAE6OF01C8CZQ.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagacctccctggctgtgtctcgtgggcgagagggccacatcaactgcaagtccagccagagttgttttattcggaccccaactaataacaactacttagcttaggtaccagacaagaaagtaggacacgccctacctaaactcctagtattacgtgggctttccgacccgggctacggttcccggggttacctaaccggtacttccagttcggacgtacggtccggggtccgtggggaaccctagtttccgaccttcttaccacctataccacgctacgcctgaccagggacctaggaaagtcgtaggtcggacttagtttactacgtgtacacgtacaaacgtatttactactttcctttacgtaccttacgtttcgggacggtacgggaccgtaagggtcggtaacgaagtaaccgtaaaacgtcgttaggtcggaccttgacctacctagttacctgtccttctaccg

SEQ ID NO: 63567 - DNA, 904 bp, Homo sapiens
  misc_feature: GYAE6OF01DE2U6.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctcgtgggcgagaggccaccatcaactgcaagtccagccagtagttgttttattcggccccacaaataacaactacttagcttaggtaccagcaagaaagtaggacacgcctacctaaactcctagtactttactgggtcctttcgtacccgggactacgttcccggggtttaccctaaaccggtactttcgtaatttcgggacctaacgggtccgggggttaccgttacgggggaacccgttaacttttcccgaaccttccgttaccaaccccgtaacttcccgaaacggtccgaacggtccccctagggaccgtaacggggtacccgttagggaaaaggtaacggttcgggttacgggtaaccgtttaaggttttttaaactttaaccggttcggttacccgtaaacggaacccttaaaccgttaactttttaaaccgtttaacccgtttttaccggtttttttaccccgttaacccgtttaaccgggttttttaccccgggggaaccgggggttaacccgggggtaacccggtaaaacggggggtttacggggaaaacggttaaacccgttaaacccgggtaaaaaaacccggggtaaaccgttttcgggggttaaccgggttacccggtttaaccggtaaccccgtaaacccccgttaaacgttttcccggttttaacccggtttccccgtttttacccgttaaaaccccgg

SEQ ID NO: 63568 - DNA, 546 bp, Homo sapiens
  misc_feature: GYAE6OF01AN70R.31.78.H01.1.454.CMB.1.raw
  modified_base (315)..(315): a, c, t, g, unknown or other
  misc_feature (315)..(315): n is a, c, g, or t
  modified_base (427)..(427): a, c, t, g, unknown or other
  misc_feature (427)..(427): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagtagtgttttattcggccccacaataacaactacttagcttggtaccagcagaaagtaggacagcctacctaaactcctgatttacgngggcttccgacccgggcagtccggggttactaaccgattcattggcaggcgggtctgggaccgtatttcactctccaccatcagccagcctgcgaggctagaatagtgtggntagtttatactgtacagactaactattataccttctttccgtctaccgtttcgggacggtacgggaccgtaagggtggagataccgtaaacgtatggtgctgctacatctgtctcgtac

SEQ ID NO: 63569 - DNA, 722 bp, Homo sapiens
  misc_feature: GYAE6OF01CSBHL.31.78.H01.1.454.CMB.1.raw
tcagcagtagacgtcacgaccggtgctcgatttagtgtgagtagtttgggtttgggggagctacaacaggcaggcagggggcagcaagatggtgttgcagacccaggtcttcatttctctgttgctctggatctctggtgcctacggggacatcgtgatgagccagtttccagactccctggctgtgtctcgtgggcgaggacgggccaccatcaactgcaagtccagccagagttgttttattcggccccacaataacaactacttagtcttggtaccagacaagaaagtaggacagaccctacctaaacctcctagtaatttacgtgggtcctttccgtacccgggctacggttcccggggttaccctaaaccggtactttctacgtttcgggaccgtagggtccggggttctacgggggacccgttagtttcccaacgttccttacaaccctatccgagccgaacgtcccttggccgaacgggtctaggaaacgtagttgggtacggtaccttaaggttttacttacgttggtaacctaggtacctaaacgttatttaacttaccgttttccttttaccggtacttacccggttttacggggaccgggtacgggggaaccctaagggggttacggaacgtaactaaccggtaaaacggtaacgtttgggtcggtaccttcggacctaaccgtattccgtttacgtcctttccgtacccg

SEQ ID NO: 63570 - DNA, 687 bp, Homo sapiens
  misc_feature: GYAE6OF01EDCNX.31.78.H01.1.454.CMB.1.raw
  modified_base (386)..(386): a, c, t, g, unknown or other
  misc_feature (386)..(386): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctcctggctgtgtctcgtgggcgagacgggccaccatcaactgacaagtccagccagtagttgttttacttcggccccaacaaataaccaactacttagcttcggtaccagacaaggaaagtacggacacgtaccctacctaaactcctagtaactttacgtcgggtcctttccggacccgggtctacggttcccgggttaccctaaccgtntttcgagttcggacgtaggtcgggtcgtagggtaccctagtttccacgttccaccgaaccctattccgaacgccgtaacgcccgttacgaccgtaggaccttaggaaacgtagttcggtacggtacttaagttttactacgtagttccaagtacctaactagtttaccttacgtttccgtttacgtccttacggtttcgggacgtaacgggtacgtaaagggtcgtaaagtactaacggtaaacggtagttcgggtacgcgtcgaaccgtaccctattcccgttgttccttccgtaacccg

SEQ ID NO: 63571 - DNA, 821 bp, Homo sapiens
  misc_feature: GYAE6OF01BRX9G.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgaggagggccaccatcaactgcaagtccagccagtagttgttttattcggaccccaacaaataacaacttacttagcttggtaccagacaagaaagtaggacacgcctacctaaactcctagtactttacgtcgggtccttccgtaccccgggactacgttcccgggggtttaccctaaaccggtactttaccgtaacgtttcgggacgtaacgggtcccgggggttacgttacgggggtaaccccgtaatttttacccgaaccgtttccctaccgtaaccctaacgttccgaacggtcccgaacggtccccgttcggaccgtaacggggtacgttacggaaaacggtacgttacgggttacgggtaccgtttaaggtttttaacgtttaaccgttcggtaccgtaacgtaccgtaaaacgttacgttttaaactttaacccgttttaccgttttaccgtacccgttaaccggtttttaccggggaaccggggttaacggggtaacccgtaaaggggtacgggtaaacggtaacgttaaacccgtaaaaccggtaaacgttcggttacgggaccttacggacctaacctaacgtttcccgttacggtttccgtttccgtaacccg

SEQ ID NO: 63572 - DNA, 541 bp, Homo sapiens
  misc_feature: GYAE6OF01DTGEZ.31.78.H01.1.454.CMB.1.raw
  modified_base (332)..(332): a, c, t, g, unknown or other
  misc_feature (332)..(332): n is a, c, g, or t
  modified_base (529)..(529): a, c, t, g, unknown or other
  misc_feature (529)..(529): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagttgttttattcggccccacaataacaactacttagcttggtaccagcagaaagtaggacagcctacctaaactcctgatttacgtgggcttcgacccgggntacgtccggggttcctaaccgattcattcggcaggcgggtctggggacctatttcactctacacatcagcagcctgcaggctagaagatgtgctagtttatactgtacagtacaactattactacttctttcgtctacgtttcgggacggtagggacctaagggtgagtatacgaaacgatggtcgctgactacatntcgtcttctacg

SEQ ID NO: 63573 - DNA, 588 bp, Homo sapiens
  misc_feature: GYAE6OF01DFUPG.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagaggccaccatcaactgcaagtccagccagagttgttttattcggccccaccaataacaactacttagcttggtaccagcagaaagtagacagcctcctaaactcctgatttactgggctttcgtaccccgggctacgttcccggggttacctaaaccggtattccatttcggactaggccggggttctggggaccctagtttccaactctcaccatcagcacgcctgcaggctagaagatgtcggctagtttacttactgtacagcaactattacttactttctttcgtctacgtttcggacggtacgggtaccaaacgggttgaacgtaactacgaaaacgtagttggtcggactagacctacctacttcttacgtccttcgtaaccg

SEQ ID NO: 63574 - DNA, 553 bp, Homo sapiens
  misc_feature: GYAE6OF01BU49I.31.78.H01.1.454.CMB.1.raw
  modified_base (431)..(431): a, c, t, g, unknown or other
  misc_feature (431)..(431): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccaccaataacaactacttagcttggtaccagcaagaaagtaggacagcctacctaaactcctgtatttacgtgggtcctttcgtaccccggggctacgttccccggggtttacctaaaccgatttcattggcaggcgggtctgggacctatttcactctcaccatcagcagcctgcaggctgaagntgtgctagtttattactgtcatacaactattattactttctttcgtctacgtttcggcggtaggaccgaaggtaggagtatacgaaacgtatggtgctgacctactattctgtccttctacg

SEQ ID NO: 63575 - DNA, 609 bp, Homo sapiens
  misc_feature: GYAE6OF01BNXR6.31.78.H01.1.454.CMB.1.raw
  modified_base (333)..(333): a, c, t, g, unknown or other
  misc_feature (333)..(333): n is a, c, g, or t
  modified_base (351)..(351): a, c, t, g, unknown or other
  misc_feature (351)..(351): n is a, c, g, or t
  modified_base (376)..(376): a, c, t, g, unknown or other
  misc_feature (376)..(376): n is a, c, g, or t
  modified_base (434)..(434): a, c, t, g, unknown or other
  misc_feature (434)..(434): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagttccagactccctggctgtgtctcgtgggcgagacgggccacatcaactgacaagtccagccaggagttgttttattcggaccccaacaataacctaactacttagtcttcggtaccagacaagaaagtaggacacgaccctacctaaactcctagtactttacgnggtcttccgtacccgggntacgttcccggggttacctaacgtnttcagttcggcaggcgggtctcgggacctatttccactctcaccatcagcacgccgtncgaggtctagaagtgtggtggtacttagtttactacgtgtcagtactaactattacttactttcgtttacgtcttacgtttcgggacgggtacgggaacgtaagggtaggagtaacgtaacgtaaacgtacgtggtacggtctagacctactacttcgttcgttccttacgtccg

SEQ ID NO: 63576 - DNA, 573 bp, Homo sapiens
  misc_feature: GYAE6OF01B7GPM.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccaacaataacaactactagcttggtaccagcaagaaagtaggacagcctacctaaactcctagtatttacgtgggtccttcgtacccgggctacgttcccggggttacctaaccgtattcattcggcaggcgggtctacgggaccgtatttcactctcaccatcagcagcctgcaggctagaagagtgtcggacttagtttattacgtgtacagactaactattacttacttctttccgtactacgtttcgggacggtacgggaccgtagggtggagtactacgaaacgtagtaggtcggactcgactaccattctcgttctctaccg

SEQ ID NO: 63577 - DNA, 617 bp, Homo sapiens
  misc_feature: GYAE6OF01DWMCE.31.78.H01.1.454.CMB.1.raw
  modified_base (602)..(602): a, c, t, g, unknown or other
  misc_feature (602)..(602): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagtgttttattcggccccacaataacaactacttagcttggtaccagcaagaaagtaggacagccctacctaaactcctagtattttacgtgggtcttccgtaccccgggctacgtcccggggtttaccctaaccgatttccagtttcggactagggtcggggttcgtcggggaaccgtactttcaccgttcctaccaaccctattaccgaacgccacgtccctgccgaaggtctaggaagattggtggcctagtttattactgtcagacaatacttaattactttctttcgtcttacgttcggtcggacgggtacgaaggtggtaagtagtaacgaaacggtaactaggtcggtactgaccgtacaacgttntacgttctcgtaccg

SEQ ID NO: 63578 - DNA, 707 bp, Homo sapiens
  misc_feature: GYAE6OF01CBGG6.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgacaagtccagccagtgttgttttatcggccccaacaataacaactacttagctggtaccagacaagaaagtaggacacgacctacctaaactcctagtatttacgtcgggtccttcgtacccgggtcacggttcccggggttacctaaaccgtattctaagttcggacgtacggtccggggtcgtacggggtacccgttactttccgaccttcctaccgtaaccctatccaacgtccgaacgtcccgttacggacctacgggtccgtaggaaacgtaagtgggtcggtacttaacgttttaagttaccgtggtacctaacggtacctaaacttagttaactttaccttttaccgtttccgttaccgttaccgtttcggggaccggggtacgggtaaccgtaagggtagggtaacgtaacgtaaccgtaaaacgtaacgttggtacggtcttacgaccgtaccgtaattaccgttcgttctaccgttacccg

SEQ ID NO: 63579 - DNA, 523 bp, Homo sapiens
  misc_feature: GYAE6OF01A4MI5.31.78.H01.1.454.CMB.1.raw
  modified_base (414)..(414): a, c, t, g, unknown or other
  misc_feature (414)..(414): n is a, c, g, or t
  modified_base (501)..(501): a, c, t, g, unknown or other
  misc_feature (501)..(501): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctacctaaactcctgatttactgggcttcgtacccgggcagtcccggggttcctaaccgattcattcggcagcgggtctgggaccgtatttcactctcaccatcagcagcctgcaggctgaagntgtggctagtttatactgtcagcaatattatacttctttcgtctactttcggacggaggacctaaggtgagatacgaaacgtatggngctgctacatctgtccttctac

SEQ ID NO: 63580 - DNA, 587 bp, Homo sapiens
  misc_feature: GYAE6OF01CJRH4.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagttccagactccctggctgtgtctcgtgggcgagagggccaccatcaactgcaagtccagccagagtgttttattcggcccacaataacaactacttagcttggtaccagcagaaagtaggacagaccctactaaactcctgatttactgggcttcgtacccgggctagtcccgggttacctaacgtattcattggcaggcgggtctgggaccgatttcactctcaccatcagcagcctgcaggctgaagatgtggctagtttatacgtgtacagtcaaactatttaactactttctttaccgtctaacgttttcgggacgggtaacggaccgaaagggtcggaacgtaattaccggaaaaacgtaacgtggtacgggcctagggccctaaccctattaccgtcggttacctttccgtaaccg

SEQ ID NO: 63581 - DNA, 570 bp, Homo sapiens
  misc_feature: GYAE6OF01EXNWW.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagttccagactccctggctgtgtctcgtgggcgagagggccaccatcaactgcaagtccagccagagttgttttattcggaccccacaataacaactactagcttggtaccagcaagaaagtaggacagcctactaaactcctagtacttacgtgggacttctacccgggctacgtcccggggttacctaaccggattccagttcggccaggtcgggtctacggggaccgtatttccgacttcgtcaccatcaacgccacgcccgtgcaggctagaagatgtggctagtttatactgtacagcaatattattacttcttctactacgtttcggacggtacggtaccgaaggtggacgaagtacgaaacggtataggtcggactgactaccgatacgtcgttctctac

SEQ ID NO: 63582 - DNA, 797 bp, Homo sapiens
  misc_feature: GYAE6OF01EN0SQ.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagtagtgttttattcggccccaacaataacaactacttagcttgtaccagcaagaaagtagacagcctacctaaactcctagtacttttacgtgggtcctttccgtaccccgggctaacgttccccggggttacccttaaacccggtatttcctaagtttcgggacctacggggtccggggttaccgttacggggggtaaccccgttaacgtttttccaaccctttcccgttaccctaacccctaaagtttcccgaaacggtccctaacggtcccccgttaggaccgtaacggggcctttaacgggaaaagtacggtttggggttaccgggaccttaaagggtttttttaacttaccgtcggttaccgaacggtacctaaactaagttttaacttaccgtttttccgtttacggttaccttaacggttttaccggggacgggtaaccggggtaaaccgtaagggggttacgggaaacgttacgtaaaccgaaaaccggttaagttcggggtacggaccttaggaccccgtaaccctagtttacccgttcggttaccgtttacctaacccg

SEQ ID NO: 63583 - DNA, 573 bp, Homo sapiens
  misc_feature: GYAE6OF01AFC24.31.78.H01.1.454.CMB.1.raw
  modified_base (451)..(451): a, c, t, g, unknown or other
  misc_feature (451)..(451): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagttgttttattcggccccacaataacaactacttagcttggtaccagcagaaagtaggacagccctacctaaactcctgtactttacgtgggtccttccgtaccccgggcacgttcccgggggttaccctaaaccgtacttccagtttcggccaagggccgggtcgtcggggacccgtatttcactcctcaccctatccagcacgcctgcaggctagaagngtgtggactagtttactacgtgtcagtacaactattacttactttcttcgtactacgtttcggacggtaggaccagggtgagatacgaaacgtactggcgtctgcaccatctcgtcttctac

SEQ ID NO: 63584 - DNA, 707 bp, Homo sapiens
  misc_feature: GYAE6OF01CANFK.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctcgtgggcgagaggccaccatcaactgcaagtccagccagagttgtttattcgcccacaataacaactactagcttggtaccagcagaaagtaggacagccctactaaactctagtatttacgtgggtccttcgtacccgggctaacgttcccggggtttaccctaaaccggtacttcgaagttcggacgtacggtcggggtccgtacggggacccgtactttccacgttcctacctaacccagtccacgaccgtacgtccgtcgcgacggactaggaaacgtagtcggtaggtacttaaggttttaacttacgttcgtacgtaagacctaaacgtatttaacgttaaccttttcctttaccggttacccttaaccggttttccgggaccgggttaacggggaacccgtaaagggtacgggaaacgtaacgtaaccggaaaaccgttaacggttacggttcggtaccgttaccgaccgtaaccctacgttaccgttcggttccctttaccgtaacccg

SEQ ID NO: 63585 - DNA, 685 bp, Homo sapiens
  misc_feature: GYAE6OF01C32W8.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgaggagggcccaccatcaactgcaacgtccagccagtagttgtttttattcggccccacaataacaactacttagcttgtaccagacaagaaagtaggacagacctacctaaactctgtatttacgtcgggtccttcgtacccgggctacggttcccggggttacctaaccgtacttcgaagtttcggcgacggtcggggttaccgtcggggtaccgtatttaccgactccttaccacctattaccacgctaacgccctggacgagggtactaggtaaacgtagttcgggtacggtacgttaagttttacttacgtaggttaccaacgtacgtaaaccttaattttaacgttaacctttttcgttttaccgttacgttaacccgttttgggaccgggtacgggtaacccgtaagggtcggaagtactaacggaacgtacgtaacggtggtacggtcgtcgtacctaacttcgttcgttgttccttaccg

SEQ ID NO: 63586 - DNA, 672 bp, Homo sapiens
  misc_feature: GYAE6OF01B7ASD.31.78.H01.1.454.CMB.1.raw
tcagcagtagacgtcacgaccggtgctcgatttagtgtgagtagtttgggtttggggagctacaacaggcaggcaggggcagcaagatggtgttgcagacccaggtcttcatttctctgttgctctggatctctggtcgccgtacggggacatcgtgatgagccagtttccagactccctggctgtgtctcgtgggcgagaggccacatcaactgcaagtcagccagtagttgttttacgttcggacccaactaataaccaactacttagcttaggtaaccagacaagaaagtacggacacgaccctacgtaaactccgttagaactttacgtcgggcctttaccgtacccgggctacgttcccggggttacctaaacgtacttcgagttcgggcagggtcgggtccgtagggacccgtatttccgacttccgtaccaacctatccgaacgtccaacgtcccgtaggacccaagggtacctaggaaacgtacgtcggtacgggtactaaggtttttactaccgtgttaaccacgaactaaacttagtttacctaacgtttccgtttacgtccttaacggtttcgggacgggaagggtaacctaggggttagaacgtataaccggaaactagtggtacgcttagactaccgattcgtacgttcttcgtaaccc

SEQ ID NO: 63587 - DNA, 588 bp, Homo sapiens
  misc_feature: GYAE6OF01DCUGX.31.78.H01.1.454.CMB.1.raw
  modified_base (445)..(445): a, c, t, g, unknown or other
  misc_feature (445)..(445): n is a, c, g, or t
  modified_base (463)..(463): a, c, t, g, unknown or other
  misc_feature (463)..(463): n is a, c, g, or t
  modified_base (475)..(475): a, c, t, g, unknown or other
  misc_feature (475)..(475): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagacctccctggctgtgtctcgtgggcgagagggcccacatcaactgcaagtccagccagtagttgttttattcggccccaacaataacaactacttagcttaggtaccagacaagaagtaggacagtcctacctaaactcctagtactttacgcgggtcttcccgtacccgggctacgttccggggttaccctaaccgattccagttcggccgacgggtcgggtcgtcgggacctatttccactctcacatcagcagcctagcgagcagaagngtgtgctagtttatacgntacagactaatnttactacttcgtttacgtcgttagttccgggacggtacgggtaacgtaagggtcgaaagtactaaccgaaacgtacgtggtcgctcggtacacctattactcgtcgttctccg

SEQ ID NO: 63588 - DNA, 628 bp, Homo sapiens
  misc_feature: GYAE6OF01CLHBC.31.78.H01.1.454.CMB.1.raw
  modified_base (412)..(412): a, c, t, g, unknown or other
  misc_feature (412)..(412): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtagacagcctacctaaactcctagatttactgggcttctacccgggcacgtccggggttctaaccgattcattggacaggcggtctgggaccgtattcactctcacatcagcagcctgcgagctagaagtntgtcggctagttttacttacgtgttaccagtaccaaactaagtttaacttaccgtttaccttttaccgttacctttaacgtttccggggaaccgggtaacggggtaaccgtaaaggggtagggaaacgtaacgttaaccgaaaaaccggtaagttcgggttcggaccgttacgaacccgtaacctaacgttccgtttacgttccgtttcgtaaccc

SEQ ID NO: 63589 - DNA, 710 bp, Homo sapiens
  misc_feature: GYAE6OF01DQVJW.31.78.H01.1.454.CMB.1.raw
  modified_base (532)..(532): a, c, t, g, unknown or other
  misc_feature (532)..(532): n is a, c, g, or t
  modified_base (686)..(686): a, c, t, g, unknown or other
  misc_feature (686)..(686): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagactccctggctgtgtctcgtgggcgaggacgggccaccatcaactgacaagtccagccaggtagttgttttactcggccccaacaataacaactactagcttggtaccagacaagaagtgacagccctactaactcctagtacttacgtcgggtcttaccgtacccgggctaccggttcccggggtttaccctaaaccggtactttaccgtaagtttcggaccgtaacggggtcccggggttcgtacggggtacccgttattttcccgaccgttcctaccaaccgtactaccgacgaccgtacgtccctagccgaacggtctaaggaagacgtggtggtaccttagtttacttacgtntaacgacgtaactaacttaactttactttaacctttcgttttccgtaccgttaccggtttacgggaccgggtaacgggtaaccggtaagggtcggtaaacgtaataacccggtaaacggtacgttcgggttacggccgttagcctaaaccgttntaccgtacgtttctaccttacccg

SEQ ID NO: 63590 - DNA, 850 bp, Homo sapiens
  misc_feature: GYAE6OF01DZUAT.31.78.H01.1.454.CMB.1.raw
  modified_base (349)..(349): a, c, t, g, unknown or other
  misc_feature (349)..(349): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacgggacatcgtgatgagccagtttcagactcctggctgtgtctcgtgggcgagacgggccaccatcaactgacaacgtccagccagtagtttgttttacgttcggacccctaactaaataaacctaacttacttagccgtttaggtaaccaggacaaagaaaggtacggaacacgtaccctacctaaactccgtagtactttacgnggtccttccgtacccggtctacggttcccgggttacctaaccggtacttacgaacgtttcggacctacgggtccgggtcgtacgggacccgttaacttttccgaaccgttccgtaccaaccgtacgtaccgaacggtaccgtaaccggtcccgtaggtacccgtacgggtaaccgttaagggaaaacggttacggttcgggttaacggggtaaccttttaacgggtttttaaaccgttaccgttacggttaccaaacggttaacccgttaaactttaacgttttaaccgttttaccctttaccccggtttttaccggttaacccggtttaccggtttttacccggggaaccggggttaacggggtaaacccgtaaggggttaaccgggtaacgtaaacgttaaacccggtaaaaaccgttaacggttacgggttaacgtaccggttaccggaacccttaacccgtagtttacccggttacgtttaccgttccgttaccccg

SEQ ID NO: 63591 - DNA, 616 bp, Homo sapiens
  misc_feature: GYAE6OF01ELC6S.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagtagttgttttattcggaccccacaataacaactacttagcttggtaccagacaagaaagtaggacacgcctacctaaactcctagtatttacgtgggtccttccgtaccgggcacgttcccggggttacctaaccgtattcagttcggcaggtcgggtcgtcgggacctatttcactctcaccatcagcacgtcctgcgaggctaggaagagttggtaggtacttagttttacttacgtcgtacagtactaactatttacttactttctttacgtacttaccgtttcgggacgggtaacgggaccgtaagggtcggaagtaacgtaaccgaaaacgtaacgttggtcggacgtagaccctaacctacttacttcgttccttcgtacc

SEQ ID NO: 63592 - DNA, 660 bp, Homo sapiens
  misc_feature: GYAE6OF01AOPTM.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagactccctggctgtgtctcgtgggcgagacgggccaccatcaactgcaagtccagccaggtagttgttttacgttcggccccaactaataaccaactacttagcttacggtaccagacaagaaagtacggacagtccctacgtaaactcctgtactttacgcgggtcttaccgtacccgggactacgttcccgggggttacctaaccgtacttacagtttcggactaggtccggggtctagggaccgtatttcacgtctaccacgatcaggcacgtctagcgaggctaggaagacgtggtacggacttaggttttaactacgttgtacgtagtactaactatttaaccttacttttaccgttcgttacttaccggtttcgggacggggaacggtaaccgagggttacggtacgtaacgttaccgaaaacggtacgtcggtacgggtacgtacgacgtacccgtattacgtcgttccgttacttacccg

SEQ ID NO: 63593 - DNA, 589 bp, Homo sapiens
  misc_feature: GYAE6OF01EP91E.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagtagtgtttattcggccccacaataacaactacttagcttggtaccagacaagaaagtaggacacgcctacctaaactcctagtatttacgtcgggtcttccgtacccgggctacgttcccggggttacctaaaccgtattccgagtttcggcgtacggccggggttcgtacggggtaccgtagtttccacttcctacaacctatccgagccacgccctgcgaggtctagaagtagtgtggactagtttatacgtgtcagacaatattaacttacttcgttacgtctacgtttacggacggaggaccgaggtggagtatacgaaacgtagtggtcggactgactactactctcgtctctacc

SEQ ID NO: 63594 - DNA, 693 bp, Homo sapiens
  misc_feature: GYAE6OF01BRVJI.31.78.H01.1.454.CMB.1.raw
  modified_base (378)..(378): a, c, t, g, unknown or other
  misc_feature (378)..(378): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagtttccagacctccctggctgtgtctcgtgggcgagacggccaccatcaactgacaagtccagccagtagttagttttattcggaccccacaataacaactacttagcttaggtaccagacaagaaagtagacagccctacctaaactcctagtactttacgtcgggtaccttccgtacccgggctacgtcgttacggggttacctaaccgtnttacgagttggacgtacgggtccgggtcgtacgggtaacccgtatttccaaccgttcctaccaacctaactcgtacggaccgtacgtcccgtaggaccgtacgggtactaaggaacgtacgttggtacggtacttaagtttacttacgtacgtactaacgtactaacttaacgtttaactttaccgtttactttccgttacgttaccggttacgggaccggtaacgggtaaccgtaagggtacggaagtaacgtaaaccgtaaacggtacgttggtcggtactacgacctaaccgtattccgttgttccttaccg

SEQ ID NO: 63595 - DNA, 537 bp, Homo sapiens
  misc_feature: GYAE6OF01E2RJJ.31.78.H01.1.454.CMB.1.raw
  modified_base (535)..(535): a, c, t, g, unknown or other
  misc_feature (535)..(535): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcaagaaagtaggacacgccctacctaaactcctagtatttacgtgggtccttccgtaccccgggcacgttcccgggggttacctaaaccgattcattcggcaggcggggtctggggacccgtatttccactctcaccatcagcagcctgcaggctagaagatgtggctagtttattactgtcagcaacattatacttcttcgtctactttcggacggaggaccaggtgagactacgaaacgatgtgctgcacatctgtctnac

SEQ ID NO: 63596 - DNA, 789 bp, Homo sapiens
  misc_feature: GYAE6OF01CVMWP.31.78.H01.1.454.CMB.1.raw
  modified_base (203)..(203): a, c, t, g, unknown or other
  misc_feature (203)..(203): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagacctccctggctgtgtctcgtgggcgaggngggccaccatcaactgacaagtccagccagagttgttttattcggccccaacaataacaactacttagcttggtaaccagacaggaaagtaggacacgccctacctaaactcctagtatttacgtcgggtcctttccgacccgggctacggttccccggggttaccctaaaccggtatttaccaagtttcggcctaagggtccggggttctacggggaacccttacgtttccaccgttccgtaccaacccgtaatccgaacgtccgaacgtcccgttgaccgtagggtacctaaggaaaggtagttcgggtacggtacctttaaggtttttaacgtttaccgtacggttaccaacggttaaccgtaaaacttaacgttttaaaccgtttaaccgttttcccgtttttacggttaccgttaaccggtttttaccggggaaccggggtaacgggtaaacccgtaaagggggttacggtaaaccgtaaacgttaaacccggtaaaaacggttaacccgttcgggttacggtaccttaccgggacccttaacccgtacgtttccgtttgttcccgtttaccgttaacccg

SEQ ID NO: 63597 - DNA, 562 bp, Homo sapiens
  misc_feature: GYAE6OF01CV64W.31.78.H01.1.454.CMB.1.raw
  modified_base (333)..(333): a, c, t, g, unknown or other
  misc_feature (333)..(333): n is a, c, g, or t
  modified_base (356)..(356): a, c, t, g, unknown or other
  misc_feature (356)..(356): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagacgggccaccatcaactgcaagtccagccagagttgttttatcggccccacaataacaactacttagcttggtaccagcaagaaagtaggacagcctacctaaactctagatttacgtgggcttcgacccgggntacgtccggggttacctaaccgnttcgattcggcaggtcgggtctcggggactattcactctcaccatcagcacgcctgcaggctagaagatggtggactagtttacttactgtcacgctaactatttatactttctttcgtctacgtttcggcggaggacctaagggtgagtagtacgaaacgtagtggtggcctaggacctacctacttcgtcgttccttcgtaccg

SEQ ID NO: 63598 - DNA, 535 bp, Homo sapiens
  misc_feature: GYAE6OF01BVUVS.31.78.H01.1.454.CMB.1.raw
  modified_base (420)..(420): a, c, t, g, unknown or other
  misc_feature (420)..(420): n is a, c, g, or t
  modified_base (496)..(496): a, c, t, g, unknown or other
  misc_feature (496)..(496): n is a, c, g, or t
  modified_base (531)..(531): a, c, t, g, unknown or other
  misc_feature (531)..(531): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctcgtgggcgagagggtcaccatcaactgcaagtccagccagagttgttttattcggccccacaataacaactacttagcttggtaccagcagaaagtaggacagcctcctaaactcctgactttactgggcttccgtacccgggcacgtcccggggttacctaaccgattcattggcaggcgggtctgggaccgtattcactctcaccatcagcagcctgcaggctgaagntgtggctagtttatactgtcagcaatattattactttctttcgtctactttcgggcggtacggaccgaaggtgganagtacgaaacgtatgtggctgccactatctgtctntacc

SEQ ID NO: 63599 - DNA, 543 bp, Homo sapiens
  misc_feature: GYAE6OF01EGJHY.31.78.H01.1.454.CMB.1.raw
  modified_base (428)..(428): a, c, t, g, unknown or other
  misc_feature (428)..(428): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctctgggcgagagggcccaccatcaactgcaagtccagccagagtgttttattggccccacaataacaactacttagcttggtaccagcaagaaagtaggacagcctcctaaactcctagatttactgggcttcacccgggcatccggggttcctaaccgattcattggcagcggtctgggaccgatttcactctcaccatcagcagcctgcaggctgaagatgtgctagtttattactntcagcaacattataacttctttcgtctacgtttcggcggtacgggaaccgaaggtggacgaattccgaaaacgtaactggtcggcttggacctaccatccttagttcttcgtaac

SEQ ID NO: 63600 - DNA, 575 bp, Homo sapiens
  misc_feature: GYAE6OF01AJH8R.31.78.H01.1.454.CMB.1.raw
  modified_base (312)..(312): a, c, t, g, unknown or other
  misc_feature (312)..(312): n is a, c, g, or t
  modified_base (452)..(452): a, c, t, g, unknown or other
  misc_feature (452)..(452): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgtttattcggccccacaataacaactacttagcttggtaccagcaagaaagtaggacagcctacctaaactcctgatttcngggtccttcgtacccgggcagttcccggggttacctaaccgtattccattcggcaggcgggtctgggaccgtatttcgactcctacgacactcaacgcacgcctcgtcacggctgaagagtgtggactagtttatacgtntacgagctacattatacctttacttcgtacctacgtttccgggcggtacgggtacccaagggtggacgaattaccgaaacggtaacgtgtcggacttgacctacctagtcttcgtcttctacc

SEQ ID NO: 63601 - DNA, 605 bp, Homo sapiens
  misc_feature: GYAE6OF01DCZQP.31.78.H01.1.454.CMB.1.raw
  modified_base (353)..(353): a, c, t, g, unknown or other
  misc_feature (353)..(353): n is a, c, g, or t
  modified_base (416)..(416): a, c, t, g, unknown or other
  misc_feature (416)..(416): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagtagttgttttacttggccccaacaataacaactacttagcttggtaccagcaagaaagtaggacagcctaccgtaaactcctgatttactgggcttcctaccgggcatccggggttcctaacgnttcattggcagcgggtctgggaccgatttcaactctcacatcagcagcctagcaggctggaanactgtggactagtttattactggtacaagcaaactacttttaacttaaccttctttaccgtacaccggttttacgggccgggaaacgggtacccgtaaagggttggaacgtaaacgttaccgaaaaccgtaagttcggtacgggcccttaggacctacccgtaattcccgtaggttcccttactacccg

SEQ ID NO: 63602 - DNA, 602 bp, Homo sapiens
  misc_feature: GYAE6OF01DUCWO.31.78.H01.1.454.CMB.1.raw
  modified_base (365)..(365): a, c, t, g, unknown or other
  misc_feature (365)..(365): n is a, c, g, or t
  modified_base (421)..(421): a, c, t, g, unknown or other
  misc_feature (421)..(421): n is a, c, g, or t
  modified_base (434)..(434): a, c, t, g, unknown or other
  misc_feature (434)..(434): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgaggagggccaccatcaactgcaagtccagccagtagttgttttattcggccccacaaataacaactacttagcttggtaccagcaagaaagtaggacagccctacctaaactcctgtatttacgtgggccttccgacccgggcaacgttcccggggttacctaaccgnttccagttggcaggcgggtctcgggaccgtattcactctcacatcagcagcctgcnggctagaagatgngactagtttatactgacagactaactattaattacctttctttccgtcttaccgtttcgggacgggtacgggtaaccgtaagggttagggaacgtacgtaaccgaaaaaccggtacgttggtcggaccgtcgaccctaaccgtattcgttacgttccttcgtaacccg

SEQ ID NO: 63603 - DNA, 629 bp, Homo sapiens
  misc_feature: GYAE6OF01EM4ER.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcagagggccaccatcaactgcaagtccagccagagttgttttattcggccccacaataacaactacttagcttagtaccagcagaaagtaggacagcctactaaactcctagtatttacgtgggcttccgacccgggcacgttccggggttacctaaccgtattcagttcggcaggtcgggtctgggacctaatttcactctcaccatcagcagtcctgcgaggctagaagtagtggtggtactagtttacttacgtgtaccagtacctaatatttaacttactttcgtttaccgtacgtaccgttttcgggacggtaacggggtacctaagggtacggacgtaacgtaccggtaaaaccggtacgttaggtcgggtaccgttaggacccgttaacccgagtttacccgttacgttaccgttaccgttaacccg

SEQ ID NO: 63604 - DNA, 927 bp, Homo sapiens
  misc_feature: GYAE6OF01AFPI0.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacaactacttagcttggtaccagcaagaagtaggacagccctacctaaactcctgtatttacgtgggtccttcgtaccccggggctacgttcccggggtttaccctaaacccggtatttccgtaagtttcgggaccgtaagggtcccgggggtttaccgtacggggggtaaaccccgttaacgtttttcccgaaaccctttcccgttaacccgtaaaccccgttaacgtttcccggaaacgggttacccgaacgggttcccccgttagggaccccggtaacgggggtccccgtttaagggtaaaaaccgggttagtttacgggggtttacggggtaacccgtttaaagggtttttttaaacgtttaaacccggtttcggttaaccccgtaagggtaaccccttaaaacccgtttaaacgtttttaaaccttttaaccccgtttttacccgttttttacccgggtttaacccgtttaacccgggttttttacccgggggaacccggggttaaaccgggggtaaaccccgttaaaggggggttaccggtaaacgggtaaaccgttaacccggtaaaaaaccgggtaaccggtttaggggttaccgggtaccgtttaacgggaccctaaaccccgtaactttacccgtttacggtttacccgtttacccgttaacccg

SEQ ID NO: 63605 - DNA, 631 bp, Homo sapiens
  misc_feature: GYAE6OF01BG9DZ.31.78.H01.1.454.CMB.1.raw
  modified_base (346)..(346): a, c, t, g, unknown or other
  misc_feature (346)..(346): n is a, c, g, or t
tcagcagtagacgtcacgaccggtgctcgatttagtgtgagtagtttgggtttgggggagctacaacaggcagggcaggggcagcaagatggtgttgcagacccaggtcttcatttctctgttgctctggatctctggtgcctacggggacatcgtgatgagccagtttccagacctccctggctgtgtctcgtgggcgagacgggccaccatcaactgcaagtccagccagtagttgttttattcggccccaacaataacaactacttagcttggtaccagcaagaaagtaggacagcctacctaaactcctagtactttacgtgggtccttccgtaccccgggntacgttcccggggttacctaaccgattcagttcggcagcgggtcgtgggaccgtattcactctacaccatcagcacgcctgcgaggctagaacgtgtgtggacttagtttacttacgtcgtcaacgactaacttacttacttacctttcgtttcgttaccttacggtttccgggaacgggtacgggtaaccgtaggggtacggtaacgtaagtaaccgaaacggtacgttacgggtcggacgtcggaccctaaccgtacttcccgttcgttcccgttactacccg

SEQ ID NO: 63606 - DNA, 547 bp, Homo sapiens
  misc_feature: GYAE6OF01BAU9A.31.78.H01.1.454.CMB.1.raw
  modified_base (313)..(313): a, c, t, g, unknown or other
  misc_feature (313)..(313): n is a, c, g, or t
  modified_base (331)..(331): a, c, t, g, unknown or other
  misc_feature (331)..(331): n is a, c, g, or t
  modified_base (354)..(354): a, c, t, g, unknown or other
  misc_feature (354)..(354): n is a, c, g, or t
  modified_base (463)..(463): a, c, t, g, unknown or other
  misc_feature (463)..(463): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctacctaaactcctgatttacgngggtcttcgaccccgggnacgtccggggttacctaaccgtnttacattggcaggcgggtctgggaccgtatttcactctcaccatcagcagcctgcaggctagaactatgtggactagtttaatacgtgtcagcaactattactactttnttacgtctacgtttcggacggacggaccgaaggtggagtactacgaaacgtatggtggctagcctaacattctacgttctctac

SEQ ID NO: 63607 - DNA, 588 bp, Homo sapiens
  misc_feature: GYAE6OF01D7OVR.31.78.H01.1.454.CMB.1.raw
  modified_base (326)..(326): a, c, t, g, unknown or other
  misc_feature (326)..(326): n is a, c, g, or t
  modified_base (343)..(343): a, c, t, g, unknown or other
  misc_feature (343)..(343): n is a, c, g, or t
  modified_base (436)..(436): a, c, t, g, unknown or other
  misc_feature (436)..(436): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagtagttgttttattcggaccccaacaataacaacttacttagtcttcggtaccagacaagaaagtagacacgcctacctaaacctctagtatttacgnggtccttcgtacccggntacgttccgggttacctaaccgtattctagttcgcacggtcgggtcgtacgggaccgtatttccactctaccacctatccagcacgcctgcgngcgtagaagagttggacggtactagttttactacgtgtacagacaatattacttacttctttcgtacgttacgtttcgggacggtacggacgtaggtggagactacgaaacgtagtcggtcggctagacctactacttctcgttctcgtacc

SEQ ID NO: 63608 - DNA, 573 bp, Homo sapiens
  misc_feature: GYAE6OF01C6Z1D.31.78.H01.1.454.CMB.1.raw
  modified_base (315)..(315): a, c, t, g, unknown or other
  misc_feature (315)..(315): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagttgttttattcggccccacaataacaactacttagcttggtaccagcagaaagtaggacagcctcctaaactcctgtatttacngggtcttcgtacccgggcacgtcccggggttcctaaccgattcattggcagcgggtctgggacctattcactctcaccatcagcacgcctgcaggctagaacgatgtggctagttttaacttactgtacagtacaactattaacttactttcctttcgtctaccgtttcggacggtagggacctaagggtgagtactacgtaaaacgacttaggtcggacttcggacctaacccaattccgttacgtctttctaaccg

SEQ ID NO: 63609 - DNA, 551 bp, Homo sapiens
  misc_feature: GYAE6OF01E2YB1.31.78.H01.1.454.CMB.1.raw
  modified_base (313)..(313): a, c, t, g, unknown or other
  misc_feature (313)..(313): n is a, c, g, or t
tcagcagtagacgtcacgaccggtgctcgatttagtgtgagtagtttgggtttgggggagctaaaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataaccaactactagcttggtaccagcagaaagtaggacagcctacctaaactcctgattttacngggtcttcgtacccgggcagtcccggggttcctaaccgattcagttggcaggcgggtctgggacctatttcactctcaccatcagcagcctgcagctgaagatgtgctagtttattactgtcagctaacattatactttcttcgtctacgtttcgggcggtagggaccgtaaggtggagtatacgaaaacggtacgtggtaggtctcggacaccgtattctagttccttcagttcccg

SEQ ID NO: 63610 - DNA, 748 bp, Homo sapiens
  misc_feature: GYAE6OF01CGVIF.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagacctccctggctgtgtctcgtgggcgagagggccaccatcaactgcaagtccagccagagttgtttattcggccccaacaataacaactacttagcttggtaccagcaagaaagtggacagaccctactaaactcctagtactttacgtggtccttaccgacccgggtatacggttcccggggttaccctaacgacttcgtaagttcggaccgacggtccggggttacctacgggggtaacccttagttttacccgtaaccgttccctacccgtaacccgtacttaccgaacggccgtaacggtccccgttaggacccgtaaggggtcccgttaaggaaaacggtcgttagggtacgggtaccctttaaggttttttaacgttaccttagggtacctaaacgtaacgtaaaccttaatttaacctttacttttcccgttttacgtaccgtttaccgttttacggggacgggtaaccggggtaaccgtaagggtacggtaacgtaacgttaaccgaaaacggttacctgggtacgtacgtagccctaaccgtagtccttacgttccgtcttacccg

SEQ ID NO: 63611 - DNA, 601 bp, Homo sapiens
  misc_feature: GYAE6OF01EYMKC.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacaactacttagcttgtaccagcagaaagtaggacagccctacctaaactcctagtactttacgtgggtccttccgtacccgggctacggttcccggggtttaccctaaaccggatttccgagtttcgggaccagggtccggggttctcggggacccgtatttccacgttcctacaccatcagccagcctgcaggctagaagtagtgtggctagtttattacgtgtcacgtacaactattacttactttctttcgtactacgtttcggacggtaggaccgtaagggtcgaagtatacgaaacgtaagtggtcggccgtgacctacgtacttcgttcgttccttctaccg

SEQ ID NO: 63612 - DNA, 900 bp, Homo sapiens
  misc_feature: GYAE6OF01CQIQ6.31.78.H01.1.454.CMB.1.raw
  modified_base (333)..(333): a, c, t, g, unknown or other
  misc_feature (333)..(333): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagacctccctggctgtcgtctcgtgggcgaggacgggccaccatcaactgcaagtccagccagtagttgttttactcggaccccaacaataacaactacttagcttaggtaccagacaaggaaagtaggacagccctacctaaactcctagtactttacgngggtacctttccggtacccgggactaccggttcccggggttaccctaaaccggtacttaccgtaacgtttcgggacgtaacgggtccggggttaccgtacgggggtaacccttaattttcccgaacctttaccgtacccgtaaccgtacttaccgacgtacccgaacgtccccgttagggaccccgtaaggggtacccgttaaggaaaacgggtacgttaccggggttaggttaccgtttaaagggttttaaccgttaaacccggttggttaaccgtaaaccgggtaaaccttaaaacccggttaaacgtttttaaacccgtttaaaccctttttccccgtttttacccgggttaaacccgtttaaccccgggtttttaccggggggaacccgggtaaaacgggggttaaccccggtaaaagggggtttaccgggaaaacggttaaccgttaaaacccggtaaaaacccgggtaaaccgtttggggtaccggtacccgttaccgggaaccccttaaacccggtactttaacccggtttccggttaacccttttcccgggtaaacccg

SEQ ID NO: 63613 - DNA, 588 bp, Homo sapiens
  misc_feature: GYAE6OF01C1CDR.31.78.H01.1.454.CMB.1.raw
  modified_base (306)..(306): a, c, t, g, unknown or other
  misc_feature (306)..(306): n is a, c, g, or t
  modified_base (417)..(417): a, c, t, g, unknown or other
  misc_feature (417)..(417): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagaggccaccatcaactgcaagtcagccagagtgtttattcgcccacaataacactacttagcttggaccagcagaaagtgacagcctactaaactcctgactttacgngggtacctttccgacccgggctaacgttccggggtttacccaaacgtatttcaatttcggcgtagtcggggtctaggggacctatttccgactctacaacctatccagcancctgccaggctgaaagagtgtaggtctagttttacttactgtacgagtacaactagtttactacctttcgtttcgttacctacgtttcggaccggaggtaacccaaggtgaagtacacgtaaaacggtatggtacggctacggacctaccgattcgttcgttctacgtacc

SEQ ID NO: 63614 - DNA, 555 bp, Homo sapiens
  misc_feature: GYAE6OF01BHVR0.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacaactacttagcttggtaccagcagaaagtaggacagcctacctaaactcctgatttactgggcttctacccgggcacgtccggggttcctaaccgattcagttggcaggcgggtcgtgggaccgtatttcactctcaccatcagcacgcctgcaggctgaagatgtggctagttttatactgtcagacaactattactactttcttcgtctacgtttcggacgtaggaccgtaggcggtagactacgaaaacggtacttggcgcgttacgacctaccgtattccgttcgttcttcgtaacc

SEQ ID NO: 63615 - DNA, 684 bp, Homo sapiens
  misc_feature: GYAE6OF01BPWZP.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctcgtgggcgagagggccacatcaactgacaagtccagccaggtacgttgttttacttcggaccccaacaaattaacaactacttagcttaggtaccagacaagaaaagtaggacacgtacctacctaaactcctagtacttttacgtcgggtcctttaccggtacccgggtactaccggttcccggggtttaccctaaacccggtattccgtaagttcggacgaacgggtccgggtcgtacggggaccgtagtttccaccgttctacgaaccagtcagccacgccgtagcgtaggtactggaaagtgtcgtaggtacttaggttttaactacgtgtacaacgtacgttaattaacgtttacttaacttttccgtttacgtaccgttacggttcgggaccggtagggtaaccgtaggtacggataacgtaaccgtaacgtacgtcgggtcgtactacgtacccgtaccttattccgttacgtccttccgttaaccg

SEQ ID NO: 63616 - DNA, 605 bp, Homo sapiens
  misc_feature: GYAE6OF01D4X5Z.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctgggtgccgtacggggacatcgtgatgagcctagtttccagacctccctggctgtgtctcgtgggcgaggacgggccaccatcaactgacaagtccagccagtagttgttttacttcggacccccaacaataacaactacttagcttaggaaccagacaagaaagtagacagccctacctaaactcctagtactttacgtgggtccttccgtacccgggctacgttcccggggttacctaaccgtattcagttggcaggcgggtctcgggacctattcactctcaccatcagcacgcctgcaggctagaagatggtgtactagtttactacgtgtacacgactaaactatttaacttacctttcgtttccgtaccgttacgtttccgggacgggaacggtaccgaagggtgaacgtactaacgaaacgtactggtcggccgtcgacctaccattcctcgttccttctaccg

SEQ ID NO: 63617 - DNA, 781 bp, Homo sapiens
  misc_feature: GYAE6OF01CM61N.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacagtcgtgatgacgcctagtttccagacctccctggctgtgtctcgtgggcgagacgggcccaccatcaactgacaacgtccagccagtagttgttttatcggaccccaccaataaccaactactagcttaggtaccagacaagaaagtaggacacgacctacctaaactcctagtactttacgtcggtcctttaccgtaccccgggctacggttaccccggggttaccctaaccgtacttaccgtaagtttcggacgtaacgggtccggggtccggttacggggtaacccgttacgttttaccgtaccttacccgtacctaaaccctaacgttaccgaacgggtcccaacggtccccgtaggacccggtaacgggtaccgtacggtaaagtaggttacgggtacgggtaccgtttaaggttttaacttaaccgtcggttaaccaacggtaacctaaaacgttagttttaacctttaccgttttaccgttttaccgttaccgttaaccggttttacccggggaacggggtaaccgggtaaccggtaaagggttacggagtaaacgtaaccgaaaacggtacgtagggtcggtctaccggactaccgtattaccgttcgtcttacgtacccg

SEQ ID NO: 63618 - DNA, 584 bp, Homo sapiens
  misc_feature: GYAE6OF01EFN4B.31.78.H01.1.454.CMB.1.raw
  modified_base (416)..(416): a, c, t, g, unknown or other
  misc_feature (416)..(416): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgaggacgggccaccatcaactgcaagtccagccagtagttgttttattcggacccccacaataacaactacttagcttggtaccagcaagaaagtaggacagccctacctaaactcctagtactttacgtgggtccttccgtacccgggctacggttccggggttaccctaaccggtattcagttcggcagggccgggtctcggggacctatttcactcncacatcagcacgcctgcgaggctagaacgtgtggtacgacttagtttactacgtgtacagtacaacttattacttactttcgttcgtcttacgttcggacggtacggacaagggtgagtactacgaaacgtagtaggcggctagacctacattcctgttcctgtaccg

SEQ ID NO: 63619 - DNA, 819 bp, Homo sapiens
  misc_feature: GYAE6OF01C4M2E.31.78.H01.1.454.CMB.1.raw
tcagcagtagacgtcacgaccggtgctcgatttagtgtgagtagtttgggtttggggaggctacaacaggcaggcaggggcgagcaagatggtgttgcagacccaggtcttcatttctctgttgctctggatctctggtgcctacggggacatcgtgatgagccagtttccagactccctggctgtgtctcgtgggcgagagggccaccatcaactgcaacgtccagccagagttgtttttattcggcccccacaaataacaactacttagcttggtaccagacaagaaagtaggacacgcctacctaaactcctgtatttacgtgggcctttacgaccccggggctacggttccccggggttaccctaaaccgtatttccgaagtttcgggaccgtaacgggtccgggggttaccttacgggggaaccccgttaatttttcccgaacccgttcctttaacccgaaccctaactttccgaaacggtccgaaccggtccccgttacggaccgtaacggggacccttagggaaaaggtacggtttacgggttacggggtaacctttaagggttttttaaactttaaccggtcggtttaacctaacgtaacccgttaaactttaattttaaccttttaacccgtttttaccgtttttcccgttaccgttaacccggtttttaccgggggaccggggtaaacggggtaaccgtaaaggggttcgggaaacgtaacgttaacccgaaaaacccggtacggttgggtccgggtaccttacggacctaacccttagttccgtttacggttccttttaccggtaccc

SEQ ID NO: 63620 - DNA, 864 bp, Homo sapiens
  misc_feature: GYAE6OF01BK1BZ.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagactccctggctgtgtctcgtgggcgagagggccaccatcaactgcaagtccagccagtagttgttttattcggaccccaacaataacaactacttagcttaggtaccagacaagaaagtggacagcctacctaaactcctgtatttacgtgggtcttacgtacccgggctacgttccccggggttacctaaaccggtactttaccaagtttcgggcctaacgggtcccgggggttccgttacgggggtaaccccgttaactttttcccggaaacctttccgtttacccgaaaccccctaagtttacccggaaaggtaccccgtaaacggtccccgtttacgggacccgtaacggggtacccgttaagggaaaacggttaacggttggggttacgggtaaccgtttaaacggttttttaaccgtttaaaccgtttcgggttaccgtaaacggtaacctaaaaccgttaatttttaaccgttaaccctttttcgtttttacccgggttaccttaacccgggtttttaccgggaccgggggtaacggggtaaaccccggtaaaggggttaccgggaacggtaaaacgttaccgtaaaaaaccgggtaaccgttagggttaaccggggtaccgttaccggtaacccgtaaaccgtttacgttaccgtttacggtttccctttaccgttaaccccg

SEQ ID NO: 63621 - DNA, 599 bp, Homo sapiens
  misc_feature: GYAE6OF01C86RM.31.78.H01.1.454.CMB.1.raw
  modified_base (319)..(319): a, c, t, g, unknown or other
  misc_feature (319)..(319): n is a, c, g, or t
  modified_base (403)..(403): a, c, t, g, unknown or other
  misc_feature (403)..(403): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaaagtccagccagagttgttttattcggccccacaataacaactacttagcttggtaccagacaagaaagtaggacagcctacctaaactcctgatttacgngggcttcgacccgggctacgtcccgggttaccaaccgtattcaattcggctaggcgggtctggggacctatttcactctcaccntcagcagcctgcgaggctagaacgatggtggctagtttatacgtgtcacgactaactattaacttactttctttacgtctacgtttcgggacggtacgggaaccgtaaggtacggagtacgtaaccgaaacggtaacgttacggtggaccgttacgacccgtaaccttaacttcgttacgttccttcgttaacccg

SEQ ID NO: 63622 - DNA, 688 bp, Homo sapiens
  misc_feature: GYAE6OF01A7Q8K.31.78.H01.1.454.CMB.1.raw
  modified_base (201)..(201): a, c, t, g, unknown or other
  misc_feature (201)..(201): n is a, c, g, or t
  modified_base (326)..(326): a, c, t, g, unknown or other
  misc_feature (326)..(326): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagtttccagactccctggctgtgtctcgtgggcgagngggccaccatcaactgacaagtccagccagagttgttttattcggcccccaactaataacaactacttagcttaggtaccagcaagaaagtaggacagcctacctaaactcctagtactttacgngggtcttcgtacccgggcacgttcccggggttacctaaccgtattccgagttcggctacggtcgggtcgtagggaccgtatttccgacctccgtaccaacctatcctaacgcacgtccctggaccgacggtctagaagtacgtggtacggacgttaacggtttattacgtcggtacgtaagtactaaacttattactttaacctttcgtttaccgttaccgttaccggttttaccgggacgggtaaccgggtaaccggtaaagggttacgggtaacgttaaccgtaacgtaaaccggtaacgttacgggtcgggttacgcggtaccgtaccctacgttacttccgttcgttacgttaacccg

SEQ ID NO: 63623 - DNA, 572 bp, Homo sapiens
  misc_feature: GYAE6OF01BJZL0.31.78.H01.1.454.CMB.1.raw
  modified_base (199)..(199): a, c, t, g, unknown or other
  misc_feature (199)..(199): n is a, c, g, or t
  modified_base (312)..(312): a, c, t, g, unknown or other
  misc_feature (312)..(312): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagngggccacatcaactgcaagtccagccagagtgtttattggccccacaataacaactacttagcttggtaccagcagaaagtaggacagcctacctaaactcctgactttacgngggtccttcgtacccgggcacgtcccggggttacctaaccgattcagttcggcagccgggtctagggacccgtatttcgactcgtcactatcagcagcctgcaggctgaacgtgtcgtggctagttttactactgtacacgactaaactattacttactttcgttacgtctaccgtttcggcgggacgtaaccgtaagggtcgagtaactacgaaacggtactggtcgactcggacactacgttactcgttctcgtaccg

SEQ ID NO: 63624 - DNA, 542 bp, Homo sapiens
  misc_feature: GYAE6OF01CIKYM.31.78.H01.1.454.CMB.1.raw
  modified_base (314)..(314): a, c, t, g, unknown or other
  misc_feature (314)..(314): n is a, c, g, or t
  modified_base (408)..(408): a, c, t, g, unknown or other
  misc_feature (408)..(408): n is a, c, g, or t
  modified_base (411)..(411): a, c, t, g, unknown or other
  misc_feature (411)..(411): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggccccaacaataacaactacttagcttggtaccagcagaaagtaggacagcctcctaaactcctgatttacngggcttctaccgggcagtccgggtcctaacgattcattggcaggcgggtctgggacctattcactctcaccatcagcagcctgcaggctgaagntgngatagtttatactgtcagcaactattacttacttctttacgtctacgtttcggcggacggaccgtaaggtcggaacgtagtaccgaaacggtactgggtcggactgacctaccattctagttcttcgtacc

SEQ ID NO: 63625 - DNA, 743 bp, Homo sapiens
  misc_feature: GYAE6OF01BY45N.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagacctccctggctgtgtctcgtgggcgagacgggcccaaccatcaactgacaagtccagccagtagttgttttagttcggaccccaacaaactaacaactacttagcttaggtaccagacaagaaagtacggacagaccctactaaactcctagtactttacgtggtccttccgtacccgggctacggttcccgggttacctaaccgtattcctaagttcggacgtacgggtcgggtacgtacggggtaccgtaactttccgaaccttcctaccgaaccctaacgtacgaacggcccgtaacgtccccgtaggaccgtacggtcctaagggaaacgtagttacggtacgggtacttaaggtttttaacttaaccgttgtaccgtacgtacctaaacttaacgtttaacttaccttttaccgtttaccgttacgtaaccggttttccggggaaccgggtaacgggtaacccgtaagggggtacgacgtaacgtaaccggtaaaaccgtaacggttggtacggtaccgttacgacccgtacctacttcgttaacgttccgttaacctacccg

SEQ ID NO: 63626 - DNA, 612 bp, Homo sapiens
  misc_feature: GYAE6OF01EH7FL.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggccccacaataacaactacttagcttggtaccagcaagaaagtaggacacgcctacctaaactcctgactttacgtgggtctttccgtaccccgggtcacgttccccgggggtttaccctaaaccggtatttcgagtttcggctacggtcggggtctcggggaccctatttccacttcctcaccatccagcagcctgcaggctagaagatggtgctagtttattactgtacagacaactattattacctttctttacgtccttacgttttccgggacgggtacgggaaccgtaagggtcggagtaacgtaaccgaaaacggtaacgtggtcggctacgacctaacctactccttacgttccttctacccg

SEQ ID NO: 63627 - DNA, 655 bp, Homo sapiens
  misc_feature: GYAE6OF01B4U3E.31.78.H01.1.454.CMB.1.raw
  modified_base (256)..(256): a, c, t, g, unknown or other
  misc_feature (256)..(256): n is a, c, g, or t
  modified_base (337)..(337): a, c, t, g, unknown or other
  misc_feature (337)..(337): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagttccagacctcccgtggctgtcgtctcgtgggcgagacggccacatcaactgacaagtccagccagtgttgttttagtcggaccccaanaataactaactacttacgcttacggtaaccagtacaaggaaacgtacggacacgacctacctaaactcctagtacttacgnggtcttaccgaccgggctacggttcccgggttacctaaccgtattcacgttcggctacgggtcgggtcgtacgggacccgttattccgactcctacgacctatcagcacgcctagcgagctagaagtacgttggtaggacgttaagtttactacgtacgtacgtaagtactaaacgttattacgtttacctttacgttccgttaacgtacggttttaccgggacgggttaaccggaccggttaaggtaacgggactaacgtaacgtaacgtacgtcggtcgacgtacgactaccgtatcctacgtcgttacgtacccg

SEQ ID NO: 63628 - DNA, 728 bp, Homo sapiens
  misc_feature: GYAE6OF01D1NDB.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagtttccagacctccctggctgtgtctcgtgggcgaggacgggcccaaccatacaactgacaagtccagccagtagttgttttattcggaccccacaataacaactacttagcttcggtaccagacaagaagtagacacgtcctacctaaactctagtactttacgtcggtcttccggtaccggctacgtccgggttacctaaccgtattcgacgttcggacgtacggcggggtcgtacggggtaccgtactttccgacttcctaccaaccgtactacgaagtccgaacgcccttaggaccgaggtcgtaaggtaacgtagttacgggtcggtacttaggttttaacttacgtcggtacaacgtaacctaaacttactttaactttaccttttaccgtttttaccgtaccgttaaccggttttcgggaccggggtaacggggtacccgtaaagggggttacggtaaacgtaacgttaaacccggtaaaaaccggtacggttaggggtacggtaccgttacggaccctaacccttacgtccgtttacgttcccttaccgtacccg

SEQ ID NO: 63629 - DNA, 733 bp, Homo sapiens
  misc_feature: GYAE6OF01B4KOX.31.78.H01.1.454.CMB.1.raw
  modified_base (364)..(364): a, c, t, g, unknown or other
  misc_feature (364)..(364): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagacctccctggctgtgtctcgtgggcgaggagggccaccatcaactgcaagtccagccagtagttgtttatcggaccccaacaataacaactacttagcttaggtaccagacaagaaagtggacagccctacctaactcctgtacttacgtggccttccgacccgggcacgtcccggggttacctaaccgtnttcagttcggacagggtccgggttcgtacgggaccgtactttcgaccgttacctccgaaccctagttccgaacggcctaacggtccctacggcgtaacgggcctaaggaaacggtagttgggttacggtaccttaaggttttaactaccgttaggtaccaaggtaactaaacgttaactttacttaaccgtttccgtttacgttaccgttaaccggttttcggggaccggggtaacggtaacccggtaaagggttacgggtaaacggtaacgttaaaccgtaaaacgggtacgttacgggtcggtaccgttacggacccgtaacccgttaactttcccggtttacgttcccgtttacccgttaacccgg

SEQ ID NO: 63630 - DNA, 748 bp, Homo sapiens
  misc_feature: GYAE6OF01AULIA.31.78.H01.1.454.CMB.1.raw
  modified_base (327)..(327): a, c, t, g, unknown or other
  misc_feature (327)..(327): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctcgtgggcgaggagggccaccatcaactgcaagtccagccagagttgttttattcggccccaacaataaccaactacttagcttggtaccagcaagaaagtaggacagtaccctacctaaactcctagtactttacgngggtccttccgtacccgggctacgttcccggggttacctaaccgtacttcagttcggaccgacggtccggggtcgtacggggtacccgtatttaccacttcctacctaaccctatccgaacggtccaacggtcccgtcgacgtacgggtacctaggaaagtacggtcgtacgggtacctttaaggtttttacttaccgtagtacctaacggtacctaaaccttaagttttacttaccgttttccgtttaccgtaccgttacggttttcccggggacgggtaacgggtaaccggtaaggggttacggtaaacgtaacggttaaacccgaaaaccgggttacgttaggggttaccgggtacccttacggtaacccctaaacccgttaggttaccccttcggtttaccctttacccggtacccg

SEQ ID NO: 63631 - DNA, 806 bp, Homo sapiens
  misc_feature: GYAE6OF01CV790.31.78.H01.1.454.CMB.1.raw
tcagcagtagacgtcacgaccggtgctcgatttagtgtgagtagtttgggtttgggggagactacaacaggcaggcaggggcagcaaggatggtgttgcagaccaggtcttcattctctgttgctctggatctctggtgccgtacgggacatcgtgatgacgcctagtttccagtacctcccgtcggtctggtcgtctcggtgggcgaggacgggcccaacactaccaactcgacaacgtccaagccgtaaggtacgtttagttttacgttaccggacccctaaacaaactaaacctaacttacgttacgtacgtttacggtaaccgagacgaaagaaacggtacggacacggtaccctaacctaaacctccgtacgtaactttaccgtcgggtacttaccggtaccgggactaaccggtccccggggttacctaaaccggtacttacgtacggttacggaccgtacggggttccggtacggttacggggtacctacgttttaccaacgtttaccaacccgtagtccgacgccacgtcccgtagtaccgtacggtagtaacggtaacgtcgttaggtacggtacgttaagtttacgtacgtagtacctaacggtaacttaacttatttaaccgtttcctttaacggttcccgaactttaccgggttaccgggacgggttaaccggtacggttaagggtacgggtacgtaaaccgttacggaaaaccgggttactagggtccggtacgtacgaccctaaccggttacttccggttaacgttcccgtaactaccccggtttacccccg

SEQ ID NO: 63632 - DNA, 533 bp, Homo sapiens
  misc_feature: GYAE6OF01CM88N.31.78.H01.1.454.CMB.1.raw
  modified_base (373)..(373): a, c, t, g, unknown or other
  misc_feature (373)..(373): n is a, c, g, or t
  modified_base (524)..(524): a, c, t, g, unknown or other
  misc_feature (524)..(524): n is a, c, g, or t
  modified_base (530)..(530): a, c, t, g, unknown or other
  misc_feature (530)..(530): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattggccccacaataacaactacttagcttggtaccagcagaaagtagacagcctcctaaactcctgatttactgggcttcgtacccgggcacgtccggggttcctaaccgattcattggcagcgggtctgggacnttcactctcaccatcagcacgcctgcaggctagaagatgtggactaggtttattactgtacagcaaatatttactactttctttcgtctaacgtttcggcggtagggaccgaaggtgagatacgaaacgatggtggctagccactatcgtntccttntac

SEQ ID NO: 63633 - DNA, 600 bp, Homo sapiens
  misc_feature: GYAE6OF01AUSLP.31.78.H01.1.454.CMB.1.raw
tcagcagtagacgtcacgaccggtgctcgatttagtgtgagtagtttgggtttgggggagctacaacaggcaggcaggggcagcaagtatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggccccacaataacaactacttagcttggtaccagcagaaagtaggacagccctacctaaactcctgatttacgtgggccttcgtacccgggctacgttccccggggttacctaaccggtattccgagtttcggcaggtcggggttaccgtggggacccgtagtttccacgtcctacaccattccagccacgcctggcagggctagaagatgtggctagtttatcgtgtcagcaactattactactttctttcgtactacgtttcgggacggtacgggaccgtaagggtcgagaagtaccgaaacggtaacttggtacgtccgtgaccgtaccctagttccgtcgttccttcgtaccg

SEQ ID NO: 63634 - DNA, 580 bp, Homo sapiens
  misc_feature: GYAE6OF01B6P3K.31.78.H01.1.454.CMB.1.raw
  modified_base (366)..(366): a, c, t, g, unknown or other
  misc_feature (366)..(366): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaaactgcaagtccagccagagttgttttattcggccccacaataacaactacttagcttggtaccagcaagaaagtaggacagcctacctaaactcctagactttacgtgggtcttaccgtacccgggctacgtcccggggttaccctaaaccgnttcgattcggcaggcgggtctggggacctattcactctcaccatcagcagcctgcaggctagaagtatggtggactagttttaacttacgtagtcaagtactaactattattacctttctttcgtactacgtttcgggacgggtacgggaccaagggtgaagtagtacgtaaaacgtatggtggctaggacctaaccattctgtccgttctacg

SEQ ID NO: 63635 - DNA, 542 bp, Homo sapiens
  misc_feature: GYAE6OF01CQHUO.31.78.H01.1.454.CMB.1.raw
  modified_base (311)..(311): a, c, t, g, unknown or other
  misc_feature (311)..(311): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggcccctacaataacaactactagcttggtaccagcagaaagtaggacagcctcctaaactcctgatttacngggcttcgtacccgggcacgttccggggttcctaacgattcattggcagcgggtctgggaccgtattcgactctcaccatcagcagcctgcaggctgaagagtgtggcagttttatactgtacagcaactattactactttctttcgtctacgtttcggacgacggaacctagggtgacgatacgaaacgtatgggtgaccgtgactaccctatccgtacgtcttcgtacc

SEQ ID NO: 63636 - DNA, 528 bp, Homo sapiens
  misc_feature: GYAE6OF01BFF6I.31.78.H01.1.454.CMB.1.raw
  modified_base (519)..(519): a, c, t, g, unknown or other
  misc_feature (519)..(519): n is a, c, g, or t
  modified_base (521)..(521): a, c, t, g, unknown or other
  misc_feature (521)..(521): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgtttattggccccacaataacaactacttagcttggtaccagcagaaagtaggacagcctacctaaactcctgatttactgggcttcgtacccgggcacgtcccggggttacctaaccgtattcattggcagcgggtctgggaccgatttcactctacaccatcagcagcctgcagctagaagatgtggactagtttatacgtgtacagacaactattactacttctttcgtcttacgttcggcggtaggaccgaggtgagatacgaaacgtatggtgctgcacatntntctctac

SEQ ID NO: 63637 - DNA, 660 bp, Homo sapiens
  misc_feature: GYAE6OF01C2XZI.31.78.H01.1.454.CMB.1.raw
  modified_base (332)..(332): a, c, t, g, unknown or other
  misc_feature (332)..(332): n is a, c, g, or t
  modified_base (371)..(371): a, c, t, g, unknown or other
  misc_feature (371)..(371): n is a, c, g, or t
  modified_base (590)..(590): a, c, t, g, unknown or other
  misc_feature (590)..(590): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagcgggccaccatcaactgcaagtccagccagtagttgttttacgttcggaccccaaccaaataaaccaactaacttagcttacggtaccagacaagaaagtaggacacgcctacctaaactcctgtatttacgngggtcttcgtacccggctacgtccgggttaccaaccgtnttcagttcggcgtacggcgggtcgtcgggactactttccgacctctacaccatcacgcacgtcctgacgaggctagaagtagtggtcgacttaagtttacttaacgtggtacaacggtactaaacgttatttaacttaccgttttaccgtttacgttacctaccggttttacggggacccgggtacgggtaaccgtaaaggggtacgggaaacggtaanaacccggtaaaaccggtaagttcggtaacgggtctacgcgtaacccattccgtaggtcctttagtacccg

SEQ ID NO: 63638 - DNA, 629 bp, Homo sapiens
  misc_feature: GYAE6OF01BZMRY.31.78.H01.1.454.CMB.1.raw
  modified_base (276)..(276): a, c, t, g, unknown or other
  misc_feature (276)..(276): n is a, c, g, or t
  modified_base (332)..(332): a, c, t, g, unknown or other
  misc_feature (332)..(332): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagacctccctggctgtgtctcgtgggcgaggacgggccaccatcaactgcaagtccagccagtagttgttttattcggccccaaccaataacaactacggttancttaggtaccagacaagaaagtaggacacgcctacctaaactcctagtacttacgngggtccttccgacccggctacgtcccggggttacctaaccgtattcgagttcggctaggcgggtcgtcgggaccgtatttccactctccactatcagcacgcctgcgacggctagaagtctgtgtctagtttatacgtagtcagtacaactattacttaacctttccgtttacgttaccgttaccggtttcgggacgggtacggtaaccgtaagggtaggaacgtaacgtaaccgtaaacggtacgttaggtcggtccgtacgacctaccgtacttaccgtcgttcctccgttaccg

SEQ ID NO: 63639 - DNA, 523 bp, Homo sapiens
  misc_feature: GYAE6OF01AOKTC.31.78.H01.1.454.CMB.1.raw
  modified_base (486)..(486): a, c, t, g, unknown or other
  misc_feature (486)..(486): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacaactacttagcttggtaccagcagaaagtaggacagcctcctaaactcctagatttactgggtccttcgtaccccgggcactccggggttacctaaccgattccattggcagcgggtctgggacctattcactctcaccatcagcagcctgcaggctgaagatgtgctagtttatactgtcagcaatattatacttcttcgtctacgtttcggcggtacggaccaggtgganatacgaaacgatgcggctgctaccatctgtctcgtac

SEQ ID NO: 63640 - DNA, 618 bp, Homo sapiens
  misc_feature: GYAE6OF01DKAHZ.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagactccctggctgtgtctcgtgggcgaggacgggccaccatcaactgacaagtccagccagagttgttttattcggacccaccaataacaactactagcttaggtacagcaagaaagtagacacgcctacctaaactcctagtactttacgtcgggtccttccgtacccgggctacgttcccggggttacctaaccggtattcagttggcagggtccgggttcgtacgggaccgtactttcactctacacctatcagcacgcctgccgagctagaagtatggtgactagtttactacgtgtacaagtacaaactatttactaacttcgtttacgtctaaccgtttcgggacggacgggtaacctaagggtgaacgtaagtaccgaaaacggtacgtggtcgggacctacgacctaacctattacccgttgttccttacgttacccg

SEQ ID NO: 63641 - DNA, 530 bp, Homo sapiens
  misc_feature: GYAE6OF01A5SIH.31.78.H01.1.454.CMB.1.raw
  modified_base (411)..(411): a, c, t, g, unknown or other
  misc_feature (411)..(411): n is a, c, g, or t
  modified_base (523)..(523): a, c, t, g, unknown or other
  misc_feature (523)..(523): n is a, c, g, or t
tcagcagtagacgtcacgaccggtgctcgatttagtgtgagtagtttgggtttgggggagctacaacaggcaggcaggggccgcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactactagcttggtaccagcagaaagtaggacagcctacctaaactcctgatttactgggcttcgtacccgggcagtcccggggttcctaaccgattcattggcagcgggtctgggaccgatttcactctcaccatcagcagcctgcaggctgaagntgtggcagtttattactgtcaagtcaactattatacttctttacgtctactttcggcggagggaccaagggtggagatacgaaacgacgtgtcggctgcaccgatctgtctnattcccg

SEQ ID NO: 63642 - DNA, 747 bp, Homo sapiens
  misc_feature: GYAE6OF01AC4T2.31.78.H01.1.454.CMB.1.raw
  modified_base (370)..(370): a, c, t, g, unknown or other
  misc_feature (370)..(370): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgacaagtccagccagtagttgttttattcggaccccacaataacaactacttagcttcggtaccagcaagaagtggacagccctacctaactcctgtactttacgtcgggtccttccgtacccgggctacggttcccggggttacctaaccggtnttcgagttcggacgtacgggtcggggtcgtacggggtacccgtactttcacctccgtaccctaaccgtataccgaggtccgacggtccctcggtaccgacgggtaccgttaagggaaaggtcgttaggttacgggtaccttaggtttttaacttacgtaggttaccgtaacggacctaaaccttaactttaacgtttaccgttttaccgttttaccggttacctttaaccgggttttaccgggaaccggggttaacgggtaacccggtaaagggggttcggtaaacgtaacgtaaccggtaaaacggttaccggttgggtaccggtacttacggtaccgtaacccgtagttaccgtcgtttaccgttccgttacccg

SEQ ID NO: 63643 - DNA, 631 bp, Homo sapiens
  misc_feature: GYAE6OF01DFKXY.31.78.H01.1.454.CMB.1.raw
  modified_base (378)..(378): a, c, t, g, unknown or other
  misc_feature (378)..(378): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagtttccagactccctggctgtgtctcgtgggcgagacgggccaccatcaactgcaacgtccagccagtagttgttttattcggccccacaaataaacaactaacttagcttaggtaccagacaagaaagtaggacacgcctacctaaactcctagtatttacgtcgggtcttccgtacccgggactacgtacccggggttaccctaaaccgtnttcagttcggccgtaggtcgggtcgtcggggaccgtagttcactctcaccactacacgcagtccctgacgaggtcgtagaacgtagtggtcggacttagttttactacgtgtacacgtactaactatttaactactttcttacgtctacgtttcgggacgggtacggtaaccgtaggtaggaagtacgtaccgtaaaacggtacgttggtcggaccgtgaccctaactacttacgtacgttccttccgtaccg

SEQ ID NO: 63644 - DNA, 546 bp, Homo sapiens
  misc_feature: GYAE6OF01BUPUQ.31.78.H01.1.454.CMB.1.raw
  modified_base (390)..(390): a, c, t, g, unknown or other
  misc_feature (390)..(390): n is a, c, g, or t
  modified_base (426)..(426): a, c, t, g, unknown or other
  misc_feature (426)..(426): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacaactacttagcttggtaccagcagaaagtaggacagcctacctaaactcctagtactttacgtgggccttccgtacccgggctacgtcccggggttacctaaaccgattcagttggcaggcgggtctgggaccgtntttcactctcaccatcagcagcctgcaggctgaagntgtggctagtttatacgtgtcagacaactattatactttcttcgtactacgtttcggcggacggtaccgaggtgagtatacgaaacgtactggtcgctgaccactatactgtcttctacg

SEQ ID NO: 63645 - DNA, 700 bp, Homo sapiens
  misc_feature: GYAE6OF01AQ0H9.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagttgttttattcggccccacaataacaactacttagcttggtaccagcaagaaagtaggacagcctacctaaactcctagtactttacgtgggtcttaccgtacccgggctacgttcccggggtttaccctaaaccggtacttaccgagtttcgggctacgggtccggggtcctacgggggtacccgtattttccaaccgttcctaccaacccgtattaccgaaggccaacggtccctggaccgacgggtaccgttaggaaacgtacgttggtacggtacttaaggttttacttaacgttacgtaccgtaacgtacctaaactaactttaacttaccttttaccgtttccgttaccttacggtttccgggacgggtaacgggtaaccgtaagggtaggaacgtaactaccgaaaacggtacgtggtaccggtctacgacctaacctacgttactcggttccttgtacccg

SEQ ID NO: 63646 - DNA, 566 bp, Homo sapiens
  misc_feature: GYAE6OF01BV3II.31.78.H01.1.454.CMB.1.raw
  modified_base (440)..(440): a, c, t, g, unknown or other
  misc_feature (440)..(440): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggccccacaataacaactactagcttggtaccagcaagaaagtaggacagcctacctaaactcctagtactttactgggtccttccgtacccgggctacgttcccggggtttacctaaccgtattcagttcggcgacggcgggtcgtgggaccgtatttcactctacaccactacacgcacgcctgcgaggctagaagntgtggacttagtttactctagtcagtacaactaattacttaacttctttcgtctacgtttcggcggacgggacctaagggtcgagtatacgaaccgatggcgctgacctacatctcgtcttcgtac

SEQ ID NO: 63647 - DNA, 570 bp, Homo sapiens
  misc_feature: GYAE6OF01BWGM1.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcaggagggccaccatcaactgcaagtccagccagagttgttttattcggccccacaataacaactactagcttggtaccagcagaaagtaggacagcctacctaaactcctgtatttacgtgggtcttcgtacccgggctagtccgggttcctaacgattcagttggcagcgggtctgggaccgtatttcactctccacatcagcacgcctgcaggctagaagagtgtggactagtttatactgtcagactaactattacttactttcgtttacgttccttacgtttcggacggtagggaaccgtaagggtaggagaacgtaaccgaaacggtaacgtggtcggctacggactaccgtatcttcgtacttctaccg

SEQ ID NO: 63648 - DNA, 651 bp, Homo sapiens
  misc_feature: GYAE6OF01CP4F1.31.78.H01.1.454.CMB.1.raw
  modified_base (267)..(267): a, c, t, g, unknown or other
  misc_feature (267)..(267): n is a, c, g, or t
  modified_base (464)..(464): a, c, t, g, unknown or other
  misc_feature (464)..(464): n is a, c, g, or t
  modified_base (634)..(634): a, c, t, g, unknown or other
  misc_feature (634)..(634): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagacctccctggctgtgtctcgtgggcgagagggccaccatcaactgcaagtccagccagagtgtttatgtccgaccaataaacaacctaacttanacgttcgtaccgtaacgacgacgaaaggtaaggtacgacgccgtaccctaaaccttaacctcgtaagtttacttacgggtcgttcttacccgggacccgtacgtaccgggtttacccggttaacctaacgttctactgtcgacgcgggtcgtcgggtaccggtacttctacacttcaccactctagcacgtccgtcngacgcgtagagaatgtgcgtatttattactgtcagactaaactagttaactttactttacccgtttcgttcctacgttttaccggtcgggaccgggaacgtaaccgggtagggtacgaacttaccgaaaaccggtaaagtcggttcgggacgttgacctaccctaacttntccgttctttcctaccg

SEQ ID NO: 63649 - DNA, 616 bp, Homo sapiens
  misc_feature: GYAE6OF01AW8W1.31.78.H01.1.454.CMB.1.raw
  modified_base (366)..(366): a, c, t, g, unknown or other
  misc_feature (366)..(366): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagttgttttattcggccccacaataaccaactacttagcttggtaccagcaagaaagtaggacagccctacctaaactcctagtactttacgtgggccttccgtacccgggcacgttcccggggttacctaaccgtnttcagttggcaggtcgggtcgtgggacctatttccactctcacctatcagcacgcctgcgaggctagaagtagtggtgcttagtttatactgtacagactaactatttacttacctttctttacgtccttaccgtttcgggaccggtacgggaaccgtaagggtacggaacgtaacgtaaccgtaaaacgtacgtaggtcggacgtacggacctaacccgtacttacgttcgttccgttaccgttacccg

SEQ ID NO: 63650 - DNA, 603 bp, Homo sapiens
  misc_feature: GYAE6OF01A9KBH.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactactagcttggtaccagcaagaaagtaggacagccctacctaaactcctagtactttacgtgggtcttccgtaccccgggctacgttccccgggggttaccctaaaccggtatttccagtttcggcagggtccggggtcgtcggggacccgtatttccactcctcacctatcacgcacgcctcggcacggaccgaagatggtcggtctagtttattacgtgtacagactaattattattacctttctttccgtactacgtttccgggacggtacgggacctaagggtggacgtactaccgaaacgtacgtggtcggctagaccacctatcctattcttctcgttccc

SEQ ID NO: 63651 - DNA, 607 bp, Homo sapiens
  misc_feature: GYAE6OF01ANWYO.31.78.H01.1.454.CMB.1.raw
  modified_base (373)..(373): a, c, t, g, unknown or other
  misc_feature (373)..(373): n is a, c, g, or t
  modified_base (416)..(416): a, c, t, g, unknown or other
  misc_feature (416)..(416): n is a, c, g, or t
  modified_base (429)..(429): a, c, t, g, unknown or other
  misc_feature (429)..(429): n is a, c, g, or t
  modified_base (477)..(477): a, c, t, g, unknown or other
  misc_feature (477)..(477): n is a, c, g, or t
  modified_base (601)..(601): a, c, t, g, unknown or other
  misc_feature (601)..(601): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagtttccagacctccctggctgtgtctcgtgggcgagagggccaccatccaactgcaagtccagccagagttgttttattcggcccccacaactaacaactacttagcttcggtaccagcaagtaaacggtaggacacgcctacctaaactcctagtactttacgtgggccttcgtacccgggctacgtcccggggttacctaaccgtnttctagttcggcaggtcgggtctgggacccgtattcgacctcncaccgatcgagcncgtctgcgaggctagaagtgtcggtgtacttagtttactcgtgtaccngtacaacgttatttagtacctttcttacgtctacgttcgggacggtacgggactaagggtcgaagtacttaaccgaaacgttagtaggtcggctacacccgtactagttaccttgtacccgttntacccg

SEQ ID NO: 63652 - DNA, 617 bp, Homo sapiens
  misc_feature: GYAE6OF01BN338.31.78.H01.1.454.CMB.1.raw
tcagcagtagacgtcacgaccggtgctcgatttagtgtgagtagtttgggttggggagctaacgaaccaaggcacggcaggggcagccaagatggtgttgcacgacccaggtcttcgagtttcctcgtgttgctcttggtatcgtctggtgccgtacggggacagtcgtcgatcgagtccagtttccagacctccctggctgtgtctcgtgggcgagagggccaccagtcaactgcaagtccagccagagttgttttattcggccccacgtaataactaacttacttagcttaggtaccagtcagaaagtggacacgcctacgtaactccgtagtactttacgtgggcttccgacccgggctacgttcccgggttacctaaaccgtattcgagttggcgaggcgggtctcgggaccgtatttcgactctacaccatcagcacgcctgccaggctagaagtatgtggacgtagtttatacgtgccagacaactattaactaccttcgtttcgtaccttacgtttcggacggtacggaccgtaaggtggacgtaagttacgaaacgtacgttggttcggcgtgaccgtaaccgtacttccgttcgttccgttcgtaccg

SEQ ID NO: 63653 - DNA, 580 bp, Homo sapiens
  misc_feature: GYAE6OF01AXTW7.31.78.H01.1.454.CMB.1.raw
  modified_base (316)..(316): a, c, t, g, unknown or other
  misc_feature (316)..(316): n is a, c, g, or t
  modified_base (419)..(419): a, c, t, g, unknown or other
  misc_feature (419)..(419): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacaactacttagcttggtaccagcaagaaagtaggacagcctacctaaactcctagactttacngggtcttccgacccgggcaacgtccggggttacctaaccgattcattggcagcgggtctgggacctatttcactctcacatcagcagcctgcaggctagaagngtgtgctagtttatactgtcagacaactatttatactttcttcgtctacgtttcgggacggtacgggacctaagggttcggaagtaacgtaccgaaaacggtattcggtaacggccttaggacctaacccgtaagttacccgttcggttccttctaacccg

SEQ ID NO: 63654 - DNA, 541 bp, Homo sapiens
  misc_feature: GYAE6OF01B9KHI.31.78.H01.1.454.CMB.1.raw
  modified_base (229)..(229): a, c, t, g, unknown or other
  misc_feature (229)..(229): n is a, c, g, or t
  modified_base (327)..(327): a, c, t, g, unknown or other
  misc_feature (327)..(327): n is a, c, g, or t
  modified_base (382)..(382): a, c, t, g, unknown or other
  misc_feature (382)..(382): n is a, c, g, or t
  modified_base (537)..(537): a, c, t, g, unknown or other
  misc_feature (537)..(537): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagngtgtttattcggccccacaataacaactacttagcttggtaccagcagaaagtaggacagcctctaaactcctgatttactgggcttcgtacccgggnagtcccggggttcctaaccgattcagtttggcaggcgggtctgggacctatttcnctctcaccatcagcagcctgcaggctagaagatgtggctagtttatactgtcagacaactattatacttctttcgtctacgtttcgggacggagggaccaagggtcgagactacgaaacgtatggtggtactgacctaccattacctgttccttntacg

SEQ ID NO: 63655 - DNA, 811 bp, Homo sapiens
  misc_feature: GYAE6OF01CLLVC.31.78.H01.1.454.CMB.1.raw
  modified_base (184)..(184): a, c, t, g, unknown or other
  misc_feature (184)..(184): n is a, c, g, or t
  modified_base (198)..(198): a, c, t, g, unknown or other
  misc_feature (198)..(198): n is a, c, g, or t
  modified_base (213)..(213): a, c, t, g, unknown or other
  misc_feature (213)..(213): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctcgtggtcgaccgtacgggacatcgtgagtgacgcctagttccagcctccgnggctgtcgtctcgnggcgagcggccacgntacaacgtcgactaacgtccagtccagtagtttcgtttactccggaccctaaactaaactaacctaaacttaccgttacgtcgttacggtaaccgagaagtaacggtaaaggtacggaactacgtacccttaacctaacgtcctagtaactttacggcggtaccttacccggtaccggactaccggttacccgggttacctaaccgtattacctagttcggacgtacgggtcggttacggacggtacgttaaccttcgtacctacctaccaacgtacgtaccgacgtcgtaccgtccgtacgaccgtacggcgtaaggaacgtaggttacggtcggaacctttaagtttacgttaccgtaacgaacgtacgtaaacttaaaccttaagttttaccttaaccgtttccgttaaccgggtaccctttaaccggggtttacgggaacccgggttaacggggttaaaccgtaaagggggttaccggaaacggttaacctaaacccgggtaaaaccggtaggtttaccgggtaccggtacgtaaccgtaaacccggttaccttacgttaccccgttgtttaaacccgttcccgtttaccccgg

SEQ ID NO: 63656 - DNA, 738 bp, Homo sapiens
  misc_feature: GYAE6OF01BI6EA.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagttccagacctcccgtggctgtgtctcgtgggcgaggcgggccaccatcaactgacaacgtccagccagtagttgttttattcggaccccacaataacaactacttagcttaggtaccagacaagaaagtacggacacgccctacctaaactcctagtactttacgtgggtccttccggtacccgggctaccggttacccggggttaccctaaaccgtattccgtaagtttcggacgtacgggtcggggttacctacggggtacccttagtttccaaccgttccgtaccaaccataccaacgccgaacgtcccgtaggaccgacgggtactaaggaagtacgtagggtacggtaacgtttaaggttttaactaccgttacggtactaacgtaacctaaacgttaattttaactttaacccttttccgtttacccgttacgttaacccggtttcggggaccgggtaacgggtaaccgtaaggggtacggtaacggtaaacgttaccggaaaacgtaacgttgggtacgaccgtcgtaccaacccgttagtacccgttgttcccttacgtaccc

SEQ ID NO: 63657 - DNA, 724 bp, Homo sapiens
  misc_feature: GYAE6OF01DKV68.31.78.H01.1.454.CMB.1.raw
  modified_base (477)..(477): a, c, t, g, unknown or other
  misc_feature (477)..(477): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtcgccgtacggggacatcgtgatgacgcctagttccagcctcccgtggctgtcgtctcgtgggcgaggacggccaaccatacaactgacaacgtccacgccaagtagtttagtttttacgttccggaccccctaacaaaataaacaaaccttacttagtccgtttaggaacccagacaaagaaaggtacggaacacgacctacctaaactcctagtacttacgtcgggtctaccgaccgggtctaccggttcccgggtttacctaaaccgtattacctagttcggacgacgggtcgggtacgtacggaacgttacttcgaacttctaccaactacgcacncgacgctaggacgacggctaaggaaaggtactgggttagaccgttagttttaacttacgtacgttacaacgtaactaaacttaactttagttaacctttccgtttaccgttaccgttacggttttaccggggaacgggtaacggggaaacccgtaaggggtacggtaaagtaacccgtaaacgaaaacgtaaccggtggtaccggtctacggaaccacgttacttacgttcttaccttcggtaaccc

SEQ ID NO: 63658 - DNA, 600 bp, Homo sapiens
  misc_feature: GYAE6OF01D5EG5.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgacaagtccagccagagttgttttattcggccccacaataacaactacttagcttggtaccagcagaaagtaggacagcctacctaaactccttagactttacgtgggtcttccgtacccgggctaacgtccggggttacctaaaccggatttcagtttcggcagggtcgggtcgtcgggaccgtatttcactcctcaccatcagcacgcctgcaggtctagaagagtggtggctagtttattacgtgtacacgactaactatttacttactttctttacgtctacgtttcggacgggtacggaacgtaagggtacgaaggtactaaccgtaaaacgtacgttggtacgggctacgacgtacctacgttctacgttcttcgtacc

SEQ ID NO: 63659 - DNA, 572 bp, Homo sapiens
  misc_feature: GYAE6OF01ADBSB.31.78.H01.1.454.CMB.1.raw
  modified_base (443)..(443): a, c, t, g, unknown or other
  misc_feature (443)..(443): n is a, c, g, or t
  modified_base (563)..(563): a, c, t, g, unknown or other
  misc_feature (563)..(563): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggccccacaataacaactacttagcttggtaccagcaagaaagtaggacagccctacctaaacctcctagtactttacgtgggtccttccgtacccgggctacgttcccggggttacctaaccgtattcagttcggctaggtcgggtcgtcgggtaccgtatttcactctacacctatcgagcagcctgcaggctagaagtntgtgctagtttatactgtcagacaactattactactttctttcgtactacgtttcggacggtacggtaccgtaggtgagtagtacgaaacgtacgtggtcgctgacctacctattccgtnttctgtacc

SEQ ID NO: 63660 - DNA, 730 bp, Homo sapiens
  misc_feature: GYAE6OF01B4WW8.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagacctccctggcttgtgtctcgtgggcgaggacgggccaccatcaactgcaagtccagccagtgttgttttattcggaccccaacaataaccaacttacttagtccttggtaccagacaaggaaagtaggacacgccctacctaaactcctagtactttacgtgggtccttaccgtacccgggctacgttccccggggttaccctaaccgtattaccgagtttcggaccgtagggccggggttaccgtcggggtacccgtacttttccacgttccctacctaacccgtatccgaacgaccacggtccctggaccgtagggtctaggaacgtagttgggtacggtacgttaagttttacgttaccgttggtacaacgtacctaaattacgtttaacttaccgttttcctttcggttacccgttacggtttccggggacgggtaacgggtaaccggtaaggggttacggaaacgtaacggtaccgtaaaaccggtacggttacgggtcggtaccgtacggacctaacccgtacgtttccgttcgttccttaccgtacccg

SEQ ID NO: 63661 - DNA, 872 bp, Homo sapiens
  misc_feature: GYAE6OF01DBYI9.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagacctcccgtggctgtgtctcgtgggcgaggacgggccacatcaactgcaagtccagccagtacgttgtttttattccggacccaactaaataacaacttacttacgcttaggtaccagcaagaaagtggacacgcctacctaaactcctagtacgtttacgtcgggtcctttaccgtacccgggactaccggttcccggggtttaccctaaaccggtctttaccgagtttcggacctaacggggtcccggggttacgttaccgggggtaacccgttacttttacccgaccgtttacccttacccggaaaccctacgtttaccgaacggacccgtaacggtcccgttacgggacccgtaacggggtaccgttaacggaaacggttaaccggtttgggttaccggggtaacctttaagggtttttttaaccgtaaccggtttacggtttaaccgtaaaccggtaacttaaaaccgtttagtttttaaaccttttaacccgtttttcccgttttacggttaaccccgtttacgggtttttacccggggacggggttaaccggggtaacccgtaaaggggttccggggaaaacggttaacgttaaacccgggtaaaacggtaaccgttacgggtaccgggtaccgttaccgaaccgttaaccccgtattacccgtttcgtttacccgttaccttaaccccgg

SEQ ID NO: 63662 - DNA, 685 bp, Homo sapiens
  misc_feature: GYAE6OF01B4IU7.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagacctccctggctgtgtctcgtgggcgaggacggccaccatcaactgacaagtccagccagtagttgttttagttcgccccaacaataacaactactagcttggaccagacaagaaagtagacacgacctacctaaactcctagtactttacgtgggtccttccgtacccgggctacggtcccggggttacctaacgtcttcagttcggacgtaggtcgggtcgtgggaccctatttccacctctaccaccatcgacgctacgcctcgaccgaggtacgtagaaacgtgtggttaggtaccttaaggttttacttacgtgtacgaacgtaactaaacttactttaacttaccttttccgtttacgttaccgttaccggtttaccggggaccgggtacgggtaaccggtaaagggttagaaacggtaactaacccggtaaacggtacggttacggtacgggtaccgtaacgtaccctaaccgtacgttaccttacggttccttcccgttaccg

SEQ ID NO: 63663 - DNA, 691 bp, Homo sapiens
  misc_feature: GYAE6OF01A29JV.31.78.H01.1.454.CMB.1.raw
  modified_base (337)..(337): a, c, t, g, unknown or other
  misc_feature (337)..(337): n is a, c, g, or t
  modified_base (359)..(359): a, c, t, g, unknown or other
  misc_feature (359)..(359): n is a, c, g, or t
  modified_base (465)..(465): a, c, t, g, unknown or other
  misc_feature (465)..(465): n is a, c, g, or t
tcagcagtagacgtcacgaccggtgctcgatttagtgtgagtagtttgggtttggggagctacaacaggcaggcaggggcagcaagatggtgttgcagacccaggtcttcatttctctgttgctctggatctctggtgccgtacggggacatcgtgatgagcctagtttccagactccctggctgtgtctcgtgggcgagaggccaccatcaactgcaagtccagccagtagttgttttactcggccccaactaaataacctaactacttagtcgttacggtaaccaggaccaaggaagtaacggacacgcctacctaaactcctagtactttacgngggactttccgaaccccgggtnaacgttcccggggttcccaaaccgtattccaaggttggcctacggtcgggtcctggggaccctagtttccactcgtacaacacttcgagcaggtccctgacacgtntacgaaagtcgtgggtcgtaccttagttttactacgttcgtacgagacccgtaaatagtttaccttaccttttacgttccgttacggttaacccgtttgggaacccgggaaggtaaccgaagggttcgggtaaacacgttaacgaaaacccggttactaagggtttcgggacccttaccggacccttaaccgaacgttcgttacccgttaacgtttcccgtaacgg

SEQ ID NO: 63664 - DNA, 1022 bp, Homo sapiens
  misc_feature: GYAE6OF01EZEN2.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctcgtgggcgagagggccaccatcaactgcaagtccagccagtagttgttttattcggccccaacaataacaactacttagcttggtaccagcaagaaagtaggacagcctacctaaactcctgtactttacgtgggtccttccgtacccgggctacggttcccgggggttaccctaaccggtatttaccgaagtttcggaccgtaacgggtccgggggttaccgtacgggggtaaccccgttaacgttttcccgaaccgtttacccgttaccctaaccccgtaacgtttcccgaacggtacccgtaacggtcccccctttagggaccccgtaacgggggtaccccgttaaagggtaaaacgggtaacggttttacgggggttaaccggggttacccgtttaaacggggttttttttaaaccgtttaacccggtttttacgggttaacccgtaaaccgggtaaacccctttaaaaaccgtttaaaccgtttttttaaaccgttttaaaccccgttttttttaccccggttttttaccccgggtttaaccccggttttaaacccgggtttttttaccccggggggaaccccgggggtttaaaaccgggggggttaaaacccccggtttaaaagggggggggtttaaccggggtaaaccgggttaaaaccggttttaaaacccccgggtaaaaaaaccggggtttaaaacccggtttacgggggtttaaccggggtacccccgttttaaaccggggaacccccttaaaaccccggttaacggttttaccccggttttaacccgggtttacccgttttaacccccgttaaaccccgg

SEQ ID NO: 63665 - DNA, 816 bp, Homo sapiens
  misc_feature: GYAE6OF01DR1H0.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagttccagactccctggctgtgtctcgtgggcgaggacggccaccatcaactgacaagtccagccagtagttgttttattccggaccccaactaaataaaccaactacttagtcttacggtaacctagacaaaggtaaaagtacggaacacgtaccctaacctaaaacgtccgtagtaactttacggtcggggtacctttaccggtaacccggggtactaacggttccccgggggttaaccctaaaccggtactttaccgtaacgttcgggactaacggggtcccggggttacgtaccgggggtaaccccttagttttacccgaaccgttaccgtacccaaaccgtacttccgaaacggcctaacggtcccctaggtaccgacgggtcctaaggtaaagaacgttcgggtacggtacgttaagtttttactaacgttggtacgtaacgaactaaacgttatttacttaaccgttttccgtttaccgtacttaacggttttccgggaacggggttacgggaaaccggttaagggtacggtaaaggtaaacctaaaccgggtaaaaacggtaaccgttacgggttaccgggaccttacggtaaaccccgtaaccgttacttacccggtttacgtacccgtttaccgtaacccgg

SEQ ID NO: 63666 - DNA, 634 bp, Homo sapiens
  misc_feature: GYAE6OF01ALHA0.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagttgttttattcggccccacaataacaactactagcttggtaccagcaagaaagtaggacacgcctacctaaactcctagactttacgtgggtcttccgtacccgggctacggttcccggggttaccctaaccgtacttcgtagttcggcgaggtcgggtccgtacggggacccgtactttccaccttcctaccaaccatccgagttacgcctgcgacggtcgtagaaagtagttggtcggtacttagtttacttacgtgtacgagtactaatacttattcctttactttcgtactacgtttcgggacgggtacggtaccgtaagggtggacgtacgtaaccgaaaccggtacgtggtacggtctacgacctaccgtagttcgtagttccttactcgttccccg

SEQ ID NO: 63667 - DNA, 618 bp, Homo sapiens
  misc_feature: GYAE6OF01DIQYE.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagacgggccaccatcaactgcaagtccagccagagttgttttattcggccccacaataacaactacttagcttaggtaccagacaagaaagtaggacagcctacctaaactcctgtatttacgtgggctttcgtacccgggctacgttcccggggttacctaaccgtattcagttcggcaggcggtcgtgggaccgtattccactctcaccatcagcagcctgcaggctagaacgtatggtggctagttttatacgtgtcaacgactaactatttaacttaccttttacgttttcgtacttaccgtttcgggaccgggtacgggtaacccgtaaagggtggaacgtaactaccgtaaaacggtacgttggtacgggccttaggaccctaaccgtacttccttacggttccttccgtaaccg

SEQ ID NO: 63668 - DNA, 546 bp, Homo sapiens
  misc_feature: GYAE6OF01BQ0S2.31.78.H01.1.454.CMB.1.raw
  modified_base (429)..(429): a, c, t, g, unknown or other
  misc_feature (429)..(429): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggccccacaataacaactacttagcttggtaccagcaagaaagtaggacacgcctacctaaactcctgtatttacgtgggccttccgtacccgggctacgtcccggggttcctaaccgattcattcggctaggccgggtctgggaccgtatttcactctcaccatcagcacgcctgcaggctagaagngtgtgctagtttatacgtgtcagacaatattatactttctttcgtctacgtttcggacggtaggaccaagggtggagacgtacgaaacgtatggtcggctgctacatctgtctctac

SEQ ID NO: 63669 - DNA, 651 bp, Homo sapiens
  misc_feature: GYAE6OF01EBYRP.31.78.H01.1.454.CMB.1.raw
  modified_base (323)..(323): a, c, t, g, unknown or other
  misc_feature (323)..(323): n is a, c, g, or t
  modified_base (370)..(370): a, c, t, g, unknown or other
  misc_feature (370)..(370): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacgggacatcgtgatgagccagtttccagacctccctggctgtgtctcgtgggcgagaggccaaccatcaactgacaagtccagccagtagttgttttattcggaccccaacaataacaactacttagcttgtaccagcaagaaagtaggacagccctactaaactcctagtactttacgngggcctttccgtacccggctacgttcccggggttaccctaaaccgtnttacgagttcggcagggtccgggtcgtcggggaccctatttccgactccgtccaaccgatcacgcgacgccgtgacgaggtctagaacgtagtggtacggacgttaagtttacttacgtgtcgaagtactaactatttaacttactttcgtttcgtacttaccgtttacgggacggtacgggtaacccgtaaggtacggtagaacgtaaccgtaaaccggtaagtcggttacggaccgttggaacctacccgtagttacccgttcgttccttccgtacccg

SEQ ID NO: 63670 - DNA, 710 bp, Homo sapiens
  misc_feature: GYAE6OF01CH35T.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagactccctggctgtgtctcgtgggcgaggacgggccacatcaactgacaagtccagccagtagttgttttattcggccccaacaaataacaacttactagcttaggtaccagacaagaaagtaggacagcctaactaactctatactttacgtgggtacctttccgacccgggtctacggtttcccggggttaccctaaaccggtattacgacgtttcggacgtacggtcggggttcgtacggggacccgtaacgtttccaccgtcctacgaacctagtccgaacgccgacgccgtcgacggacggtacctaggaaagtacgtaggtcggtacttaaggttttattacgtcgtacgtagtactaactactttacttaccttttaccgtttccgtacgttaccggtttccgggaacgggtacgggtaaaccgtaagggttacggaaacgtacgtaaaccgtaaacggtaacgttggtcgggtaccgttacggacctaacccggttattccgtttacggttaccctttccgtaaccccg

SEQ ID NO: 63671 - DNA, 630 bp, Homo sapiens
  misc_feature: GYAE6OF01CWFOJ.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagtttccagactccctggctgtgtctcgtgggcgagagggccaccgtcaactgaccaagtccagccagtagttgttttattcggaccccaacaataacaactacttagtcttggtaaccagacaaggaaagtaggacacgcctacctaaactcctagtatttacgtcggtcctttccgtacccgggctacggttcccggggttacctaaccggtattccagtttcggacgtacggccgggttcgtacgggacctatttccactcctacaccactcacgcacgcctgcgaggctagaagtgtggtcgtacttagtttatacgtcgtacagtactaattattacttactttcttacgtcgttacgttcgggacggtaagggtaccgtaaggtacggaagtactaccgaaaacgtacgtaggtacggtctacgaccacttactacgttacgttccttccgtcttccccg

SEQ ID NO: 63672 - DNA, 582 bp, Homo sapiens
  misc_feature: GYAE6OF01DGTB6.31.78.H01.1.454.CMB.1.raw
  modified_base (572)..(572): a, c, t, g, unknown or other
  misc_feature (572)..(572): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacaactacttagcttggtaccagcagaaagtaggacacgcctacctaaactcctgtatttactgggctttccgtacccgggctacgtcccggggttacctaaccgtattcctagttcggcacgggtccgggtcgtcggggtaccgtatttcactctacaccatcacgcacgcctgcaggcagaagatggtggctaggtttattacgtgtcagctaactatttaacgttactttctttcgtctacgtttcggcgggtacgggaccgtaagggtggacgtatacgaaaacgtactaggtggcctgacctaacctactcgttntccttctacg

SEQ ID NO: 63673 - DNA, 565 bp, Homo sapiens
  misc_feature: GYAE6OF01DTZ94.31.78.H01.1.454.CMB.1.raw
  modified_base (356)..(356): a, c, t, g, unknown or other
  misc_feature (356)..(356): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagtagttgttttattcggccccacaataacaactacttagcttggtaccagcaagaaagtaggacagcctactaaactcctgatttacgtgggcttcgacccgggctacgtcccggggttcctaaaccgnttcagttcggcaggcgggtctgggaccgtatttcactctcaccatcagcagcctgcagctgaagatgtggctagtttattactgtcagcaactattaattacttctttcgtctacgtttcggacggtagggaccgtaaggtggaagtacgtacgaaacgtaagttggtcggacgttgacctaaccgtaacttcgttcgttcttctaccg

SEQ ID NO: 63674 - DNA, 550 bp, Homo sapiens
  misc_feature: GYAE6OF01DXEG0.31.78.H01.1.454.CMB.1.raw
tcagcagtagacgtccacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacaactacttagcttggtaccagcagaaagtaggacagcctcctaaactcctgtatttactgggcttctacccgggcactccggggttcctaaccgattcattggcagcgggtctgggacctatttcgactctcacatcagcagcctgcaggctagaagatgtgctagtttatactgtcagcaactattacttacttctttcgtctacgtttcggacggtacggacctaagggtggaagtagtacgaaacggtaactggtcggaccttgacctacctatccgttgttcttcgtaccg

SEQ ID NO: 63675 - DNA, 788 bp, Homo sapiens
  misc_feature: GYAE6OF01COXY0.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagcctccctggctgtgtctcgtgggcgaggacggccaaccatcaactgacaacgtccagccagtagttgtttatcggaccccaacaataacaactacttagcttaggaccagacaagaaagtacggacagtaccctacctaaaactcctagtactttacgtcgggtccttaccgtacccgggctaccgttcccgggggttacctaaaccggtacttacgtagttcggaccgtacgggtccgggttcgtacgggggtaacccgtacgttttaccgaacctttccgtacctaaccccagttaccaacggtcccaacggtcccgttacggaccgacgggtacctagggaaacgtaaggttcgggttacggtacgttaacggttttaacgttacgttcgtaacgaacggtaacctaaacttaacttttaacgttaacctttttacccgttttaccggttacccgttaaaccggttttaccgggggaaccgggtttaacggggaaccgttaaacgggggtcggtaaacggtaacggttaaaccgaaaaccggtacggttaacggtacgggtacgtacccggacctaaccggtagttaccgtcgtttaccgttccttaacccg

SEQ ID NO: 63676 - DNA, 735 bp, Homo sapiens
  misc_feature: GYAE6OF01DSLVG.31.78.H01.1.454.CMB.1.raw
  modified_base (522)..(522): a, c, t, g, unknown or other
  misc_feature (522)..(522): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctcgtggtgccgtacggggacatcgtgatgacgcctagtttccagacctcccgtggctgtgtctcgtgggcgaggacgggcccaccatcaactgacaagtccagccagtagttgttttacttccggaccccaacaaattaaactaacttacgttagtcttacggtaacccaagacgaaaggaaaacggtaggaacctacgtaccccttaaccgtaaaacctccgttaggtaacttttacggtccggggttacctttacccggtaccccggggtctaaccggtttaccccgggggttacccctaaaaccggtgtttaccaaggttcggacgtacggggtccgggtcgtacggggaccttatttccactcctacacctatccagccacgtccngacgaggtactagaagtagtgtggtctagtttacttacgtacgtcaagactaatacttaacttacttcgtttcgtacttacggttcgggacgggtacggaaccgtaagggtacggaactacgtaaaccgtaaacggttaacggttcgggtacgaccggtacgtaaccccgtaacgttaccgttcttccggtttaccctttccgttaacccccg

SEQ ID NO: 63677 - DNA, 673 bp, Homo sapiens
  misc_feature: GYAE6OF01COYIS.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagacctccctggctgtgtctcgtgggcgaggacgggccaccatcaactgcaagtccagccagagttgttttatcggccccaacaataacaactacttagcttacggtaccagacaagaaagtacggacagacctacctaaactcctgtactttacgtggtccttccgtacccgggctacggttcccggggttaccctaaccggtacttcgtacgttcggaccgacgggtcggggtaccgtacggggaccgtactttccacttccgtacaacccgtataccacgtccacgtcccgtggaccgacggtcctaggaacgtagtaggtcgtacttagttttaactacgtcgtacagtacctaacgtaatttacgtacctttcgttccgttactaccggtttcgggacgggtacggaccgtaagggtacggaagtacgtaaccgaaaccggtagtacggtggtacccgtagacctaaccgttactcccgttcttccgttactacccg

SEQ ID NO: 63678 - DNA, 592 bp, Homo sapiens
  misc_feature: GYAE6OF01DB9IO.31.78.H01.1.454.CMB.1.raw
  modified_base (133)..(133): a, c, t, g, unknown or other
  misc_feature (133)..(133): n is a, c, g, or t
  modified_base (337)..(337): a, c, t, g, unknown or other
  misc_feature (337)..(337): n is a, c, g, or t
  modified_base (384)..(384): a, c, t, g, unknown or other
  misc_feature (384)..(384): n is a, c, g, or t
  modified_base (421)..(421): a, c, t, g, unknown or other
  misc_feature (421)..(421): n is a, c, g, or t
  modified_base (463)..(463): a, c, t, g, unknown or other
  misc_feature (463)..(463): n is a, c, g, or t
  modified_base (504)..(504): a, c, t, g, unknown or other
  misc_feature (504)..(504): n is a, c, g, or t
  modified_base (581)..(581): a, c, t, g, unknown or other
  misc_feature (581)..(581): n is a, c, g, or t
tcagcagtagacgtcacgaccggtgctcgatttagtgtgagtagtttgggtttgggggagctaacgaacaggcaggcaggggcagcaagatggtgttgcagacccaggtccttcatttctctgttgctctggntctctggtgcctacgggggacatcgtgatgagccagtttccagacctccctggctgtcgtctcgtgggcgagacgggccaccagtcaactgcaagtccagccagagttgttttagttcggccccaaccgaataaccaactaacttagcttggtaccagacagaaagtaggacaggccctaccgtaaacctcgtgtactttacgngggtctttcgtacccggggctacggttccggggtacctaaaccggtnttacgagttcggacacggtcgggtacgtgggaacctnttcacgtctcaccgtatcgagcagcctgcagctgacgatcgnggtctagttactagtgtacagactaatatttactacctttntttacgtctacgttggacggtaggacctagggtggactacgtacgaaacggtatcggtcgactagacctacgtactntcgtctctacg

SEQ ID NO: 63679 - DNA, 571 bp, Homo sapiens
  misc_feature: GYAE6OF01BAR0P.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgtttattcggccccacaataacaactacttagcttggtaccagcagaaagtaggacagcctcctaaactcctgatttactgggcttcgtacccgggcagttccggggttcctaaccggattccatttggcaggcgggtcgtgggaccgtatttcactctcaccatcagcagcctgcagctgaagatgtggctagtttatactgtacagacaactatttatacctttctttacgtcttacgttttcgggcggtacgggaccgtaaggtaggaacgtaagtaccgaaaacgtataggtcggtactacggacctaaccgacttacgttcttccgttcgtaccc

SEQ ID NO: 63680 - DNA, 708 bp, Homo sapiens
  misc_feature: GYAE6OF01DSIGA.31.78.H01.1.454.CMB.1.raw
  modified_base (187)..(187): a, c, t, g, unknown or other
  misc_feature (187)..(187): n is a, c, g, or t
  modified_base (415)..(415): a, c, t, g, unknown or other
  misc_feature (415)..(415): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacgggacatcgtgatgagcctagttccagacctccctggctgtntctcgtgggcgaggacggcccaccgatcaactgacaagtcccagccaggtagttgtttttacgttccggaccccctaacaaattaaccaaccttacgttacgtcgtttacggtacccagtacaaaggtaaacggtaggaccaccgtcccttaacctaaacctctagttactttacgtcgggtacctttccggacccgggctacgggttcccgggttacctaaccggtnttccgagttcggcgacggtcgggttcacggggtacctgtttccactctacaccagtcacgcacgcccgtgcgacggtctaaggtacgtagttggtcggtactttagtttacttacgtgtacacgtactaacttatttaaccttcgttttacgtttcgttaccttaccgggtttacgggaccgggtaacgggtaaccgtaacgggtaggaaccgttacgtaaaccgtaaacggtaacgttcgggtacgaccgtcgaaccctaccggtacttccggtacgttcccttactacccg

SEQ ID NO: 63681 - DNA, 724 bp, Homo sapiens
  misc_feature: GYAE6OF01EJFNC.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagaggccaccatcaactgcaagtccagccagagtgttttattcggccccaacaataacaactactagcttggtaccagacaagaaagtaggacagccctactaaactcctagtactttacgtgggccttcctacccgcgtcagttccccggggttacctaaccgtattcaagttcggactaggccgggttctcgggaaccgtatttccgaactctacaccatcacgcacgcctgacgaggtctagaagtagtggtggtaccttaagttttacgttaacgtcgtacaacgtacctaaacgttaactttaacttaccgttttaccgttttaccgtttaccttaacccggttttccgggggaaccggggttaaacggggtaaaccccggttaaagggggttacgggtaaacggttaaacggttaaacccgtaaaaaccgggttaaaccggtttcgggttacggggtaccctttacgggaacccctaaacccgttaaccgtttccgtttaacccggtttccgtttaacccg

SEQ ID NO: 63682 - DNA, 948 bp, Homo sapiens
  misc_feature: GYAE6OF01CHC9N.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgaggacgggccaccatcaactgacaagtccagccagtagttgttttattcggccccaacaataacaactacttagcttaggtaccagacaagaaagtaggacacgcctacctaaactcctagtactttacgcgggtcttccgtacccgggtctacggttcccggggttaccctaaccgtactttacgaacgtttcggaccgtacgggtccggggttaccggtacgggggtaacccgttacgttttacccgaacccgtttccgtacccgtaaccccgtaagttacccgtaacgggtaccgtaacccgggtcccgtttaccggccgggtaaacggggtcccgtttaaagggtaaaacggttaggtttacggggttacgggttaccgttttaaacgggtttttttaaactttaacccggttttcggttaacccgtaaaccgggttaacccttaaaaacccgtttaacgtttttaaacccgttttaacccgttttttaccggttttttaccccggttaacccggttttaacccggggtttttaccccggggggaaccgggggttaaccgggggtaaaccccggttaaaggggggttaccggggtaaacggttaaaccgttaaaccccggtaaaaaaccgggtttaacccgggttacggggtttaccgggtaaccccggttacggtaaccccgtaaacccggtttaaccgtttaccggtttacccgggtttacccttttccgtttaaacccccccgg

SEQ ID NO: 63683 - DNA, 746 bp, Homo sapiens
  misc_feature: GYAE6OF01CDO7X.31.78.H01.1.454.CMB.1.raw
  modified_base (718)..(718): a, c, t, g, unknown or other
  misc_feature (718)..(718): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctcgtggtgccgtaaggggacatcgtgatgagcctagttccagtacctcccgtggctgtcgtctcggtgggacgaggacggccaccatcaacgtgacaagtccagacctaggtagtttagttttacgttccggaccccctaaactaaataaaccaaacttacttaagcttacggtaaccagacaagaaagtacggacacgaccctacctaaactcctagtaactttacgtcgggtaccttccggtacccgggactaccggttcccggggtacctaaaccgtacttacgtaacgttcggacgtacgggtccgggttacgtacggggtaacccgttactttaccacctccctaaccaacctacgtccgaagcaaccggtctaggaccgaggtactaggtaaagtgtacggtacggtaccttaagtttaactacgtcgtaactaacgactaaacttaactttaacgttacctttccgttaccgttaccttacggtttaccggggaccgggtaacggaaccggtaagggtacggaaagtaaccgaaaccgtaaaacggtacgttggtcgggaccttggaacccgttaaccnttacctttcggttccttaccgttaaccc

SEQ ID NO: 63684 - DNA, 598 bp, Homo sapiens
  misc_feature: GYAE6OF01BMIU0.31.78.H01.1.454.CMB.1.raw
  modified_base (426)..(426): a, c, t, g, unknown or other
  misc_feature (426)..(426): n is a, c, g, or t
  modified_base (449)..(449): a, c, t, g, unknown or other
  misc_feature (449)..(449): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgaggagggccaccatcaactgcaagtccagccagagttgttttattcggccccacaataacaactacttagcttagtaccagcagaaagtaggacagcctacctaaactccctagtactttacgtgggtcttccgtacccgggctacgttcccggggttacctaaaccgtattccgaagttcggacaggtccggggtcgtggggacccgtatttcactctacacctatcancgacgcctgacaggctaggaagngtgtggactagtttatacgtgtcagtacaacttaattacttactttcctttacgtaccgtacgtttcgggacggtacgggaaccgtaagggtcgaagtactacgaaacgtactggtcggctggacctaccgatctacgttcttcgtacc

SEQ ID NO: 63685 - DNA, 618 bp, Homo sapiens
  misc_feature: GYAE6OF01ELKP0.31.78.H01.1.454.CMB.1.raw
  modified_base (339)..(339): a, c, t, g, unknown or other
  misc_feature (339)..(339): n is a, c, g, or t
tcagcagtagacgtcacgaccggtgctcgatttagtgtgagtagtttgggtttgggggagctacaacaggcaggcagggcagcaagatggtgttgcagacccaggtcttcatttctctgttgctctggatctctggtgcctacggggacatcgtgatgagccagtttccagacctccctggctgtgtctcgtgggcgagacgggccaccatcaactgcaagtccagccagagttgttttattggccccacaataacaactctagcttggtaccagacagaaagtaggacacgcctacctaaactcctagtactttacgtgggtccttccgtacccgggnaacgttccggggttaccctaacgattcattggcaggcggtcgtgggaccgtatttcactcacaacatcagcagcctgcgaggctgaagatggaggctagttttatacctgtcagtacctaactatttacttactttccgttttcgtacgttacgtttccgggacggtaacgggaaccggtaagggtacggtaagaacttacgtaaaaccggtacgtacgggttcggaccttcggaccctaacccgttaattcctttacggtttccttaccgttaacccg

SEQ ID NO: 63686 - DNA, 543 bp, Homo sapiens
  misc_feature: GYAE6OF01B9JDD.31.78.H01.1.454.CMB.1.raw
  modified_base (388)..(388): a, c, t, g, unknown or other
  misc_feature (388)..(388): n is a, c, g, or t
  modified_base (498)..(498): a, c, t, g, unknown or other
  misc_feature (498)..(498): n is a, c, g, or t
  modified_base (532)..(532): a, c, t, g, unknown or other
  misc_feature (532)..(532): n is a, c, g, or t
  modified_base (538)..(538): a, c, t, g, unknown or other
  misc_feature (538)..(538): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggccccacaataacaactacttagcttggtaccagcaagaaagtaggacagcctacctaaactcctgtatttacgtggtccttcgtaccccgggcacgttcccggggttacctaaccgtattcattggcagcgggtctgggaccgtnttcactctcacatcagcagcctgcaggctagaagatggtgctagtttactactgtcagcaactattactacttctttcgtctacgtttcggcggtaggacctaggtgganagtacgaaacgatggtgcgtgacctactatcgtnttcgtntaccg

SEQ ID NO: 63687 - DNA, 543 bp, Homo sapiens
  misc_feature: GYAE6OF01B8AQ7.31.78.H01.1.454.CMB.1.raw
  modified_base (451)..(451): a, c, t, g, unknown or other
  misc_feature (451)..(451): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacaactacttagcttggtaccagcaagaaagtaggacagcctacctaaactcctgatttacgtgggtcttcgtacccgggcacgttcccggggttcctaaccgtattccagttggcagcgggtctgggaccgtatttcactctcaccatcagcagcctgcgaggctagaacgtatggtggctagtttattactgtcagnaactatattacttctttcgtctacgttcggacggtagggaaccaggtgacgatacgaaagtactggtcgctgactactatctgtcttctacg

SEQ ID NO: 63688 - DNA, 594 bp, Homo sapiens
  misc_feature: GYAE6OF01CZZJF.31.78.H01.1.454.CMB.1.raw
  modified_base (322)..(322): a, c, t, g, unknown or other
  misc_feature (322)..(322): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgaggagggccaccatcaactgacaagtccagccagtagttgttttatcggccccacaataacaactactagcttggtaccagacagaaagtaggacacgcctacctaaactcctagtaatttacgngggtcctttaccgacccgggactacgttcccggggttacctaaccgtattcgattggcaggtcgggtctgggacctattcactctcacatcagcagcctgcgaggctagaagagtgtaggtcttaagtttactactgtacagtactaaacttattacttactttcgtttccgtaccttacgtttcgggacgggtaagggtaccgtaagggtcggaacgataaaccgaaaccggtagttggtcggctcgactaccattctcgttcttcgtacc

SEQ ID NO: 63689 - DNA, 790 bp, Homo sapiens
  misc_feature: GYAE6OF01EVPYK.31.78.H01.1.454.CMB.1.raw
  modified_base (370)..(370): a, c, t, g, unknown or other
  misc_feature (370)..(370): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagacctccctggctgtgtctcgtgggcgaggacgggccaccatcaactgcaagtccagccagtagttgttttattcggaccccacaataacaacttacttagcttaggaccagacaagaagtaggacacgtcctactaaactcctagtacttcgtcggtccttccggaccggctacggttcccgggttacctaacgtnttcgagttcggcagggtcggtcgtacgggtaccttattccacgttacctaccgtaaccacgttaccgaacgtccgtaacgtcccgttacggaccggtacgggtactaagggtaaacgtacggttacgggttacgggtaaccgttttaaggttttaaccgtttaacgttacggtaccgtaaacggtacctaaaacgttttactttaaccgtttaacccgttttccgttttaccgggttacctttaaccggggttttaccggggaacggggttaacccggggaaaccggttaagggggttaacggtaacggttaaaccgttaaccggtaaaaacggttacggttacgggtacgggtaccgttaaccgaacccgttaaaccgttacgtacccgttttacggttcctttacccgttaaccccgg

SEQ ID NO: 63690 - DNA, 516 bp, Homo sapiens
  misc_feature: GYAE6OF01D2FRC.31.78.H01.1.454.CMB.1.raw
  modified_base (328)..(328): a, c, t, g, unknown or other
  misc_feature (328)..(328): n is a, c, g, or t
  modified_base (513)..(513): a, c, t, g, unknown or other
  misc_feature (513)..(513): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctagatttacgtgggcttcacccgggnactccggggttcctaaccgattcattggcagcgggtctgggaccgattcgactctcaccatcagcagcctgcaggctgaagatgtggctagttattacgtgtcagcaacattatacttctttcgtctatttcggcggaggaccaaggtgagatacgaaacgatggtgctgacaccatctgtcttntac

SEQ ID NO: 63691 - DNA, 734 bp, Homo sapiens
  misc_feature: GYAE6OF01A6W9G.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagaggccaccatcaactgcaagtccagccagagttgttttattcggccccacaataacaactacttagcttggtaccagcagaaagtaggacagcctacctaaactcctagatttacgtgggtccttccgtacccgggctacgttcccggggtttaccctaaccggtattaccgtagtttcggactagggtccggggttccgtacggggtacccgtattttccaaccttccgtaccaaccctattccgaacggtccacggtccctacggaccgtagggtcctaggaaacgtagttcgggtacggtacgttaaggtttttaactttacgtcgttacaacggtacctaaacttaactttaactttaaccttttaccgttttaccgttaccgttaccgttttaccggggaccggggtaaccgggtaaccgtaaaggggttacgggtaaaggtaacgttaaccgaaaaccggtaacgttacgggttacgggacgttaccgacctaacccgtacttaccgttcgtttcccgtttcgttacccg

SEQ ID NO: 63692 - DNA, 749 bp, Homo sapiens
  misc_feature: GYAE6OF01D10VY.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgacaagtccagccagagttgttttattcggccccaacaataacaactacttagcttaggtaccagcaagaaagtaggacagccctactaaactcctagtactttacgtgggtctttccgtacccgggctacggttcccggggtttaccctaaaaccggtatttaccgtaagtttcgggaccgtaagggtccgggggttccgttacgggggtaacccgtaattttcccgaaccttcctaccgtaaccctaagttcccgaacgcccgaacggtccccgttaggaccgtaacggggtaccttagggaaacgttaacggttcgggttacggggtaccctttaaggtttttaacgtttaaccgttggttaccaacggtactaaacttaagttttaacttacctttaccgttttaccggtaccttaaccggttttcgggaccgggtaagggtaaccgtaaagggtggaacgtaactaaccgaaaacggtacgttcggtacggtctagacctacctacgttccttcggttccttcgtacccg

SEQ ID NO: 63693 - DNA, 706 bp, Homo sapiens
  misc_feature: GYAE6OF01DXJ2C.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgacgcctagtttccagactccctggctgtgtctcgtgggcgaggacgggcccaccatcaactgacaagtccagccagtagttgttttattcggaccccaactaataacaactactagtcttaggtaccagacaagaaagtagacagccctacctaaactcctagtacttacgtgggtacttccgtaccgggctacggttcccggggttacctaaccgtattcgaagttcggcgtagggtccgggtcgtcgggaccgtacgtttccacgtccgtaccaaccgtataccacggacctacggtccctggaccgaggtactaaggaaagtgtgggtacggtcgttaagttttacgttaccgtaggtaccagacttaaactatttaacttaaccgtttccgttttacgtaccgtttaccggtttccggggaacggtacgggtaacccgtaagggtcggtaacgtaacgttaaccgaaacggtacgttagggtcggtaccgttacggaccctaaaccgttcgttacccgtttcgttcccgttccgttaacccgg

SEQ ID NO: 63694 - DNA, 572 bp, Homo sapiens
  misc_feature: GYAE6OF01APP15.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgaggagggccaccatcaactgcaagtccagccagagttgttttattcggccccaacaataacaactacttagcttggtaccagcaagaaagtaggacagccctacctaaactcctagtactttacgtgggtaccttccgtacccgggctacgttcccggggttacctaaccggtattcatttcggcgtaggcgggtcgtgggaccgtatttccactcctcaccatcagcacgcctgcaggctgaagatgtgactagtttactactgtacagctaactattacttacttcgttacgttctacgttcgggacggacgggacctaggtgagactacgaaacgtacgtaggtcggactcgacactatctcgttcttctacc

SEQ ID NO: 63695 - DNA, 814 bp, Homo sapiens
  misc_feature: GYAE6OF01BHBTK.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgaggagggccaccatcaactgcaagtccagccagtagttgttttattcggccccaacaataacaactacttagcttggtaccagcagaaagtagacacgcctactaaactcctagactttacgtgggtccttccgtacccgggtctaacgttcccgggggttaccctaaaccggtatttccgaagttcggacgagggtccggggttacgtacggggacccgttacgttttaccaacccgttccttaccgaaccctacgtaccgtaacggaccctaacggtccccgttacggaccgtaacggggtacctaacgggaaaacggtagtttaccggggttacggtaccgtttaagggttttttaacgttaccgttacgggtttaacctaacgggtaccctaaaaacgttaactttttaacctttaacccggtttttacccttttacccgggttacctttaaccgggttttcccgggaacgggggtaacgggtaacccgtaaagggggttacggaaacggttaaaccgttaaccgtaaaaccgggttaacggttacgggtacgggacccgtttacggaacccgttaaccgacgtttacctcggttttaccttacccgttacccg

SEQ ID NO: 63696 - DNA, 549 bp, Homo sapiens
  misc_feature: GYAE6OF01B8FAZ.31.78.H01.1.454.CMB.1.raw
  modified_base (502)..(502): a, c, t, g, unknown or other
  misc_feature (502)..(502): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgtttattcggccccacaataacaactacttagcttggtaccagcagaaagtaggacagcctcctaaactcctgatttactgggtcttcgtacccgggctacgtccggggttacctaaccgattcagttggcaggcgggtctgggaccgtatttcactctcaccatcagcacgcctgcaggctagaagatgtggctagttttatactgtcagctaaactattattacttcgtttacgtctacgtttcggacggacgggtaccaagggtgganacgtacgaaacgtatggtggactgacctacatcgtcgttctcgtacg

SEQ ID NO: 63697 - DNA, 691 bp, Homo sapiens
  misc_feature: GYAE6OF01BGGGV.31.78.H01.1.454.CMB.1.raw
  modified_base (377)..(377): a, c, t, g, unknown or other
  misc_feature (377)..(377): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagtttccagactccctggctgtgtctcgtgggcgagacggccaccatcaactgacaagtccagccagtagttgttttattcggccccaacaataacaactacttagcttaggtaccagacaagaaagtaggacacgccctacctaaactcctgtactttacgtgggtccttaccgtacccgggctacggttccccggggttacctaaccggtnttaccgtagttcggacctaggtccggggttcgtacggggacccgttatttccaaccttcctaccaaccctatccagccacgtcccgtgaccgacgggtctaggaaagagttggtcggtacgttaagttttacttaccgttagtcaacgtactaaactatttaacttaccttttccgtttaccgttaccttaccggtttacgggacgggtaaccgggtaacgtaagggtaggaagtaaccgttaacgaaaaccggtacgttggtacggtaccgtacgaccctaaccgtacgttaccttcggttccttcgtacccg

SEQ ID NO: 63698 - DNA, 799 bp, Homo sapiens
  misc_feature: GYAE6OF01BRPUY.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagacctccctggctgtgtctcgtgggcgaggacgggccaccatcaactgacaagtccagccagtagttgttttattcggccccaacaataacaactacttagcttggtaccagacaagaaagtaggacagccctacctaaactcctagtactttacgtgggtccttccgtaccccgggctacggttcccggggttaccctaaaccgtattccagtttcggcgtacggtcggggttcgtcggggtaacccgtattttccaaccgttcctaccgaaccctaagttacccgaacggtacccgtaaccggtccccgttacggaccgtaacggggtaccgttaagggaaacggtagttacgggttacgggtaccgtttaaacggtttttaacgtttaccgttacggttaccgaacggtaaccctaaaacgttaacttttaacgtttaacccttttaccgttttacccgttacccgttaccggttttaccggggaccggggttaacggggtaacccgtaaagggggtacggtaaacggtaacgtaaccgtaaaaccggtaacgtacgggttcgggtaccgtacgtacccgtaacccgtacgttaccgttacgtttacccgttaccgttacccg

SEQ ID NO: 63699 - DNA, 752 bp, Homo sapiens
  misc_feature: GYAE6OF01BAUA5.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgacaagtccagccagtagttgtttattcggccccaacaataacaactacttagcttggtaccagacaagaaagtaggacacgccctacctaaactcctagtactttacgtgggtcctttccgtacccggggctacgttcccgggggttaccctaaaccggtatttacgacgtttcgggacctaggggccggggttacgtacggggtaacccgtacttttacccgaacgttcctacccaaaccgtacttaccgacgccgtaacggtcccgttacggaccgtaacgggtaccgttaggaaaagtacgttagggttacgggtaccgttaacgttttttaacgttaaccgtttcggttaacccgtaaacggtacctaaaacgttaagttttaaccttaaccttttcccgttttacgtccgtttaaccgttttcggggaccgggttaacgggaacccgtaaggggtacggaagtaacgtaaccgtaaacggtacttagggtcggcgttacgacctaccgtattcgtacgttccttacgtaccg

SEQ ID NO: 63700 - DNA, 571 bp, Homo sapiens
  misc_feature: GYAE6OF01D7D7G.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagacgggccaccatcaactgcaagtccagccagagttgttttattcggccccaacaataacaactacttagcttggtaccagcaagaaagtaggacagccctacctaaactcctagtactttacgtcgggtccttccgtacccgggctacgttcccggggtttacctaaaccggtattccgagttcggccaggtccgggtcgtcggggaccgtatttccactcgtacaccatcagcacgcctgcaggctagaagagtgtgctagtttatactgtcagactaactattactactttcttcgtacttacgttcggacggaggaccgtaggtgagatacgaaacgtatggtcgctgacctacatctcgtctcgtacc

SEQ ID NO: 63701 - DNA, 808 bp, Homo sapiens
  misc_feature: GYAE6OF01AIO7W.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggccccacaataacaactacttagcttggtaccagcagaaagtacggacacgcctacctaaactcctagtaatttacgtgggtcttaccgtaccccggggctacgttcccggggtttaccctaaaccgtacttccgtacgtttcggaccgagggtcccggggttccggttacgggggaaccccgttacgttttccaacccgtttccttacccaacccgtacttccgaacgtaccgacggtacccgttcggaccgtaagggtcccgttaaggaaacgttacgtacggttacgggtaaccgttaagggtttttaactttaaaccggttgttacccgtaacggtacctaaaccgttaagttttaacctttaacccgttttcccgtttttaaccggttccgttaccggtttttaccggggaccggggttaacgggaaccccggtaaaggggttcgggtaaacggtaacgttaaaccggaaaaccggttaaccggtacgggttacgggtacccgttacggtaacccgtaacccgttagttacccgtttcgttaccgtttaccgtttaacccg

SEQ ID NO: 63702 - DNA, 546 bp, Homo sapiens
  misc_feature: GYAE6OF01E4U5B.31.78.H01.1.454.CMB.1.raw
  modified_base (509)..(509): a, c, t, g, unknown or other
  misc_feature (509)..(509): n is a, c, g, or t
  modified_base (538)..(538): a, c, t, g, unknown or other
  misc_feature (538)..(538): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctacctaaactcctgactttactgggctttcgtaccccggggcacgttcccggggttaccctaaccggattcatttcggcaggtcgggtcgtggggacccgtatttccacttcctcaccatcagcagcctgcaggctgaagatgtggctagtttattactgtcagacaatattattacttctttcgtctacgtttcgggcggtagggaccaaggtgganatacgaaacgtatggtcgctgccacatcngttctctc

SEQ ID NO: 63703 - DNA, 543 bp, Homo sapiens
  misc_feature: GYAE6OF01DRSRE.31.78.H01.1.454.CMB.1.raw
  modified_base (533)..(533): a, c, t, g, unknown or other
  misc_feature (533)..(533): n is a, c, g, or t
  modified_base (540)..(540): a, c, t, g, unknown or other
  misc_feature (540)..(540): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacaactacttagcttggtaccagcagaaagtaggacagcctacctaaactcctgtatttactgggcttcgtacccgggcacgtcccggggttcctaaccgtattacattggcaggcgggtcgtgggaccgtattcactcctcaccatcagcagcctgcaggctagaagtagtgtggctagtttattactgtcagctaactattactactttctttcgtctacgtttcggcggacggaccgtaagggtggagagtacgaaacgaagtgtggctgacacattntcgtctntac

SEQ ID NO: 63704 - DNA, 958 bp, Homo sapiens
  misc_feature: GYAE6OF01AS3HE.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacgggacatcgtgatgagcctagtttccagactcccgtggctgtgtctcgtgggcgaggacggccaccatcaactgacaagtccagccagtagtttgtttttacttccggaccccctaactaaactaaacctaaaccttacgttacgtccgtttacgggtaacccaggaccgaaaggtaaaacggtacggaaccaccggtaccccttaacccttaaaaccttcccgttaggttaacttttaccggtcggggttaccctttacccggtaccccgggtactaccgggttccccggggtttaacccctaaacgtacgtttccgtaaggttcggaccgtaacggggtccggggttaccgtacgggggtaaccccgttacgtttttacccgaacccgtttacccgtacccaaacccgttacgttacccgaacgggtacccgtaaccgggttccccgttacgggaaccgtaaccggggtaccgttaaagggaaacgggttacgttacggggttaaccgggttaccgttttaaacggttttttaccgttaaccgtttaccgggttaaccgtaacggtaaacccttaaacctttaacggttttacctttaacccgtttttccgttttacccggttacccgtttaccggttttacccgggggaccggggtaaacgggtaccccggttaaaggggttacgggtaaacctaaaccggttaaaccggtaaaaacgggtaccggttcgggttacccgggtaaccttaccggaaccccgttaaccgttacgtttaccggtttactttcccgttaaccccgtttaacccg

SEQ ID NO: 63705 - DNA, 656 bp, Homo sapiens
  misc_feature: GYAE6OF01CHO3B.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgaggagggccaccatcaactgcaagtccagccagtagttgttttattcggcccccaacaataacaactacttagcttaggtaccagcaagaaagtaggacacgcctacctaaactcctagtatttacgtgggccttcgtacccgggctacgttcccggggttacctaaccgtattcagttcggcgaggtccgggtcgtacggggacccgtacgtttcctaaccgttcctccgaacccctatccgaacggtccaacgtccctggccagggtctagaaaggtagttggtacggtacgtaaggtttttaacttacctggtaccaggacctaaactatttaattaacctttcgtttaccgttcttacgtttcgggacgggtacgggaccgtaagggtggacgtagtaaccgaaacgtaacgtggtggcctaggacccaccgtattccgtcgttccttcgtaccg

SEQ ID NO: 63706 - DNA, 534 bp, Homo sapiens
  misc_feature: GYAE6OF01AWHQE.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccaccaataacaactacttagcttggtaccagcagaaagtaggacagcctcctaaactcctgatttactgggcttctacccgggcatccggggttcctaaccgattcattggcagcgggtctgggaccatttcactctcaccatcagcagcctgcaggctgaagagtgtggctagtttatactgtcagcaacatttatacttctttcgtctacgtttcggcggaggaccaaggtggagatcaaacggaactggtcggctagggccaacccgtataccgtgtccttcgtaac

SEQ ID NO: 63707 - DNA, 608 bp, Homo sapiens
  misc_feature: GYAE6OF01D8P9D.31.78.H01.1.454.CMB.1.raw
  modified_base (323)..(323): a, c, t, g, unknown or other
  misc_feature (323)..(323): n is a, c, g, or t
tcagcagtagacgtcacgaccggtgctcgatttagtgtgagtagtttgggtttgggggatctacaacaggcaggcaggggcagcaagatggtgttgcagacccaggtcttcatttctctgttgctctggatctctggtgccgtacggggacatcgtgatgagccagtttccagactccctggctgtgtctcgtgggcgagagggccaccatcaactgcaagtccagccagagttgttttattcggaccccacaataacaactacttagcttggtaccagacaagaaagtaggacacgcctacctaaactcctagtatttacgngggccttccgtacccgggctacgttcccggggttacctaaccgtattcagttcggctaggcggggtctggggaccgtatttccactctcaccatcagcagcctgcagctagaagatgtggtactagtttatacgtgtcagacaactattaacttactttcctttcgttactacgtttcgggacgggtacgggaccgtaaggtcggtaagaacgtaacgaaaccggtaagttcggttcggaccgtacggaccctaaccacttaccgtttcgttccttccgtacccg

SEQ ID NO: 63708 - DNA, 746 bp, Homo sapiens
  misc_feature: GYAE6OF01EYZJD.31.78.H01.1.454.CMB.1.raw
tcagcagtagacgtcacgaccggtgctcgatttagtgtgagtagtttggggtttggggggagctacaacaggcaggcaggggcagcaagatggtgttgcagacccaggtcttcatttctctgttgctctggatctctggtgcctacggggacatcgtgatgagcctagtttccagacctccctggctgtgtctcgtgggcgaggagggccaaccgatcaactgcaagtccagccaggagttgttttattcggccccacaataacaacttactagcttcggtaccagcaagaaagtacggacagcccttacctaaactcctagtacttacgtcgggaccttccgtacccgggcacggttcccggggttaccctaaccggtattccagttcggcgtacggtccggggttcgtacggggacccgttaagtttccaacgttcctacctaacccattaccgaacggtacctaacggtcccgttaggccgtaacgggtctacggaaacgtagttcgggtacggtaccgttaaggtttttaacttacgttcggttaccgtaagtaccctaaacgtatttaacctttaccgttttcccttttacgggtacccttacggtttccggggaccgggaaccgggtaacgtaaacggggttggtaaacgtaaccgttacgtaaaaaccgtacggttcgggtacggtaccgtacggtacctaacccggtaagttccggttagttcccttacgttaacccg

SEQ ID NO: 63709 - DNA, 627 bp, Homo sapiens
  misc_feature: GYAE6OF01CHQ4Z.31.78.H01.1.454.CMB.1.raw
  modified_base (341)..(341): a, c, t, g, unknown or other
  misc_feature (341)..(341): n is a, c, g, or t
  modified_base (456)..(456): a, c, t, g, unknown or other
  misc_feature (456)..(456): n is a, c, g, or t
  modified_base (469)..(469): a, c, t, g, unknown or other
  misc_feature (469)..(469): n is a, c, g, or t
  modified_base (600)..(600): a, c, t, g, unknown or other
  misc_feature (600)..(600): n is a, c, g, or t
tcagcagtagacgtcacgaccggtgctcgatttagtgtgagtagtttgggtttgggggagctacaacaggcaggcaggggcagcaagatggtgtgcagacccaggtcttcatttctctgttgctctggatctcgtggtcgccgtacggggacagtcgtgatgagcctagtttccagacctcctggctgtgtctcgtgggcgagagggccacgatcaacgtgactaagccagccgagtgttacgttttatccggcccaaccaataaccaacttacttagcttaggaccagctaaggaaagtcggaacacgaccctaccgtaaactcctagtaacgtttacgngggtaccttaccgtaacccggggcttaacggttcccggggttacctaaaccgtattacgtacgttcgggactacggggtcgggtacgtcgggacctactttcgactctaccactntcgagccacgtcngcgacgctagaacgagtcgtggtacctaaggttttacaccgtggtaccacgtacaacttattactactttcgttacgtctacgttcggacgggagaccgtaggtcgatacgtacgaaacgtagtgacggcngaccgtaccatctacgttctctacccg

SEQ ID NO: 63710 - DNA, 538 bp, Homo sapiens
  misc_feature: GYAE6OF01EX4CB.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagccctcctaaactcctgatttactgggcttcgtacccgggcagtccggggttcctaaccgattcattggcagcgggtctgggaccgatttcactctcacatcagcagcctgcaggctgaagatgtggctagtttattactgtcagcaactattatacttctttcgtacttacgtttcggcggtagggaccgtaagggtggtaagatacgaaaacgtaacttggtggactgccaccattctcgtcttctac

SEQ ID NO: 63711 - DNA, 837 bp, Homo sapiens
  misc_feature: GYAE6OF01BEFQE.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagacctccctggctgtgtctcgtgggcgaggacggccacatcaactgacaagtccagcctagtagttgttttacttaccgaacccctaactaaactaaacctaacttacgttacgtaccttacggtacccagacgaaagaaaggtacggaacctacgtaccccttaacctaaacctcccgttaggtaacttttaccggtcgggtaccttacccggtaaccccgggctacggttaccccggggttacctaaaccgtgtttaccacgttcggcgtacgggtccggggttacgtacggggaacccgttacgtttccaacgttccctaccgtaacctactccgaacgtcctaaccggtccctacggaccgtacgggtaccgttaaggaaacgtcggttcggttacgggtacgttttaacggttttaacgttacgttacgttaccgtaacgtaacgttaaacctttaattttaaccgtttacccgttttacgttttacccggtaaccgtttaccgggttttaccggggaaccggggtaaacgggtaacccgttaaggggtacggtaaacgtaacggtaaaccgtaaaacgggttaacggtcgggttacggtaccgtaccgtacccgtaaccttacggttaccctttccggttacccgttccgtaaccccg

SEQ ID NO: 63712 - DNA, 648 bp, Homo sapiens
  misc_feature: GYAE6OF01BM6T2.31.78.H01.1.454.CMB.1.raw
  modified_base (201)..(201): a, c, t, g, unknown or other
  misc_feature (201)..(201): n is a, c, g, or t
  modified_base (319)..(319): a, c, t, g, unknown or other
  misc_feature (319)..(319): n is a, c, g, or t
  modified_base (336)..(336): a, c, t, g, unknown or other
  misc_feature (336)..(336): n is a, c, g, or t
  modified_base (434)..(434): a, c, t, g, unknown or other
  misc_feature (434)..(434): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctcgtgggcgagngggccacatcaactgcaagtccagccagtagttgttttattcggccccaacaataacaactacttagcttgtaccagacaagaaagtgacagcctacctaaactcctagtactttacnggtcttccgacccgggntacgtcccggggttcctaacgtattcgagttggcaggcggtacgtgggacctagtttcaactcctacaaccatccagccacgcctgcaggctagaagngtgtagctaagtttattacgtgtacagtacctaaactactttacttaaccttttccgtttacgtacgttaccgtttacggggaccgggtaacgggtaacccgtaaggggtacggaaacggtaactaaaccggtaaaaccgtaacggttgggtacggtacccgtacggacccttaaaccggtacttaccgttaccgttccggtttacctaacccg

SEQ ID NO: 63713 - DNA, 675 bp, Homo sapiens
  misc_feature: GYAE6OF01DN7RP.31.78.H01.1.454.CMB.1.raw
  modified_base (372)..(372): a, c, t, g, unknown or other
  misc_feature (372)..(372): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagtagttgttttattcggaccccacaataacactacttagcttggtaccagcaagaaagtaggacacgtcctacctaaactcctagtactttacgtgggtcctttcgtaccccgggctacgttcccggggttaccctaaaccggtntttccgaagtttcggcgacgggtccggggtctacgggggaccctaattttccaaccgttcctaccaacctaattccaacgccgaacgtcccctggaccgagggtacctagggaaagtagttggtcgggtacttaaggtttttacttaccgtgttaccgagtacctaaactatttaacttacctttctttccgtacttacgttttcggggacggtacgggaccgtaagggttggaacgtactaaccgaaaacggtacgttggtacgggcctagacctaacctattcgtcgttccttctaacccg

SEQ ID NO: 63714 - DNA, 761 bp, Homo sapiens
  misc_feature: GYAE6OF01DHJW0.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagaggccaccatcaactgcaagtccagccagtattgttttattcggaccccacaaataacaactacttagcttaggtaccagacaagaaagtacggacacgtccctacctaaactcctagtactttacgtcgggtaccttccgtacccggtctacgttcccggggttaccctaaccgtattcgagttcggactaggtccgggttacgtacggggtacccgtatttccaacctttccgtaccaacccgtattaccgaacgtacccgtaacggtcccgttacggaccgacgggtaccttaggtaaaggtacgttgggttaccgggtacgtttaaggtttttaaccgttaccgtacggtaccaacgtaacctaaacttacttttaaacgttaccgttttaccgtttaccgttaaccgttaccggttttacggggaccgggtaaccgggtaacccgtaaaggggtggtaaacgtaaacgttaaccggtaaaaccggtaacggttcggtacggtaccgttacgaaccctaaccgtactttacccgttcgttaccttccgttaaaccccg

SEQ ID NO: 63715 - DNA, 538 bp, Homo sapiens
  misc_feature: GYAE6OF01BWZJR.31.78.H01.1.454.CMB.1.raw
  modified_base (317)..(317): a, c, t, g, unknown or other
  misc_feature (317)..(317): n is a, c, g, or t
  modified_base (335)..(335): a, c, t, g, unknown or other
  misc_feature (335)..(335): n is a, c, g, or t
  modified_base (531)..(531): a, c, t, g, unknown or other
  misc_feature (531)..(531): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagactccctggctgtgtctctgggcgagagggccaccatcaactgcaagtccagccagagtgtttattcggccccaacaataacaactacttagcttggtaccagcaagaaaagtaggacagcctacctaaactcctgatttacgngggcttccgtacccgggntagtcccggggttaccaaccgattccagttggcagcggtctgggaccgtatttcactctcacatcagcagcctgcaggctagaagagtgtgctaagtttatactgtacagactaaacattaatactttctttcgtctacgtttcggcggaggaccaagggtgagaatacgaaacgatggtcgctgacaccatactntctctac

SEQ ID NO: 63716 - DNA, 748 bp, Homo sapiens
  misc_feature: GYAE6OF01BYGE7.31.78.H01.1.454.CMB.1.raw
tcagcagtagacgtcacgaccggtgctcgatttagtgtgagtagtttgggtttgggggagctacaacaggcaggcaggggcagcaagatggtgttgtagacccaggtcttcatttctctgttgctctggatctctggtgcctacggggacatcgtgatgagccagtttccagactccctggctgtgtctcgtgggcgagagggccaccatcaactgacaagtccagccagagttgttttattcggccccacaaataacaactacttagcttggtaccagcaagaaagtaggacagcctacctaaactcctagtactttacgtgggtcctttccgtacccgggctacggttccccggggtttaccctaaaccggtatttcgagtttcgggctaaggtccggggttcgtaggggaaccctattttccaacttcctaccaacctatccgagccacgtcctgaccgaggtcctaggaaagtagttgggtacggtacgttaagttttacttacgttagtaccaaggtacctaaacgttaactttaacttaccgttttaccgttttaccgtaccgttaaccggttttccggggaaccgggttaacggggtaacccgtaaaggggttacggaacgtacgtaaacccggtaaaacggtaaccggttagggttaccgggtaccgttacggtaacccgtaacccgttaacgttacccgttaccggtttacccgtttaccgtaaccgttttccccccgg

SEQ ID NO: 63717 - DNA, 609 bp, Homo sapiens
  misc_feature: GYAE6OF01DP31V.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagttccagactccctggctgtgtctcgtgggcgaggacgggccaccatcaactgacaagtccagccagtagttgtttttacttcggaccccaactaaataacaacttacttagcttggtaccagacaagaaagtaggacagcctacctaaactctagtatttacgtcgggtcttcgtacccgggctacgttcccggggttacctaaccgtattacagtttcggctaggtcgggtcgtcgggtaacctatttccgacttctaccaccatccagcttacgcctgacgaggctagaagtacgtggtcggtactagttttactactcgtacacgtactaactattacttactttctttccgtactacgtttcgggacggtacgggaactaagggtcgagtactaacgaaacgtagtggtcggtctagacctacatacttcgtctctaccg

SEQ ID NO: 63718 - DNA, 589 bp, Homo sapiens
  misc_feature: GYAE6OF01A3AK7.31.78.H01.1.454.CMB.1.raw
  modified_base (320)..(320): a, c, t, g, unknown or other
  misc_feature (320)..(320): n is a, c, g, or t
  modified_base (394)..(394): a, c, t, g, unknown or other
  misc_feature (394)..(394): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgacaagtccagccagagttgtttattcggccccacaataacaactacttagcttggtaccagcaagaaagtaggacagccctacctaaactcctagtatttacgngggtcttcgacccgggctacgttcccggggttacctaaccgtattccagttcggcaggtcgggtctgggacctntttcactctcaccatcagcagcctgcaggctagaacgagtggtaggctaagtttactacgtgtcagactaatattaacttactttctttcgtcttacgtttcggacgggtacggaacgtagggtaggaacgtacgtaaccgaaacgtacgtggtcggtctacgaccgtacctacgttacttcgttcttcgtaccg

SEQ ID NO: 63719 - DNA, 604 bp, Homo sapiens
  misc_feature: GYAE6OF01CBS6R.31.78.H01.1.454.CMB.1.raw
  modified_base (365)..(365): a, c, t, g, unknown or other
  misc_feature (365)..(365): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagttgttttattcggccccaaccaataacaactacttagcttggtaccagacagaaagtaggacagccctacctaaactcctgactttacgtgggcttccgtacccgggcacggttcccggggttacctaaccgtnttcagttggcaggtcgggtctgggacccgtatttccactctaccaccatcagcacgcctgcaggctagaagatggtggtactagttttactacgttcgtcaacgctaaacctagtttattacctttcttaccgttctacgtttcgggacggacgggtaccgaagggtcggaagtacgtacgaaacgtacgttaggtcggtactcggactacccgtacttcgttacgttcttccgtaccc

SEQ ID NO: 63720 - DNA, 583 bp, Homo sapiens
  misc_feature: GYAE6OF01BG0AU.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaaactgcaagtccagccagagtgttttattcggccccacaataacaactacttagcttggtaccagcagaaagtaggacagccctacctaaactcctagtactttacgtgggtccttccgtacccgggctacgttcccggggttacctaaccgtattcagttcggactaggtcggggttctcggggaccgtatttcgactctaccacatccagtcacgtcctgcaggtctagaagtagtgtcggctagtttactactgtcagactaactattactactttctttcgtcttacgtttcggcggtaggaccgtaaggtggatacgtaacgaaacggtactggtcgctcgactaccgtatcttcgttcttctaccg

SEQ ID NO: 63721 - DNA, 583 bp, Homo sapiens
  misc_feature: GYAE6OF01CJHFB.31.78.H01.1.454.CMB.1.raw
  modified_base (317)..(317): a, c, t, g, unknown or other
  misc_feature (317)..(317): n is a, c, g, or t
  modified_base (359)..(359): a, c, t, g, unknown or other
  misc_feature (359)..(359): n is a, c, g, or t
  modified_base (405)..(405): a, c, t, g, unknown or other
  misc_feature (405)..(405): n is a, c, g, or t
  modified_base (429)..(429): a, c, t, g, unknown or other
  misc_feature (429)..(429): n is a, c, g, or t
  modified_base (433)..(433): a, c, t, g, unknown or other
  misc_feature (433)..(433): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagacgggccaccatcaactgcaagtccagccagagttgtttattcggccccacaataacaactacttagcttggtaccagcagaaagtaggacagcctacctaaactcctgattttacgngggtcttccgtacccgggcacgttcccggggttcctaaccgnttccagttcggcagccgggtcgtgggactattccactctacgaccntacacgcacgcctgcagctagagntggngtctagtttactacgtcgactagactaaactatttactacctttctttacgtcttacgtttcgggacggtaggaccgtaaggtggagtacaccggaaacgtacgttggcggcctagacccgtacctagttcgttcgttccttacctaccg

SEQ ID NO: 63722 - DNA, 702 bp, Homo sapiens
  misc_feature: GYAE6OF01DCF9V.31.78.H01.1.454.CMB.1.raw
  modified_base (323)..(323): a, c, t, g, unknown or other
  misc_feature (323)..(323): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagttgttttattcggccccacaaataacaactacttagcttggtaaccagcaagaaagtaggacacgcctacctaaactcctagtactttacgngggtccttaccgtacccgggactaacgttccccgggggtttacctaaacccggtatttaccgagtttcggacgaggtaccgggggttctagggggaaccctattttccgaccgtctaccaaccgtaatccgaagccacggtcctggacgacgcgtagaagtagtggtcggtacttaaggtttatttacgtgttacacggactaaacgttactttaacgttaccttttaccgttttacggtacccgttaaccggttttcggggaccgggtaagggtaacccgtaaagggttacgggaaacgttacgtaaaccgtaaaacggtaaccgttaggtacggacttcggacctaaccgtaactcgtttacttccgttcctaaccg

SEQ ID NO: 63723 - DNA, 613 bp, Homo sapiens
  misc_feature: GYAE6OF01C8NL3.31.78.H01.1.454.CMB.1.raw
  modified_base (341)..(341): a, c, t, g, unknown or other
  misc_feature (341)..(341): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgccaagtccagccagtagttgttttattcggccccacaataacaactacttagcttggtaaccagacagaaaagtaggacagccctacctaaactcctagtatttactgggccttcgtacccgggntacgtcccggggttcctaaaccggtattcgaatttcggctaggtcggggtctggggtaaccctagtttccaacctctacaccgattccgagccaacgccctgacgaggactaggaagtatcggtaggcttaagttttactacgtgtacagactaacgtattacttactttctttacgcttacggtttcggacggtaggaccgtaagggtcgagtactaacgaaaacgtagtgtcggctggaccctacctagttcgtttactccttcgtaccg

SEQ ID NO: 63724 - DNA, 940 bp, Homo sapiens
  misc_feature: GYAE6OF01BWS6V.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggccccacaataacaactacttagcttggtaccagcagaaagtaggacagcctacctaaactcctgacttttacgtgggtccttccgtaccccggggtctaacggttccccgggggtttacccctaaaacccggtactttaccgtaagtttcgggaccgtaacgggtccgggggttaccgttcggggggaaccccggttaagttttttacccgaaccctttcccgttaccctaaacccccgttaaacgttacccgtaaacgggtacccgtaaaccgggtcccccgtttacgggacccgtaacggggtcccgttaagggaaaaacgggtaacgtttacggggttacggggttacccgttaaagggtttttttaacgtttaaacccgttttacgggttaacccggtaaacggtaaccccgtaaaaaccgtttaactttttaaaccgttttaaacccgttttttcccgttttttacccgggtttaccccgtttaacccgggtttttttaccccggggggaacccgggggttaaaccggggggtaaacccccggttaaaaggggggtttaccggggtaaacggtaaaccgttaacccggtaaaaaacccgggttaaaccgtttacggggttacgggtacccgttacggaccccgtaaacccttaacgtttacccgtttcggtttcccgtttaccgttaacccg

SEQ ID NO: 63725 - DNA, 703 bp, Homo sapiens
  misc_feature: GYAE6OF01A4YHI.31.78.H01.1.454.CMB.1.raw
  modified_base (205)..(205): a, c, t, g, unknown or other
  misc_feature (205)..(205): n is a, c, g, or t
  modified_base (239)..(239): a, c, t, g, unknown or other
  misc_feature (239)..(239): n is a, c, g, or t
  modified_base (324)..(324): a, c, t, g, unknown or other
  misc_feature (324)..(324): n is a, c, g, or t
  modified_base (343)..(343): a, c, t, g, unknown or other
  misc_feature (343)..(343): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagtacctcccgtggctgtgtctcgtgggcgagnggcccacatcaactgcaagtccagccagtagttnttttacttcggccccaacaataacaactacttagcttggtaccagacaagaagtgacacgcctacctaactcctagtacttacgngggtccttcgtacccgggntacggttccccggggttacctaaccgtattccgtagttcggacgtacgggtccgggttaccgtcgggtaccttactttcaacgtttccaccaacctctaccgagtcctacgcccgtacgacgtacggcttaaggaagtacgtggtacggtactttaggtttacttacgtagtaccacgtacctaacttaatttcttaccttttacgttccgttaccgttaccgtttccggggacgggtaccggaacggttaacgggtacggtaacgtaacgtaaccggtaaaaccggtacggttacgggtcgggtacgttcgtaaacccttacgtaacgtttaccgttacgtttacccgttcctaacccg

SEQ ID NO: 63726 - DNA, 811 bp, Homo sapiens
  misc_feature: GYAE6OF01B8T0B.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgacaagtccagccagagttgttttattcggccccaacaataacaactacttagcttggtaccagcagaaagtaggacagcctacctaaactcctagtactttacgtgggccttccgtacccgggctacggttaccccggggttaccctaaaccggtattccgaagtttcggaccgtacggtccggggttccgttacggggaacccgtaattttccgaccgttccctaccctaaacccgtaacttaccgaacggaccgtaaccggcccgttacggaccgtaacgggtaccgtaaggaaacgtaagttacgggttacgggtaccgtttaaggtttttaactttaaccggttacgttaccgtaacggtaacctaaaaccgttaatttttaaccgttaaccctttttaccggtttttacccgttaccgttaaccggtttttacccggggaaccgggggttaaccggggtaacccggtaaacggggttacgggtaaacggtaaacgttaacccggtaaaaaccggtaccggttacgggttacgggtaccgttaccggaacctaacccgtacgtttaccgttacgttccgttcgttaacccg

SEQ ID NO: 63727 - DNA, 782 bp, Homo sapiens
  misc_feature: GYAE6OF01C44UO.31.78.H01.1.454.CMB.1.raw
  modified_base (349)..(349): a, c, t, g, unknown or other
  misc_feature (349)..(349): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgaggacgggccaccatacaactgcaagtccagccagtagttgttttattcggaccccacaataacctaactacttagcttacggaccagacagaaagtagaccagaccctacctaaactccgtagtatttacgtggtccttacgtacccgggntaaccgtccggggttaccctaaaccggtatttcaagtttcggaccgtacggtcggggtacctggggaaacccgttatttacccgaaccttccgttaccaaacccgtattacccgaggtcccgaaaccgtcccgttcggacggtaacggtccgttaaggtaaaacgagtttacggacgggttacttaaggtttttaacgttacccgtagttaccgaaacgtacctaaacttaacgttttaactttaacccgtttttccgtttttaaccggttacccttacgggttttacccggggtaccgggtaacgggtaaccggtaacggggtttacgggaacgtacgttaaacccggtaaaacggtaccggtttaggtccgggaacgtccggtacctaaacccgttatttcccgtttacggttaccctttccgtaaccccg

SEQ ID NO: 63728 - DNA, 573 bp, Homo sapiens
  misc_feature: GYAE6OF01BHUDZ.31.78.H01.1.454.CMB.1.raw
  modified_base (339)..(339): a, c, t, g, unknown or other
  misc_feature (339)..(339): n is a, c, g, or t
  modified_base (363)..(363): a, c, t, g, unknown or other
  misc_feature (363)..(363): n is a, c, g, or t
  modified_base (398)..(398): a, c, t, g, unknown or other
  misc_feature (398)..(398): n is a, c, g, or t
  modified_base (413)..(413): a, c, t, g, unknown or other
  misc_feature (413)..(413): n is a, c, g, or t
  modified_base (428)..(428): a, c, t, g, unknown or other
  misc_feature (428)..(428): n is a, c, g, or t
  modified_base (436)..(436): a, c, t, g, unknown or other
  misc_feature (436)..(436): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagaggccaccatcaactgcaagtccagccagagttgttttattcggcccccaacaataacaactacttagcttggtaccagcagaaagtaggacagccctactaaacgtcctagtatttacgtgggtcttccgtaccccgggnacgtcccggggttacctaaccgtnttccagttcggctaggcgggtctcggggtaccgtntttcgactctcaccntacagcacgctgacngctgaagntaggtgctagtttataccgtgtcagtacaatagttactactttcttccgtctacgtttcggacggtacggaccgaagggtgagtaagtacgaaacggtatcggtcgcgttgacctacgtattctcgttcctctaccg

SEQ ID NO: 63729 - DNA, 692 bp, Homo sapiens
  misc_feature: GYAE6OF01C1P0Z.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgaggagggcccaccatcaactgcaagtccagccagtagttgttttattcggccccacaataacaactacttagcttggtaccagacagaaagtaggacagcctacctaaactctgtattacgtgggtcttcgtacccgggactacgttcccggggttaccctaaaccggtattactagtttcggccgtaagggtccggggtcgttcggggtaaccctacgtttcccaccgttcctccaaccctattaccgacggcctacggtcccctggaccgaacgggctaacggaagtagttcggtaggtccgttaagttttacttacgtaggtacctaagacctaaacgtacttttaagttacccttttacgttttaccgtaccttaccggttttccgggaccggggtagggtaacccgtaaggggtacggaacgtacgtaaccgaaaaccgtacgttggtcggtcgtaccgactacctagttccgttacgttcttcgtaccc

SEQ ID NO: 63730 - DNA, 636 bp, Homo sapiens
  misc_feature: GYAE6OF01ES848.31.78.H01.1.454.CMB.1.raw
  modified_base (382)..(382): a, c, t, g, unknown or other
  misc_feature (382)..(382): n is a, c, g, or t
  modified_base (432)..(432): a, c, t, g, unknown or other
  misc_feature (432)..(432): n is a, c, g, or t
  modified_base (439)..(439): a, c, t, g, unknown or other
  misc_feature (439)..(439): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtcgccgtacggggacatcgtgatgagcctagttccagacctcccgtggctgtgtctcgtgggcgaggacgggcccacatcaactgacaagtccagccgagtagttgttttacttccggaccccaactaataactaacttacttagtcttaggtaccagacaagaagtagacacgtcctacctaaactcctagtacgttacgtcgggtcttccgtaccggctacggttcccgggttacctaacgtnttctagttcggcgtacggcggtcgtcgggtacctcttcactctacacctnacagtcncgccgtagcgacggtctagaacgtagtcggtagtacgttagtttactacgtacgtacacgtactaacttacttaacttcgtttccttacgtacgttacgtttcgggacggtacggacgtaggtacggtacgtaagtaacggtaacgtagacggtcgtacgtcgacctaccgttactccgttcgttacgtcccttacg

SEQ ID NO: 63731 - DNA, 627 bp, Homo sapiens
  misc_feature: GYAE6OF01ARPRH.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgaggagggccaccatcaactgcaagtccagccagagttgttttattcggccccacaataacaactacttagcttggtaccagcaagaaagtaggacacgcctacctaaactcctgtactttacgtgggtcttccgtacccgggctacggtcccggggttacctaaaccggtacttacctagtttcggaccgtagggtccggggtcgtacggggacccgtatttccacgttcctaccaccatacagcacgcctgacgaggtctagaaagtgtggtaggacttagtttacttacgtgtacagacctaatatttacttacctttctttcgtacttaccgtttcgggacggtacgggtaccgtaagggtcggaagtacgtaaccgtaaacggtacgtggtcggactacgacctacctactctcgttcttctaccg

SEQ ID NO: 63732 - DNA, 669 bp, Homo sapiens
  misc_feature: GYAE6OF01DGT4Q.31.78.H01.1.454.CMB.1.raw
  modified_base (329)..(329): a, c, t, g, unknown or other
  misc_feature (329)..(329): n is a, c, g, or t
  modified_base (348)..(348): a, c, t, g, unknown or other
  misc_feature (348)..(348): n is a, c, g, or t
  modified_base (375)..(375): a, c, t, g, unknown or other
  misc_feature (375)..(375): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagtttccagacctccctggctgtgtctcgtgggcgaggacggcccaccataccaactgacaacgtccagccagtagttgttttatcggaccccacaataacactacttagcttgaccagacaagaaagtaggacacgtacctacctaactcctagtactttacgngggtccttcgtacccgggntacggttcccgggttacctaaaccgtnttactagttcggacgtagggtcgggtcgtcgggaccttattccacctcgtaccacctatccgagtcacgtcctcgaccgaggtctagaagacgttggtggtacttaagttttactacgtgtacacgactaacttatttacttacctttacgtttcgtacgttacggtttccgggacgggtacgggtaaccgtaagggtaggaacgttaacgtaaccggaaaaaccgttacggttcgggtcggaccttacggaccgtaaccctagttaccgtttacgttccgttaccgtaacccg

SEQ ID NO: 63733 - DNA, 906 bp, Homo sapiens
  misc_feature: GYAE6OF01CTRYE.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagacctcccgtggctgtcgtctcgtgggcgaggagggccaccatcaactgcaagtcagccagtagttgttttatcggaccccaactaataacaacttacttagcttaggtaccagacaaggaaagtaggacacgtaccctaccgtaaactcctagtactttacgcgggtacctttccgacccgggctacggttcccggggttaccctaacgtactttcgaacgtttcggacgtacgggtcccggggttcgtacgggggtaaccccttagttttacccgaacctttaccgtacccgtaaacccctaagtacccgtacgacccgtacggtaccccttacgggacccgtacggggtacccgtagggtaaaacggtacggttagggtttacgggtaccgttttaaacggtttttaaacgtttaacccgttacggtaaccgtaaccggttaaacctaaaccggttttaaactttttaaccgttttaaacccctttttcccggtttttttaaacccggttaccccggttttaacccgggtttttacccgggggtaaccccggggttaaacggggtaaaccccgggttaaaagggggttaacggtaaaccgggttaaacgttaaacccggtaaaaaccgggttaacccggttacggggtacgggtaccccggttaaccggaaacccgttacccggttaacttcccgggtttaccggtttccccttaacccggtttaaccccg

SEQ ID NO: 63734 - DNA, 957 bp, Homo sapiens
  misc_feature: GYAE6OF01EJV89.31.78.H01.1.454.CMB.1.raw
  modified_base (369)..(369): a, c, t, g, unknown or other
  misc_feature (369)..(369): n is a, c, g, or t
tcagcagtagacgtcacgaccggtgctcgatttagtgtgagtagtttgggtttggggggagcgtacaacaggccaggcaggggcagcaagatggtgttgcagacccaggtcttcatttctctgttgctctggatctcttggtgccgtacggggacagttcgtgatgagacctagtttccagtactccctggctgtgtctcgtgggcgagaggaccacatcaactgaccaaggtcccagccagtagttgttttattcggcccctacaataacgaactacttagcttaggtaaccagacagaaagtcggacacgtccctacctaaactccgtaggtaagtttaccgtggggcctttccggtaccccgggtntaacggtttcccgggggtttacccttaaaccgggtattttccgaagttttcgggacctaagggtcccgggggtttacctacggggggaaccccgttaacgtttttcccgaaaccgtttacccggtaccctaaacccgtaacttaccgaacggtacccgtaaccgtacccgttaggacccgtaacggggttacccttaagggaaacgtaacgttacggggttacgggttaccgtttaaaggttttttaaccgttaaaccgtttacggttaacccgtaaacggtaacccgtaaaacccttaagtttttaaaccgtttaacccgtttttacccggtttttaacccggttaaccccgttttaacccgggttttttacccgggggaacccggggtttaaaccgggggtaaaccccgtttaaaggggggttacgggtaaaaccgggtaaacggtttaacccgggtaaaaaacccggggttaacgggttacggggttaccggggtaaccggttaaccgggtaacccggtaaaccccgtttaaacggtttacccggtttaacggtttcccccggtttaaccgggttaaacccccgg

SEQ ID NO: 63735 - DNA, 606 bp, Homo sapiens
  misc_feature: GYAE6OF01DP3KS.31.78.H01.1.454.CMB.1.raw
  modified_base (334)..(334): a, c, t, g, unknown or other
  misc_feature (334)..(334): n is a, c, g, or t
  modified_base (353)..(353): a, c, t, g, unknown or other
  misc_feature (353)..(353): n is a, c, g, or t
  modified_base (411)..(411): a, c, t, g, unknown or other
  misc_feature (411)..(411): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagacctccctggctgtgtctcgtgggcgaggacgggccaccatcaactgacaagtccagccagtagttgttttattcggaccccaacaaataacaacttacttagcttaggtaccagacaagaaagtaggacacgcctacctaaactcctagtactttacgngggtccttccgacccgggntacggtccggggttaccctaaccgtattcagttcggcacggtcgggtctgggaccgtntttccactctacacatcagcacgtcctgcaggctagaagtgtggtaggcttaagtttactacgtgtacagactaactatttactactttcgtttcgtctacgttcgggacggtacggaccgtagggtgaagtacgtaacgaaacgtagtcggtacggctacgaccctacgtacttccgttcgttctccgttaccg

SEQ ID NO: 63736 - DNA, 563 bp, Homo sapiens
  misc_feature: GYAE6OF01A8OUB.31.78.H01.1.454.CMB.1.raw
  modified_base (559)..(559): a, c, t, g, unknown or other
  misc_feature (559)..(559): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacaactacttagcttggtaccagcagaaagtaggacagccctacctaaactcctgtatttacgtgggtcctttccgtaccccgggctaacgttcccggggtttaccctaaaccggtatttccaagtttggccaggtcggggttctggggaccctatttcacctctacacctatcagcagcctgcaggctagaagtatgtggctagtttacttactgtacagctaactattactacttcttcgtctacgtttcggacggtacggacgaaggtggagagtacgaacgatggtgctgcacatctgtcttntacg

SEQ ID NO: 63737 - DNA, 763 bp, Homo sapiens
  misc_feature: GYAE6OF01BHFN3.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagacgggccaccatcaactgcaagtccagccagtagttgttttacttcggaccccctaactaaataactaacttacttagtcttaggtaccagacaagaaagtaggacacgcctacctaaactccttagtactttacgtcgggtccttccggtaacccgggctacggttccccgggggttaccctaaaccggtattaccgtagttcggacgtacgggtccggggttccgtaccgggggtaacccgttacttttccgaacccttccgtaccgtaacccctagttacccgacggtccgaacgtcccgtaggaccgacgggtaccgtacggaaaggtacgttggttacggtacgttaacgttttaacttacgttacggtacgaacgtactaacttaactttaactttaacctttccgttttacgttaccgttacgggtttccgggacgggtaacgggtaaccggtaagggttacggaacggtaacgttaaccggtaaacggttaaccgttggtcgggtaccgtacggtaccctaacgttaacgttctccgtttccttaccgttaacccg

SEQ ID NO: 63738 - DNA, 596 bp, Homo sapiens
  misc_feature: GYAE6OF01CZI3H.31.78.H01.1.454.CMB.1.raw
  modified_base (319)..(319): a, c, t, g, unknown or other
  misc_feature (319)..(319): n is a, c, g, or t
  modified_base (339)..(339): a, c, t, g, unknown or other
  misc_feature (339)..(339): n is a, c, g, or t
  modified_base (368)..(368): a, c, t, g, unknown or other
  misc_feature (368)..(368): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactcctggctgtgtctctgggcgagagggccaccatcaactgcaagtccagccagagttgttttattcggccccacaaataacaactacttagcttaggtaccagcaagaaagtaggacagcctacctaaaactcctgtatttacgngggtccttcgtaccccgggnacgttcccgggggttaccctaaaccggtnttacgaagtttggacctaggtcggggttctggggaccgtatttcgactctcacctatcagcagcctgcaggctagaagatggtgctagtttatctgtcagacaatattactactttctttcgtactacgtttcggacggacgggtaaccgtaagggtacggagtacgtaccgaaaacggtaccgttggtacggccttgacacccgtaattctacgttcttcgtaaccg

SEQ ID NO: 63739 - DNA, 517 bp, Homo sapiens
  misc_feature: GYAE6OF01ANU49.31.78.H01.1.454.CMB.1.raw
  modified_base (409)..(409): a, c, t, g, unknown or other
  misc_feature (409)..(409): n is a, c, g, or t
  modified_base (510)..(510): a, c, t, g, unknown or other
  misc_feature (510)..(510): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagttttccagactccctggctgtgtctctgggcgagagggccaccatcaactgcaagtccagccagagtgttttattggccccacaataacaactacttagcttggtaccagcagaaagtaggacagcctacctaaactcctgatttactgggcttctacccgggcagtccggggtcctaaccgattcattggcagcgggtctgggaccgatttcactctcaccatcagcagcctgcaggctgaantgtgctagtttatactgtcagcaactattatactttctttcgtctacgtttcggcggaggaccaggtggagagtacgaaacgtatggtgctgcaccatctntctctac

SEQ ID NO: 63740 - DNA, 642 bp, Homo sapiens
  misc_feature: GYAE6OF01EK41D.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagtagtgttttattcggaccccacaaataacaactacttagctggtaccagacagaaagtggacacgtcctacctaaactcctagtactttacgtgggtccttaccgtacccgggctacgttcccggggttacctaaccgtattcagttcggcaggcgggtctagggaccctatttcactctaccaccatcagcacgcctgcgaggctagaagactggtacgtactagttttaacgttactaggtacaagtaccaactaatttacgttaacctttccgttttacgtaccttacggtttccgggacgggtaaccgggaaccgtaagggtaggtacgtaacgtaacccgtaaaacggtaacgtcggtaggcccgttagaccctaaccgtaattcccgttacgttccgttctaacccg

SEQ ID NO: 63741 - DNA, 560 bp, Homo sapiens
  misc_feature: GYAE6OF01ER4WE.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcaagaaagtaggacagccctacctaaactcctgtatttacgtgggcttccgtacccgggctacgttcccggggttcctaaaccgtattcattcggcaggccgggtctgggaccgtatttccactctcaccatcagcagcctgcaggctgaagagtggtggctagtttattacgtgtcagtaccaactatttattactttcctttcgtcttacgtttcgggacggtagggtaaccagggtcggagtatacgaaacgtatcggtgcgtgccacctatctgtctctacg

SEQ ID NO: 63742 - DNA, 1013 bp, Homo sapiens
  misc_feature: GYAE6OF01BMNND.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagacgggccaccatcaactgcaagtccagccagagtgttttattcggccccacaataacaactacttagcttggtaccagcagaaagtaggacagccctaccgtaaactcctgtactttacgtcggggtaccttccgtaccccgggctaacgttccccgggggtttaccctaaaccgtattcccgtaagtttcgggccgtaacgggtccgggggttaccttacggggggtaaccccgtaacgtttttcccaaccgttcccttaccaaccccgtaattcccgaacgggtaccctaacggtcccctagggtaccgtaacgggtaccgtaaggaaaacggtacgttacgggttacgggtaccgttaaggtttttaaccgtttaaccgttacggttaccgtaaacggtaaccctaaaaccgttaacttttttaaacgtttaaccccgttttttaccgttttttaaccccgggtttacccgtttaaaccccgggttttttacccggggggtaacccggggggttaaacccggggggttaaacccccgggttaaaagggggggtttaacccgggggtaaaaacgggttaaacccggttttaaaaacccccgggtaaaaaaaccccgggggttaaaaaccccggtttttaacggggggtttaaccccgggggttaacccccggtttttaaccccggggggttaaaaccccccttaaaaacccccccgggtttaaaccggttttttaccccccggggttttaaacccggggtttttttaaccccccccggttttttaaaccccgttttaaaaacccccccgggg

SEQ ID NO: 63743 - DNA, 767 bp, Homo sapiens
  misc_feature: GYAE6OF01DSKQV.31.78.H01.1.454.CMB.1.raw
  modified_base (229)..(229): a, c, t, g, unknown or other
  misc_feature (229)..(229): n is a, c, g, or t
  modified_base (266)..(266): a, c, t, g, unknown or other
  misc_feature (266)..(266): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagttccagactccctggctgtgtctcgtgggcagagggcccaccatcaactgcaagtccagccagngttgttttattcggccccacaataacaactacttagnttggtaccagcaagaagtagacagcctcctaaactccttatttactcgggtcttcgtacccgggcacgttcccggggttacctaaccgtattaccgagtttcggactacggtccggggttacctacgggggtacccgtaacgtttttaccgaaccgtttcccttacccgaaacccctaacgttcccgaaacggacccgtaaggtccccccttagggacccgtaacggggtaccgttaacgggaaaacggtagttacgggttacgggtactttaacggtttttaacgtttaacgttcgtacgtaacgtaacctaaacttaatttaactttaaccgttttccttttaccggtacctttaccggtttaccggggaccgggtaacggggtacccgtaaagggttcgggtaagtaaccgtaacgaaaaccggtaacgttggtacgggtccgttaccgacctaacccgtacgtttaccgttgtttacccttacgtacctttcccccg

SEQ ID NO: 63744 - DNA, 673 bp, Homo sapiens
  misc_feature: GYAE6OF01EG80H.31.78.H01.1.454.CMB.1.raw
tcagcagtagacgtcacgaccggtgctcgatttagtgtgagtagtttgggtttgggggagctacaacaggcaggcagggggcagcaagatggtgttgcagacccaggtcttcatttctctgttgctctggatctctggtgccgtacggggacatcgtgatgagcctagtttccagacctccctggctgtgtctcgtgggcgagacgggccaccatcaactgacaagtccagccagagttgttttacttcggacccccaacaaataacaactacttagtcttaggtaccagacaagaagtacgacacgtacctacctaaacctctagtactttacgtcgggtccttaccgtacccgggactacgtcccggggttacctaaccgtacttcgagttcggacgtaggtcgggtcgtacgggtaccgtatttccacctctaccacctactcgacgccgacgcctcgcgaggtctaggaacgtagtggtacgtacttagtttacttacgtgtacagtactaactactttacttacctttcgtttaccgtacgttaccggtttccgggacgggtaacgggtaaccggtaagggtacggaacgtaactaacggtaaaccggtaacgttgggtcggtacgtacggacctaaccgtattaccgttacgttcttaccgtacccg

SEQ ID NO: 63745 - DNA, 807 bp, Homo sapiens
  misc_feature: GYAE6OF01BZ4G7.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagactccctggctgtgtctcgtgggcgagacgggccaccatcaactgacaagtccagccagtagttgttttattcggccccaacaataacaactacttagcttaggtaccagcaagaaagtaggacagcctacctaaactcctagtactttacgtgggtccttccgtacccgggctacggttcccggggttaccctaaaccggtattcgaagttcggaccgtacgggtccggggttcgtacggggtaacccgttagttttaccaaccgttcctaccaaccgtacttaccgaacggtcccgaacggtcccgttacggaccgtaacgggtaccgttaagggaaaacggtacggtttacgggtacgggttactttaaacgggtttttaactttaccggttacggttaaccgaacggtaacctaaaactttaacgttttaacgtttaaccctttttaccggtttaccggttacccgtttaaccgggttttaccggggaaccggggtaacggggtaacccggttaaagggggttacggtaaacgttaaacgtaaccggtaaaaccggttacggttcgggttacggtaccgtacgtacccgtaaccttacgttaccgttaccgttccgttaccgttacccg

SEQ ID NO: 63746 - DNA, 643 bp, Homo sapiens
  misc_feature: GYAE6OF01CULVY.31.78.H01.1.454.CMB.1.raw
  modified_base (369)..(369): a, c, t, g, unknown or other
  misc_feature (369)..(369): n is a, c, g, or t
  modified_base (420)..(420): a, c, t, g, unknown or other
  misc_feature (420)..(420): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagactccctggctgtgtctcgtgggcgaggacgggccaccatcaactgacaacgtccagccagtagttgttttactcggccccacaataacaactatagcttaggtaccagcaagaaagtacgacacgtcctacctaactcctagtactttacgtcgggtccttcgacccgggctacggttcccgggttaccaacgtnttcagttggcaggtcgggtcgtcgggaccttattccacgtcctacaacctntacgacgtcacgtccgtgccgacggctagaagtagtggtcgtacttagtttattaccgtagtaccagtacctaacgttattaactttacctttcgtttcgtaccgttaccggtttcgggacgggtacgggtaaccgtaagggtacggaacgtacgtaacgtaaaccgtagttacggtcggacctacgtacctacgtacttaccgttcttccgttcgttacccg

SEQ ID NO: 63747 - DNA, 795 bp, Homo sapiens
  misc_feature: GYAE6OF01E36RI.31.78.H01.1.454.CMB.1.raw
tcagcagtagacgtcacgaccggtgctcgatttagtgtgagtagtttgggttgggggagctacaacaggcaggcagggcagcaagatggtgttgcacgacccaggttcttctatttctctgttgctcgtggctctcgtggtcgaccggtacggggactacgttcggtagacgtacggaccgtacccgttacgtttacccgaacggtcccgttcccggtggtcgttggtcgtaccgtcggtacgggaccggaacggaccggaccctaactacgtaacctaacgtcgaaccgtacgtaccgtacgtaccgtaggtttacgtttacgtttaccgtacccgaaccctaaactaaactaacaacgttacgtacgtacgtaccgaacgacgtaacgaagtaacgtacaccgtacctaccctaactacgtctacgttaaccgtccggcgtaccgttcccggtaccgtacgtaccggttccgtacgtacgtactacggtcgtcggagtccggtacgtacgacgtactactacgtctacacacgtcacgacgtacgacgtccgagtaccgagtacgtaagtacgttgacggttactaacgtttattacccgagtacccgtaactttactaacgttttacgttaaccgtttccgtttacccggttcgggaaaccgttacggtaaccggggtgggaaaccgtaagtaccgggtaggtacgtaaacctacggtaacgtcgtaccgtcggtacctacgtacccgttacctaccgttcgtacccttccgttaaaccgcgtttaaccccg

SEQ ID NO: 63748 - DNA, 650 bp, Homo sapiens
  misc_feature: GYAE6OF01CBD46.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagtttccagactccctggctggtgtctcgtgggcgaggacgggccaccatcaactgacaagtccagccagtagttgttttattcggaccccacaataacaactactagcttggtaccagacagaaagtaggacacgcctacctaactcctagtactttacgtgggtccttccgtacccgggactacgttcccggggttacctaaccggtattcctagttcggactacggtccggggtcgtacggggaacctagtttccaaccttcctaccaacctatccagccgacgtcccgtagcgacggctaggaagtagtggtgtactagtttactacgtagtctacgacctaactatttacttacctttcgttcgttaccgttacggtttcgggacgggtaggtaccggtaaggttaggaacgtactaaccgaaacgtacgtggtacgggcctaggacctaaccgtagttaccgttcgtccttccgtacccg

SEQ ID NO: 63749 - DNA, 761 bp, Homo sapiens
  misc_feature: GYAE6OF01CMYPW.31.78.H01.1.454.CMB.1.raw
  modified_base (330)..(330): a, c, t, g, unknown or other
  misc_feature (330)..(330): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagactccctggctgtgtctcgtgggcgaggagggccaccatcaactgacaagtccagccagtagttgttttattcggaccccaacaataaccaactacttagcttaggtaccagacaagaaagtaggacacgccctacctaaactctagtatttaccgnggtcctttaccgtacccgggctacgttcccggggttacctaaccgtattcagtttggaccgacgggtccggggttcgtacgggggtaacctacgttttccaaccgttcctaccaaccctaacgttccgaacggccgaacggtcccgtcggaccgaacgggtaccgtaaggaaacggtagttacggtacgggtacgttaacggtttttaagttaccgttaggtaccgaacggtacctaaaacgttaacttttaacttaacccttttccgtttttaccggtacctttaaccgggttttccggggaccggggtaacgggtaacccggtaaaggggttacgggaaacgttaacgtaaaccgtaaaaccggtaccggttcggtacgggaccgttacggacctaaccgtacgttcgttaccgttcgtttcctacccg

SEQ ID NO: 63750 - DNA, 523 bp, Homo sapiens
  misc_feature: GYAE6OF01A27QU.31.78.H01.1.454.CMB.1.raw
  modified_base (232)..(232): a, c, t, g, unknown or other
  misc_feature (232)..(232): n is a, c, g, or t
  modified_base (326)..(326): a, c, t, g, unknown or other
  misc_feature (326)..(326): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtntttattggccccacaataacaactacttagcttggtaccagcagaaagtaggacagcctcctaaactcctgatttactgggcttctacccgggnagtccggggttctaaccgattcattggcagcgggtctgggaccgtatttcactctcaccatcagcagcctgcaggctgaagatgtggctagtttatactgtcagcaatattatacttctttcgtctacttttcgggacggtagggaccgaaggtggagatacgaaacgataggtggctgctaccatctgtcttgtac

SEQ ID NO: 63751 - DNA, 725 bp, Homo sapiens
  misc_feature: GYAE6OF01A7ESP.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagactccctggctgtgtctcgtgggcgaggcgggccaccatcaactgacaagtccagccagtagttgttttattcggcccctaacaataacaactacttagtcttacggtaccagcaagaaagtaggacacgccctactaaactcctagtactttacgtgggctttaccgtacccgggctacggtcccggggttacctaaaccggtattccagttcggcacgggtcgggtactggggacctagttaccgactctacacctaatccgacgcacgccctgaccgtaggtctaaggaaacgtagtgggtacggtacgtttaagtttaacttaaccgtgttaccgaaggtaacctaaacgttaattttaactttaccgttttacctttacccgggttaccgtttaaccgggttttccggggaccgggtaacggggttaacctaaacggggggtttacggaacggttaaacgttaaacccgaaaacgggttaaccttggggtaccggtaccgtccggtaactacccgtaagttccgttacgttaccgttccgtaacccg

SEQ ID NO: 63752 - DNA, 678 bp, Homo sapiens
  misc_feature: GYAE6OF01C8ZXL.31.78.H01.1.454.CMB.1.raw
  modified_base (416)..(416): a, c, t, g, unknown or other
  misc_feature (416)..(416): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagttccagactccctggctgtgtctcgtgggcgagacgggccaccatcaactgcaacgtccagccagtagttgttttatcggccccacaaataacaactacttagcttggtaccagacaagaaagtaggacacgcctacctaaactcctagtactttacgtgggtccttaccgtacccgggactacggttcccggggttaccctaaaccggtattcgagttcggccagggtccgggtctaggggtaacccgtntttccgactctaccaccatcagcacgcctagctaggctaggaacgtagtggtacggcttagttttacttaacgtcgttacagtaacctaactatttaacttacctttccgttttaccgtaccttaccggtttccgggaacgggtacgggtaacccgtaaaggggttacggaacgttaacgtaaccgaaaaacggttacgttcgggtacggtaccgtacgacccgtaacccgttattcccgtttacggtcctttacgtacccg

SEQ ID NO: 63753 - DNA, 548 bp, Homo sapiens
  misc_feature: GYAE6OF01A8641.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacaactacttagcttggtaccagcagaaagtaggacagcctcctaaactcctgatttacgtgggccttctaccccgggcacgttccggggttacctaaccgattcattggcagcgggtctgggaccgatttcactctcaccatcagcagcctgcaggctagaagatggtggctagtttattactgtacagcaactattatactttcttcgtcctacgttcggacggtagggaccgtaaggtggtaagagtacgaaacgtaacgtggtcggactcgctaccattctcgtcttcgtac

SEQ ID NO: 63754 - DNA, 922 bp, Homo sapiens
  misc_feature: GYAE6OF01DS3BO.31.78.H01.1.454.CMB.1.raw
  modified_base (216)..(216): a, c, t, g, unknown or other
  misc_feature (216)..(216): n is a, c, g, or t
  modified_base (247)..(247): a, c, t, g, unknown or other
  misc_feature (247)..(247): n is a, c, g, or t
tcagcagtagacgtcacgaccggtgctcgatttagtgtgagtagtttgggtttgggggagctacaacaggcaggcgaggggcagcaagagtggtgttgcgaccgacccaggtcttcactttcgtctcgttgctctggagtctctggtgccgtacgggacatcgtgatgacgcctagtttccacgacttccctggcttcgtcgtctcgtgggcgagngggtccgaccatactaactgactaacgtccngacccaagtagttcgtttacgttaccggtaacccctaactaaattaacgtaacttacttagtccttaggtaacctagaaccgaacgaaacgtacgacctacgaccttacctaaactccgtagtaactttacgtcggtacctttccggtaaccccgggtcgtaaacgttcccgggggttacccctaaacccggtacgtttaccgaacggttttcggacgtacggggtccggggttaccggttacggggtaacccgttacggttttacgaaccgttaccgttaccttaacccgtaaacgttcctaaccggacctacggtacccctcggaacccgtagggtacctaacgggtaaacggtacgttaggggtaccggtttacgtaacggtttttaacttaaccgtttaccgttaccgttaaacggtaccttaaaacctaacgtttttaaccgtttaaaccgtttttcccgttttaaaccccgggtttccctttaaacccgggtttttccgggtaacccgggggtttaaccggggtaaccccgggtaaaggggttaccgggtaaaacgttaacggttaaaccgtaaaaacggtaaccggtttaacgggttacgggtacccttagggaccccttaaacgttacccgttaccgttttcccgttcgtttcccgtttaaacccgg

SEQ ID NO: 63755 - DNA, 741 bp, Homo sapiens
  misc_feature: GYAE6OF01C2RCS.31.78.H01.1.454.CMB.1.raw
  modified_base (349)..(349): a, c, t, g, unknown or other
  misc_feature (349)..(349): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctcgtggtgcctacggggacatcgtgatgagcctagtttccagacctccctggctgtgtctcgtgggacgaggacggccaccatcaactgacaacgtccagaccagtagttgttttacgttccggacccctaacaactaaacctaacttacttagtcgttacggaccagacaaggaaaggtagacacgcccttacctaaacttcctgtactttaccgngggtacctttccgacccgggtctaccggttcccgggttacctaaccgtacttcacgttcggacgtacgggtccggtacggtacgggtaccgtactttaccgacctctaccaacccgtatccgacgctacgtcccgtcgaccgacggtacgagtaaacgtgtcggtcggtactttaggtttaccttacgtcgtacgtacgtaactaacctttaatttacctttaccttttccgtttaccggttaccttaaccgggtttcccggggtaacgggaccgggtaacccggtaaggggttacggtaaaccggtaactaaacccggtaaaacggtaacgttcggtacggtacctacggaacccttaccgtacgtttaccgttccttcgttccgtacccc

SEQ ID NO: 63756 - DNA, 806 bp, Homo sapiens
  misc_feature: GYAE6OF01CXO9I.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagtttccagcctccctggctgtgtctcgtgggcgaggacgggcccaaccatcaactgacaacgtcccagccagtagtttgtttttacgttccggaccccctaaccaaattaaacctaaccttaactttacggccgtttacggtaacccagacaaagaaaggtacggacacgacccttacccgtaaaacctcctagtaacttttaccggtcgggtacccttttccggtaacccccgggtacgttaacccgggtttacccccggggggtttaacccctaaaacccggttacttttaccggtaaacggttttcggggaccctaacgggggttccgggggttacccggttacggggggtaaacccttacgttttacccaacccgtttcccgttacccaacccgtaacgtcccgaacgggtccctaaccggtccccgtagacccgaacgggtaccgtaaggtaacggtagttgggtacggtacttaaagtttttacgttaacgtcgtacaacgtacctaaacttatttaaccttactttccgtttcgtaccttcggtttacgggacgggtacggaaccgtaagggtagacgtaactaacgaaacgtacgtgtcggactcgacctactacgttcttcgtctcgtaccc

SEQ ID NO: 63757 - DNA, 698 bp, Homo sapiens
  misc_feature: GYAE6OF01D5QIL.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagtttccagactccctggctgtgtctcgtgggcgagagggccacatcaactgacaagtccagccagtagttgttttacttcggaccccaacaataacaactacttagcttgaccagacaagaaagtaggacacgtaccctacctaaaactccttagtacttttacgtgggtccttccgtacccgggtactacggttcccggggttacctaaccggattacagttcggaccgagggtccgggttcgtacgggaaccgtattttccacttcctacgaacctatcgacgcacgtcctggaccaggtctaggaactagttgtcgtacttagttttaacttacgtagtacgacgactaactaactttacgttacctttccgttacgttaccgttaccggttccggttacgggtacgggtaaccggtaaacggtacggggtaaacggtaacgtaaccgtaaaccggtaaacgttacggttacgggtacgacccgttacgtaacccgtaccgttaagttccgttcgtttacccgttacccg

SEQ ID NO: 63758 - DNA, 657 bp, Homo sapiens
  misc_feature: GYAE6OF01C1A5G.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgaggacgggccaccatcaactgcaagtccagccagagttgttttattcggccccacaataacaactacttagcttcggtaccagacaagaaagtaggacacgtcctacctaactcctagtatttacgtgggccttcgtacccgggctacggttcccggggttaccctaaccgtacttcgagtttggccaaggccggggtacgtacggggacccgtaactttccgaacttcctaccacctatccagccagtccctgaccgtagggactaggaacgtatcggtaggtactaaggttttacttacgttagtacgagacctaaactagtttaacttacctttcgtttaccgttcttaccgtttcggggacggtacgggtaaccgtaagggtcggaagtactaacgaaaacggtaacgttggtcggaccttcgacctaccctacgttcgttcgttccttcgtaccg

SEQ ID NO: 63759 - DNA, 752 bp, Homo sapiens
  misc_feature: GYAE6OF01DTEEY.31.78.H01.1.454.CMB.1.raw
  modified_base (331)..(331): a, c, t, g, unknown or other
  misc_feature (331)..(331): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctgggtgcctacgggggacatcgtgatgagccagtttccagactccctggctgtgtctcgtgggcgagacgggccaccatcaactgaccaagtccagccagtagttgttttattcggaccccaacaataacaactacttagcttaggtaccagacaagaaagtaggacacgtcctacctaaactcctagtatttacgngggtccttccgaccgggctaacgttccggggttaccctaacgtattccgagttcggacgtacggccgggtcgtcggggtaaccctaattttccgaaccttccgtaccacctacttaccgaagtcccgtaacgtcccgtacgaccgtacgggtacgttaacggaaacggtaacgttcgggtacggttacgttaaggtttttaaccttacgttggtacctaaggtacctaaacgttaactttaacgtttacccttttaccgttttaccgttcctttaaccgggttttccgggaccggggtaacgggtaacccggtaaagggtacggtaacggtaaacgtaaccggtaaaaacggttacccgttgggtaccggtaccgtacggaccctaaccgtaacttccgttacgttccgttcctaaccccg

SEQ ID NO: 63760 - DNA, 726 bp, Homo sapiens
  misc_feature: GYAE6OF01CANPL.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagacggccaccatcaactgacaacgtccagccagtagttgttttactcggccccaacaaataacaactacttagcttaggaccagacaagaaagtaggacacgcctacctaaactctagtattacgtgggtcttaccgacccgggctacggttccggggttacctaaaccggtacttacgaacgttccggacgacggtccggggtacgtacggggacccttagtttaccgaccttcctaccgaacctaacgtcgaacgccgtaacggtccctacggaccgtacggtacgttaaggaaaggtaagttgggtacggtacgtttaagttttaactaccgttacgtacgaacgtaactaaacgttactttaacttaccgttttccgtttacgttccgttaaccggtttaccggggacgggtaacggtaacccggtaaggggtcggtaaacgtaacgtaaaccggtaaacggtaacgtcgggtacgtaccgtaccggtacctaccgtacgttcgttacgttcgttacctacccg

SEQ ID NO: 63761 - DNA, 622 bp, Homo sapiens
  misc_feature: GYAE6OF01BRHBR.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctctgggcgagagggccaccatcaactgcaagtccagccagagttgtttattcggccccaacaataacaactacttagcttggtaccagcaagaaagtaggacagcctacctaaactcctagtatttacgtggcttccgtacccgggctaacggtccccggggtttaccctaaccggtattcctagtttcgggccgtaacggtccggggttaccgtcgggggaacccgtattttccgaccttcctcctaaccatccaagtccacgcctggcacggctaggaagtatggtcggactaagtttacttacgtgtcaagcaactatttattactttcttccgtactacgtttcgggtaggacgggtaccgtaaggtaggagtaacacgtaaacgtacttggtcggacgtgaccctacgacttcgtcttcgttctaccg

SEQ ID NO: 63762 - DNA, 848 bp, Homo sapiens
  misc_feature: GYAE6OF01ECI7Q.31.78.H01.1.454.CMB.1.raw
  modified_base (476)..(476): a, c, t, g, unknown or other
  misc_feature (476)..(476): n is a, c, g, or t
tcagcagtagacgtcacgaccggtgctcgatttagtgtgagtagtttgggtttgggggggagctaacaacgaggcgaggcggaggggcagacaagagtgggttgttgacacgacccgaggttcttctatttctcttgttcgctcgtggacttctcgtgggtcgtaccggtacggggactagtcgtgtatggacgaccttacgtttccagtaccctccgtggtctggtcgtctcggtgggacgaggacggcccacatacaactgacaacgtccacgccgaaggtagtttagtttttacgttcccggaccccctaactaaactaaacctaacttacgttacgtccgttacggtaaccagacgaaaggtaaacggtacggaaccaccgtaccctaacctaaaccttccgttagttactttacggtcgggtccttcccggtacccggctaccgggttcccgggttaaccctaaaccgttnttactaggttcggacgtacggggtccgggttcggtaccggggtaaccttactttccaccttccctaccgaacctagttacgaacggtccaaccggtcccgttaggaaccgtagggtacttaagggaaagtacggttgggtacggtaccgttttaagtttttaacttaccgtggtaccaacggtaaccctaaagtttaattttacctttcccttttacgtttcccgtaccgtttaccgggttcgggggacgggtaacgggtaaccgtaaagggggttcgaaaggttacctaaaccggtaaaaccggttagttcggggtacggtacccctagaacccctacgttaccttcgttacgttccttaccgttacccgg

SEQ ID NO: 63763 - DNA, 710 bp, Homo sapiens
  misc_feature: GYAE6OF01BVT7M.31.78.H01.1.454.CMB.1.raw
  modified_base (232)..(232): a, c, t, g, unknown or other
  misc_feature (232)..(232): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgaggagggcccaccatcaactgcaagtccagccagngttgttttatcggccccacaataacaactacttagcttggtaccagcaagaaagtaggacacgcctacctaaacctcctagtactttacgtgggtccttccgtacccgggctacggttcccggggttacctaaaccgtattccgtagttcggacgtacggcggggttccgtaggggtaacccgtaagtttccaacccttccgtaccaaccctacgtaccaagcccgaacggtccgtacgacgtacggtccgtaggtaaacgtagttggtacggtacttaaggttttacgtacgtgtacgaacgtactaaacgttatttacgttaaccctttcgtttaccgttaccgttacgtttaccggggacgggtaacgggtaacccgtaaggggtacgtacgtaaacgttaccgaaaacggttacgttacggtcggtaccgtacgacccgtaaccagttaccttacgttccgttacccgtacccg

SEQ ID NO: 63764 - DNA, 596 bp, Homo sapiens
  misc_feature: GYAE6OF01BLUM2.31.78.H01.1.454.CMB.1.raw
  modified_base (447)..(447): a, c, t, g, unknown or other
  misc_feature (447)..(447): n is a, c, g, or t
  modified_base (451)..(451): a, c, t, g, unknown or other
  misc_feature (451)..(451): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagtttccagactccctggctgtgtctcgtgggcaggaggccaccatcaactgcaagtccagccagtagttgttttattcggaccccaacaataacaactacttagcttggtaccagacagaaagtaggacagcctacctaaactcctagtatttacgtgggtcctttccgacccgggctacgttcccggggttacctaaccgtattacgagttcggcacgggtcgggttcgtgggaaccgtatttcactctccactatcacgcagcctgcgaggtctagaagngtgnggtactagtttatctgtacagactaatattattaccttctttacgtccttacgttccgggacggtacggaaccgtaaggtcgtaagacgttaacgaaaccgtagtggtcgacctggacctacgtactacgtcgttcctcgtaccg

SEQ ID NO: 63765 - DNA, 880 bp, Homo sapiens
  misc_feature: GYAE6OF01C3AK2.31.78.H01.1.454.CMB.1.raw
tcagcagtagacgtcacgaccggtgctcgatttagtgtgagtagtttgggttgggggaaggcgtacaacgaggcaggacagggcgagcaagatggtgttcgcgagacccaggtcttcactttctctgttgctctggatctctggtgccgtacgggacatcgtgatgagccagttccacgtactcccgtggctgtccgtcgtccgtgggacgaggacgggccaccatcaactgacgaacgtccagccgagtagttagttttaagttacggacccctaacgtaaattaaacctaacttaaccttaacggtacgttacgggtaaccaacggaccaaggtaaacggtacggtactaggtacccttaacctaaaacttaccgtacgtaacgtttaaccgtacggggtcctttaccggtacccccgggactaacggttaccccggggttaccctaaacccggtagtttacccgtaagtttccggtccgtaacggggttcccgggggtaccgttacgggggtaacccttacgttttccgaaccgttccttacgaaccccttagttaccgaacggttccaaaccggtccgttacggaaccgtaacgggtacccgtaagggtaaaaggtacgttaacgggttcggggaacctttaaacgggttttttaaccttaaccgtgtttaaccgtaacggtaacctaaaacgttaactttaacgtttaaccgttttacgttttaaccgggtacgttacccgggttttacgggaacccgggttagggtaacccggttaggggttacggaaacgtaagtaacccgtaaaacggtaggtcggttacggaccttacggacctacccggttaagttccgtacgttcccgttacgtacccg

SEQ ID NO: 63766 - DNA, 602 bp, Homo sapiens
  misc_feature: GYAE6OF01DAA1Z.31.78.H01.1.454.CMB.1.raw
  modified_base (371)..(371): a, c, t, g, unknown or other
  misc_feature (371)..(371): n is a, c, g, or t
  modified_base (453)..(453): a, c, t, g, unknown or other
  misc_feature (453)..(453): n is a, c, g, or t
  modified_base (514)..(514): a, c, t, g, unknown or other
  misc_feature (514)..(514): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagtttccagacctccctggctgtgtctcgtgggcgagacgggccaccatcaactgacaacgtccagccagtacgttgttttattcggccccaacaataacaactacttagcttacggtaccagcaagaaagtaggacacgcctaacctaaactccgtagtatttactgggtcttccgtaccggctacgtccgggttacctaaccgtnttcgagtcggctaggtccgggtctaggaccgtactttcgaactcctcacctatcacgcacgccctgacaggctagagtatgnggtctagtttactaagtgtcaagctaaacgtatttactcttcgtttacgtctacgttcggnggaacggtacgtagtgaacgataaccgtaaaacggattcggtaccgtcgttacgacctaacccgtattccgttactcgttaccgtacc

SEQ ID NO: 63767 - DNA, 594 bp, Homo sapiens
  misc_feature: GYAE6OF01CHOAI.31.78.H01.1.454.CMB.1.raw
  modified_base (449)..(449): a, c, t, g, unknown or other
  misc_feature (449)..(449): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagtttccagacctccctggctgtgtctcgtgggcgagagggccaccatcaactgcaagtccagccagagttgttttatcgcccacaataacaactacttagcttggtaccagacaagaaagtaggacagccctacctaaactcctagtatttacgcgggtctttaccgacccgggctaacggttcccggggttacctaaaccgtattccagttcggcgaggtcgggtcgtggggaacctagtttccacttcctacaccatcacgcacgcctgcaggctagaagtntggtggactaggtttattacgtgtccagactaactattattactttcttacgtctacgtttcggcggtagggaaccgtaaggtggaagattaaccgaaacgtaacgtgtacggctagacctacctatccgttagtccttcgtacc

SEQ ID NO: 63768 - DNA, 586 bp, Homo sapiens
  misc_feature: GYAE6OF01BPXEB.31.78.H01.1.454.CMB.1.raw
  modified_base (443)..(443): a, c, t, g, unknown or other
  misc_feature (443)..(443): n is a, c, g, or t
  modified_base (577)..(577): a, c, t, g, unknown or other
  misc_feature (577)..(577): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagacgggccaccatcaactgcaagtcccagccagagttgttttattcggaccccacaataacaactacttagcttggtaccagcagaaagtaggacagccctctaaactcctagactttactgggccttctacccgggctacgttcccggggttaccctaaaccgtattccagttggcctaggcgggtctggggacctatttccgaacttctcacctatacagcaagccctgcaggctagaaacgntgtggctagttatactgtcagccaatattatactttcgtttccgtctacgttttcggcgggtacggtaccgaaggtaggacgtaatacgtaaaacgtaacttggtacgggtactgaccactacgtctacggttnttcctaccg

SEQ ID NO: 63769 - DNA, 568 bp, Homo sapiens
  misc_feature: GYAE6OF01BSC9A.31.78.H01.1.454.CMB.1.raw
  modified_base (334)..(334): a, c, t, g, unknown or other
  misc_feature (334)..(334): n is a, c, g, or t
  modified_base (351)..(351): a, c, t, g, unknown or other
  misc_feature (351)..(351): n is a, c, g, or t
  modified_base (372)..(372): a, c, t, g, unknown or other
  misc_feature (372)..(372): n is a, c, g, or t
  modified_base (382)..(382): a, c, t, g, unknown or other
  misc_feature (382)..(382): n is a, c, g, or t
  modified_base (401)..(401): a, c, t, g, unknown or other
  misc_feature (401)..(401): n is a, c, g, or t
  modified_base (449)..(449): a, c, t, g, unknown or other
  misc_feature (449)..(449): n is a, c, g, or t
  modified_base (470)..(470): a, c, t, g, unknown or other
  misc_feature (470)..(470): n is a, c, g, or t
  modified_base (555)..(555): a, c, t, g, unknown or other
  misc_feature (555)..(555): n is a, c, g, or t
  modified_base (563)..(563): a, c, t, g, unknown or other
  misc_feature (563)..(563): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagacctccctggctgtgtctcgtgggcgaggacgggcccaaccatcaactgacaagtccagccagtagttgttttattccggaccccaaccaaataaacaacctacttagcttggtaaccagacaagaaagtagacagcctacctaaactctagatttacgnggtcttccgacccgggnaacgtccgggttaccaacgtnttcagttggnagggcggtctagggacctntttacactctcaacatcagcacgcctagcaggcagaagagtggtaggntaagtttatactgtcaagtanaactattaatactttcgttacgtctaacgtttcggacggacggaacgaaggtggagtacaacgaaacgactgtggcctagcacancttgtctntaacc

SEQ ID NO: 63770 - DNA, 767 bp, Homo sapiens
  misc_feature: GYAE6OF01EQ2N0.31.78.H01.1.454.CMB.1.raw
  modified_base (369)..(369): a, c, t, g, unknown or other
  misc_feature (369)..(369): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagttccagactccctggctgtgtctcgtgggcgagagggccaccatcaactgcaagtccagccagagttgttttattcggccccaactaataacaactacttagcttaggtaccagcaagaaagtaggacagccctacctaaactcctagtatttacgtgggtcttccgtacccgggctacgttcccggggtttacctaaaccgtnttacgagtttcggcgtaggtccggggtcgtacgggggacccgtagttttccgaaccgttcctaccaacccgtaagttccaaggtccacggtacccttcggaccgtacgggtaccgttaacggaaagtacgttgggtacggtaccgtttaaacggtttttactttaacccgttggtaccaaacggttaccctaaatttaacgttttaacgtttaacctttcccgttttaccggtttaccgttaaccggttttccggggaaccggggtaacggggtaacccgtaaggggttacgggtaaagtaacgttaacccgaaaaccgggtaacgttcgggttacgggaccgttacggacccgtaaccgttacgttacccgtttacggttccctttaccgttacccg

SEQ ID NO: 63771 - DNA, 903 bp, Homo sapiens
  misc_feature: GYAE6OF01CEEU2.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtcgccgtacggggacagtcgtgatgagcctagtttccagacctcccgtggctgtcgtctcgtgggcgaggacggccacatcaactgacaacgtccagccagtagtttgttttactcggaccccaacaataacaacgttacttagcttaggtacagacaagaaagtagacacgccctactaaactcctagtattacgtcggtcctttccgaccggctacggttcccgggttacctaaccgatttcgagttcggactacgggtccggggtctacggggtaacccgttactttaccgaccgttacctacccaacctagtaccaccgggtacgaaccggtcccgttaggacccggaacgggttaccgtaagggtaaacggttacggttacggggttacggtaacgttttaaacggtttttaaacgttaaccgttacggttaacccgtaaacgggttaaccttaaaaacccgtttactttttaaaaccgttttacccgttttttaccccggtttttaacccggtttaacccggtttaaacccggggtttttacccgggggaaacccggggtaaaccgggggttaaaccccggttaaaaagggggggtttaccgggtaaaacggtttaaaaccgttaaaaccccgggtaaaaaacccggtttaacgggtttaccggggtttacccgggaacccgtttacccggaaaccccggttaccggttaacctttacccggttttacccggttacccttaccccggttttaacccccgg

SEQ ID NO: 63772 - DNA, 687 bp, Homo sapiens
  misc_feature: GYAE6OF01AZH3Y.31.78.H01.1.454.CMB.1.raw
  modified_base (376)..(376): a, c, t, g, unknown or other
  misc_feature (376)..(376): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggcccacatcaactgcaagtccagccagagttgttttattcggacccccaacaaataaccaactacttagcttggtaaccagacaagaaagtaggacacgccctacctaaactcctagtactttacgtgggtccttccgtacccgggctacgttcccggggttaccctaaccgtnttcagttcggcaggtcgggtcgtcgggaccgtatttccacttcctacacctatcgagcacgcctgccgtaggctaggaacgtatggtacggcttagtttacttacgtacgtctacgactaaactaactttaacttaccgttttaccgtttaccgttaccgtttaaccggtttccgggaccgggtaacgggtaaccggtaagggtacggtaaacggtaacgttaaaccggaaaaccggttacgtacgggttacggtaccgttacggaaccctaacccgttacgttaccgttcgttccgttacgttaaccccg

SEQ ID NO: 63773 - DNA, 859 bp, Homo sapiens
  misc_feature: GYAE6OF01D0WD7.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagacctcccgtggctgtgtctcgtgggcgaggacggccacatcaactgacaacgtccagccgtagtagtttgttttacgttccggaccccaactaaattaacctaacttacttacgtccttacggaaccagacaaaggaaagtacggacacgtaccctacctaactctagtactttacgtcgggtaccttaccggtacccgggtactaccgggttaccccggggtttacctaaaccggtactttaccgtacggtttacggaccgtaacggggtccggggttacggtacggggtaacccgttacttttcccgaacctttccgtaaccctaaccctacttacggacgaccgtaaccgtcccgtacggaccgtacgggtcgttaaaggaaacggtcggttcgggttaacggttaaccgtttaacgtttttaaccgttacgttacggttaaccgtaacggtaaccttaaaactttacttttaacctttaccgttttccgtttacccggttaccgtttaccgggtttaccggggaaccggggttaacgggtaaccggttaaggggttacgggaaaacgttaaccgttaaaccgggtaaaaccggttacggttacgggtaccggtaccgttaaccggtaacccttaacccggttacgttttacccgttacgtttacccgttaaccgttacccg

SEQ ID NO: 63774 - DNA, 704 bp, Homo sapiens
  misc_feature: GYAE6OF01A7RZV.31.78.H01.1.454.CMB.1.raw
  modified_base (264)..(264): a, c, t, g, unknown or other
  misc_feature (264)..(264): n is a, c, g, or t
  modified_base (363)..(363): a, c, t, g, unknown or other
  misc_feature (363)..(363): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagacggccaccatcaactgcaagtccagccagagttgtttattcggccccaacaatacaactactancttgtacagcaagaaagtaggacacgacctacctaaactcctagtactttacgcggtcttccgtacccgggctacgttcccggggttacctaaccggtnttacagtttcggccgaggtccgggtcgtcggggaccgtacttcacctcgtaccaccacgtcaacgcgacgccctggccaacgggtctaaggaaacggtacgttggtacggtacgtttaaggttttacttaacgtcggtacgtaacgtacctaaacgttacttaactttaacctttccgttttaccgtaccgtttaaaccggtttccgggaaccggggttaccgggtaaaccggtaacggggtacggtaaacgtaacgttaaacccgaaaaccggttaaccgttagggtccgtaccgttacgacccgtaacctagttccctacggttcccttacgtaacccg

SEQ ID NO: 63775 - DNA, 756 bp, Homo sapiens
  misc_feature: GYAE6OF01B7G7F.31.78.H01.1.454.CMB.1.raw
  modified_base (322)..(322): a, c, t, g, unknown or other
  misc_feature (322)..(322): n is a, c, g, or t
  modified_base (341)..(341): a, c, t, g, unknown or other
  misc_feature (341)..(341): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagttccagacctccctggctgtgtctcgtgggcgagacgggccaccatcaactgacaagtccagccagagttgttttatcggccccaacaataaccaactactagcttaggacagacaagaaagtacggacagcctacctaactcctagactttcgngggtccttccgacccgggntacggttccccgggttacctaacgtcttacaacgtttcggacgtacggtcgggtacgtacggggaccttacgtttccgacgttaccctaccacctacgtacgaacggacctaaccggtcccgttaggaccgtaacgggtaccgtaagggtaaacgtacggttacgggtacgggtacctttaagggtttttaacttaccgtacgttacgaacgtaactaaacttaagtttaacctttaacccgtttttaccgtttacccggttaccgtaacccggttttaccggggaaccggggtaacgggtaacccggtaaggggtcggaaacgtaacgttaaacccgaaaccggttaaggtcggttacggtcccgtaacggaccctaaccgtacgttcttccggtttacccttcgttacccccg

SEQ ID NO: 63776 - DNA, 576 bp, Homo sapiens
  misc_feature: GYAE6OF01CUZIL.31.78.H01.1.454.CMB.1.raw
  modified_base (319)..(319): a, c, t, g, unknown or other
  misc_feature (319)..(319): n is a, c, g, or t
  modified_base (364)..(364): a, c, t, g, unknown or other
  misc_feature (364)..(364): n is a, c, g, or t
  modified_base (456)..(456): a, c, t, g, unknown or other
  misc_feature (456)..(456): n is a, c, g, or t
  modified_base (524)..(524): a, c, t, g, unknown or other
  misc_feature (524)..(524): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaacgtccagccagagttgttttattcggccccacaataacaactactagcttggtaccagcagaaagtaggacagcctacctaaactcctagtactttacgngggtcctttcgtaccccgggctacgttcccggggttacctaacgnttcagttggcaggcgggtctgggacctacttcactctcacatcagcacgcctgcaggctagaagagtggtgtctagtttattactgtacganactaactatttacttaactttctttacgtactacgtttcgggacggtacggaaccgtaggtggagtanacgaaacgtagtggtcgtcgtacgctaacctacttctgttcccttgtacccg

SEQ ID NO: 63777 - DNA, 629 bp, Homo sapiens
  misc_feature: GYAE6OF01BHXCG.31.78.H01.1.454.CMB.1.raw
  modified_base (320)..(320): a, c, t, g, unknown or other
  misc_feature (320)..(320): n is a, c, g, or t
  modified_base (363)..(363): a, c, t, g, unknown or other
  misc_feature (363)..(363): n is a, c, g, or t
  modified_base (493)..(493): a, c, t, g, unknown or other
  misc_feature (493)..(493): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagttccagactccctggctgtgtctcgtgggcgagacgggccaccatcaactgacaagtccagccagagttgtttatcggaccccacaataacaactactagcttggtaccagacaagaaagtaggacacgtccctactaaactctagactttacgnggtccttccgtacccggctacgttcccggggttacctaaccgntttccgaagttcggacgtagggtcgggtcgtagggacccgtatttccgactctccaacctatacccaaggtcccacgtcccgtagccgtaacggtcgtaggaacgagtcggtgacttagtttactacgtncagtctaactattactactttcgttcgtacttaccgtttcgggaccgggtaacggtaccgaaggtcggagtaacgtaaccgaaaggtacgtaggtcggaccgtagaccctactacttccgtctccgttctaacccg

SEQ ID NO: 63778 - DNA, 592 bp, Homo sapiens
  misc_feature: GYAE6OF01CABJK.31.78.H01.1.454.CMB.1.raw
  modified_base (322)..(322): a, c, t, g, unknown or other
  misc_feature (322)..(322): n is a, c, g, or t
  modified_base (431)..(431): a, c, t, g, unknown or other
  misc_feature (431)..(431): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctcgtgggcgagagggccaccatcaactgcaagtccagccagagttgttttattcggccccaacaaataacaactacttagcttggtaccagcaagaaagtaggacagccctacctaaactcctgtatttacgnggtcttccgacccgggctacgtccgggttacctaaccgtattcagttggacaggtcgggtcgtcgggacctatttcactctcaccatcagcagcctgcaggctagaagntgtaggtcttaagtttattacgtgtcacgtacaactagtttaatacctttcgtttcgttactacgtttcgggacggtaacgggacctaagggtgaacgtataccgaaaacggtaccttgggtgccgttacgactacctagttcttacgttcttacgtaccg

SEQ ID NO: 63779 - DNA, 653 bp, Homo sapiens
  misc_feature: GYAE6OF01CX9ZQ.31.78.H01.1.454.CMB.1.raw
  modified_base (593)..(593): a, c, t, g, unknown or other
  misc_feature (593)..(593): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagaggccaccatcaactgcaagtccagccagagttgttttattcggccccaacaaataactaactaacttagcttacggtaccagcaagaaagtaggacagacctacctaaactcctgtactttacgtcgggtctttaccgtacccgggctaacggtcccggggttaccctaaaccgtacttcgtaattcgggacctagggtccggggtcgttacgggggaacccttagtttcaaccgttccacctacctatccgagccacgtcctggaccgagggacctagaaacgtagttcggtggtacttaggtttattacgtggtacaagtactaaactatttactactttctttacgtacttacgttcgggacggtagggtacctaagggtacggagtaanaacgaaacgtacgtaggtcggtcctaggactaaccctattacctcgttccttacgtaccc

SEQ ID NO: 63780 - DNA, 672 bp, Homo sapiens
  misc_feature: GYAE6OF01BE006.31.78.H01.1.454.CMB.1.raw
  modified_base (165)..(165): a, c, t, g, unknown or other
  misc_feature (165)..(165): n is a, c, g, or t
  modified_base (391)..(391): a, c, t, g, unknown or other
  misc_feature (391)..(391): n is a, c, g, or t
  modified_base (401)..(401): a, c, t, g, unknown or other
  misc_feature (401)..(401): n is a, c, g, or t
  modified_base (643)..(643): a, c, t, g, unknown or other
  misc_feature (643)..(643): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacacgtgatgtagccncgttctacgactcctcgtgtgtgtctctggtcggacgacgggccaccatcactagcgaacgtccgacgccgagtagttgttttagttcggtaccccaacctaaataaactaacgtaactttacgcttacggtaccacgacaaggaaagtaaggacgacgcctacctaaactcctctattacgtggcttcgtaccggcgatccgggttccctaactatctattgcgngtacgggtcnggtaccgtattcactctcgacactcgacgctacggtctgacgacggtcgtaggtaagaacgttgttacggcttaacgtttagtttacgtcgtaccacggtaacctaataacctttaatttcctttaccgtttttccggaccttaccggttttaccgggtaggggaacccgggtaagaccgggttaggtaacggtactaaaccggaaaccgtaacgttcgggtacgcctacgacctaaccgtntaccggttgtacccttcgtaccgttcccg

SEQ ID NO: 63781 - DNA, 719 bp, Homo sapiens
  misc_feature: GYAE6OF01CHJPV.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagactccctggctgtgtctcgtgggcgagacgggccaccatcaactgacaagtccagccagagttgtttattcgcccacaataacaactacttagcttaggtaccagacaagaagtaggacacgcctacctaaactcctgtacttacgtgggtccttaccgtacccgggctacggtccccggggtttacctaaaccggtacttcgtaagtttcggacacgggtccggggtcgtacgggggtaccctagttttccgaaccttcctacgaaccctacgttccaacggcgacgcccttggaccgtagggcttaggaagtagttggtacgggtcttaaggtttttagtaccgtacgtacaacggtactaaacgttattttaacgttaaccttttccgttttaccgtaccgtttaaccggttttccggggaacgggtaaccgggtaaaccgtaacggggttggtaaacggtaacgttaaccgaaaaccggttagttacgggtcggacccgttgacccgtaaccgtattccgttacgttcccgttacttacccg

SEQ ID NO: 63782 - DNA, 573 bp, Homo sapiens
  misc_feature: GYAE6OF01DC18R.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcgaactgcaagtccagccagagtgttttattcggccccaccaataacaactaacttagcttggtaccagacaagaaagtaggacacgcctacctaaaactctagtatttactgggccttcgtacccgggctaacgtccggggttaccctaaaccgacttcaattggactaggcgggtcgtgggaccgtattcactctacaccatcagcagcctgacaggctagaagatggtcgctagtttatactgtcagacaactattaatactttcttacgtctacgtttcggacggtagggaaccagggtagacgtatacgaaacgtaactggtcggaccttggacctaaccattcctgtccttcgtaccc

SEQ ID NO: 63783 - DNA, 596 bp, Homo sapiens
  misc_feature: GYAE6OF01B8XL1.31.78.H01.1.454.CMB.1.raw
  modified_base (460)..(460): a, c, t, g, unknown or other
  misc_feature (460)..(460): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagacgggccaccatcaactgcaagtccagccagagttgttttattcggccccacaataacaactacttagcttggtaccagcaagaaagtaggacacgcctacctaaacctcctagtactttacgtgggtcttccgtaccccgggtctacgttcccggggttaccctaaaccggtattaccgagttcggccaggtccggggtccgtcggggacccgtatttccacttcctaccaccatcagcacgcccgtgcaggctagaagngtgtggactagttttatacgtgtacagcaactattatactttcttcgtctacgtttcggacggtagggtaccgtaagggtggagaacgtacgaaacggtactggtcggctagacctactagttctcgttctcgtac

SEQ ID NO: 63784 - DNA, 647 bp, Homo sapiens
  misc_feature: GYAE6OF01B2R6R.31.78.H01.1.454.CMB.1.raw
  modified_base (386)..(386): a, c, t, g, unknown or other
  misc_feature (386)..(386): n is a, c, g, or t
  modified_base (475)..(475): a, c, t, g, unknown or other
  misc_feature (475)..(475): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagacctccctggctgtgtctcgtgggcgaggacggccaccatcaactgcaagtccagccagtagttgttttattcggacccctaacaataacaacttacttagcgttgtaaccagacaagaaagtggaacacgccctacctaaacctcctagtactttacgtcgggtccttaccgtacccgggctacggttacccggggttaccctaaaccgtnttacgtaagttcggacacggtcggggttcgtcgggtaccctatttccactcctacacctatccagcgacgcctgacacgcgtacgaagngtggtgtactagtttatacgtgtacgacgtactaactattacgttacctttcgttaccgttacgttaccggtttacgggacgggtacggtaccggtaagggtaggacgtacgtaacgaaacgtacgtggtcgtacgtacgtacctaccgttacgtactcgttcctcgtaccg

SEQ ID NO: 63785 - DNA, 597 bp, Homo sapiens
  misc_feature: GYAE6OF01ELAKH.31.78.H01.1.454.CMB.1.raw
  modified_base (368)..(368): a, c, t, g, unknown or other
  misc_feature (368)..(368): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggattctctggtgcctacgggggtacatcgtgattggagccagtttccagactcctggctgtgtctcgtgggcggagacgggccaccatcaactgcaagtccagccagagtgttttattcggccccactaataacaactacttagcttggtaccagcaagaaagtggacacgacctacctaaacgtcctagtactttacgtgggtcttcgtaccgggctacgttccggggttacctaacgnttcagttcggctaggcgggttcgtagggtacctagtttcactctccaacatcacgcacgtcctgacgaggctagaagtatggtacgactagtttatacgtgtacagtactaactattactacttcgtttcgtacttacgtttcggacggtacggaacgaagggtaggacgtaatacgaaacggtataggtcggtacctagactacgtacttcgtacgttcctcgtaccg

SEQ ID NO: 63786 - DNA, 613 bp, Homo sapiens
  misc_feature: GYAE6OF01CQIFE.31.78.H01.1.454.CMB.1.raw
  modified_base (325)..(325): a, c, t, g, unknown or other
  misc_feature (325)..(325): n is a, c, g, or t
  modified_base (434)..(434): a, c, t, g, unknown or other
  misc_feature (434)..(434): n is a, c, g, or t
  modified_base (447)..(447): a, c, t, g, unknown or other
  misc_feature (447)..(447): n is a, c, g, or t
tcagcagtagacgtcacgaccggtgctcgatttagtgtgagtagtttgggtttgggggagctacaacaggcaggcagggggcagcaagatggtgttgcagacccaggtcttcatttctctgttgctctggatctctggtgcctacggggacatcgtgatgagccagtttccagacctccctggctgtgtctcgtgggcgaggacgggccaccatcaactgcaagtccagccagtagttgttttattcggcccccaacaataacaactactagcttgtaccagacaagaaagtaggacacgcctacctaaactcctgtatttacgnggtcttaccgtacccgggctacggtcccggggttacctaaccgtattcagttcggacgaggccgggtcgtcgggaccgtattcacctcctacacctatcacgcacgccngcgaggcagaagntggtcgctaagtttactacgtgtacagactaactatttactaccgtttctttccgtcttacgtttccgggacggtacgggaaccgtagggtacggaaacgtacgtaaccgaaacggtagtcggtcggaccgtcgacctaacctacttcgtcgttccgttctacccg

SEQ ID NO: 63787 - DNA, 699 bp, Homo sapiens
  misc_feature: GYAE6OF01DJSAV.31.78.H01.1.454.CMB.1.raw
  modified_base (378)..(378): a, c, t, g, unknown or other
  misc_feature (378)..(378): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagttccagacctccctggctgtgtctcgtgggcgaggacgggcccacatcaacgtgacaagtccagccagtagttgttttatccggccccaactaaataacaactactagcttacgtacagacaagaaagtaggacacgtcctacctaaactctagtacttacgtggtaccttccgtacccgggtctacgttcccggggttaccctaaaccgtnttacgtagttcggacgtagggtccgggtacgtacgggaccgtactttcactcctaccgtaacctataccgacgaccacgtcccgtagccgtaggtcgtaaggaaacgagttggtacgtacgttaagttttacgttacgtacgtcaacgtactaaaccgttatttaacctttacctttcgttttaccgtaccgtttaaccggtttccgggaacgggtacgggtaacccgtaaggggtggaacgtaacgtaaccggtaaaacgtacggttagggtcggtaccgtcgtacctaaccgtagttccgttacgttcttccgtacccg

SEQ ID NO: 63788 - DNA, 685 bp, Homo sapiens
  misc_feature: GYAE6OF01A7WFU.31.78.H01.1.454.CMB.1.raw
  modified_base (376)..(376): a, c, t, g, unknown or other
  misc_feature (376)..(376): n is a, c, g, or t
  modified_base (626)..(626): a, c, t, g, unknown or other
  misc_feature (626)..(626): n is a, c, g, or t
tcagcagtagacgtcacgaccggtgctcgatttagtgtgagtagtttgggtttgggggagctacaacaggcaggcaggggcagcaagatggtgttgcagacccaggtcttcattttctctgttgctctggatctctggtgcctacggggacatcgtgatgagccagtttccagactccctggctgtgtctctgggcgagaggccaccatcaactgcaagtccagccagagttgttttattggcccccacaataaccaactacttagcttggtaccagcagaaagtaggacagccctacctaaactccctagacttttacgtgggtcctttcgtaccccggggctaacgttcccgggggtttccctaaaccccggtnttttacccgagtttcgggccaacgggtccgggggttcttcggggggtaaccccgtaatttttccgaactttccgtacccaaccctaattccgaacggtccgaacggtcccttggaccgaagggccttaggaaagtacgtggtacgggcctaaggttttacttacgtgttacacgtacctaactatttaattaccgtttctttacgttacttaccgttttacggacgggtacgggaaccgtaaggtcgganacgttaccgaaacgtactggttcggacttgacctacctacttctcgttccttacgtacc

SEQ ID NO: 63789 - DNA, 829 bp, Homo sapiens
  misc_feature: GYAE6OF01C8CIS.31.78.H01.1.454.CMB.1.raw
  modified_base (200)..(200): a, c, t, g, unknown or other
  misc_feature (200)..(200): n is a, c, g, or t
  modified_base (320)..(320): a, c, t, g, unknown or other
  misc_feature (320)..(320): n is a, c, g, or t
  modified_base (336)..(336): a, c, t, g, unknown or other
  misc_feature (336)..(336): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcaggnggccacatcaactgacaacgtcagccagagttgttttagttcggaccccaacaataacaactacgttagcttaggtaccagctaagaagtaggacagtccctactaactctatattacgnggtcttccgaccggtntacgttccgggtacctaacgtcttcgtagttcggcgtacgcgggttacgtcgggtacctacgtttaccacgtccgtacctaaccgtacgttaccgaacggtccgtaaccggtcccgttacggcccgggtaaacgggtccctaaagggtaaacggtaccggttacgggtttaccgggtaacccggtttaaagggttttttacggttaaaacccccgtttgggttaacccgtaacgggttaacccttaaaaccgggtttaacgtttttaaaccttttaaccccgtttttacccggtttttacccggtttaccgttaaacccgggttttttaccggggaaccggggttaaccgggttaaaccgtaacggggttacgggtaaacgtaaacccggttaaacgaaaaacccggggttacggttacggtcgggttaccgttaccgggaacccgttaacccgtacgttacccggttcgttttaaccccgtcgtttaccccg

SEQ ID NO: 63790 - DNA, 622 bp, Homo sapiens
  misc_feature: GYAE6OF01BFK7N.31.78.H01.1.454.CMB.1.raw
  modified_base (326)..(326): a, c, t, g, unknown or other
  misc_feature (326)..(326): n is a, c, g, or t
  modified_base (463)..(463): a, c, t, g, unknown or other
  misc_feature (463)..(463): n is a, c, g, or t
  modified_base (467)..(467): a, c, t, g, unknown or other
  misc_feature (467)..(467): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagtttccagactccctggctgtgtctcgtgggcgaggacgggccaccatcaactgcaagtccagccagtagttgttttattcggccccaacaataacaactacttagcttggtaccagcaagaaagtaggacacgcctacctaaactcctagtactttacgngggtccttccgtacccgggctacgttccccggggttacctaaccgtattacagtttcggccacggcggggttctcggggacccgtactttccgacttcctaccgaccctatcacgcacgcctgcgaggtctagaagntggnggtctagtttatctgtcagtacaactattacttactttcgtttacgtacgttaccgtttcgggacgggtacggtaacgtaagggtcggaagaacgtaccgaaaacggtacgttggtcggtctacggacctactacttcgtcgttcttccgtaccg

SEQ ID NO: 63791 - DNA, 766 bp, Homo sapiens
  misc_feature: GYAE6OF01DO9BG.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagttgttttattcggccccacaaataacaactacttagcttcgtaccagcaagaaagtagacacgcctacctaaactcctgtactttacgtgggccttccgtacccgggctaccggtcccggggttaccctaaaccgtagttctaattcgggcagggtcgggtccgtacggggtaccgtaacgttttcaaccgttcttaccgaacccacttaccgacgtaccgaacggtcccctggaccgtaacggtaccttagggaaagtagttacgggttacgggtaccttttaagggttttacgtttaccgttagttaccgaaacggtaccctaaacgttacgttttaaacctttaccttttaaccggtttttccgttaccgttaccggtttttccggggaaccggggtacggggtaaacccggtaaaggggttacggtaacggtaaccgtaaacccgtaaaaacgggtaaacccgttgggttaacggcccgttacgacccggtaacccttaagttcccttacggttccctttccgttaacccg

SEQ ID NO: 63792 - DNA, 536 bp, Homo sapiens
  misc_feature: GYAE6OF01B80GR.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcaagaaagtaggacagcctcctaaactcctgatttactgggccttcgtacccgggctacgtccggggttcctaaccgattcattggcagcgggtctgggacctattcactctacacatcagcagcctgcaggctagaagatggtggctagtttatactgtcagacaatattactactttctttacgtctacgtttcggacggtacggaactagggtggagtagtacgaaacgtactggtggctagcaccatctgtcttgtac

SEQ ID NO: 63793 - DNA, 553 bp, Homo sapiens
  misc_feature: GYAE6OF01CCO7R.31.78.H01.1.454.CMB.1.raw
  modified_base (390)..(390): a, c, t, g, unknown or other
  misc_feature (390)..(390): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagttgttttattcggccccacaataacaactacttagcttggtaccagcaagaaagtaggacagcctacctaaactcctgtactttacgtgggtcttcgtacccgggctacgtcccggggttacctaaccggtattcattggcagcgggtctcgggacctntttcactctcacatcagcacgcctgcagctagaagatgtaggctagtttatacgtgtcagacaactattacttacttcttcgtactacgtttcggacggacgggaccgtaagggtggaagtatacgaaacgtactggtcggctggccacatcgtcgtcttgac

SEQ ID NO: 63794 - DNA, 649 bp, Homo sapiens
  misc_feature: GYAE6OF01BQOK0.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagtttccagactccctggctgtgtctcgtgggcgaggacgggcccaccatcaactgacaagtccagccagtagttgttttattcggaccccaacaataacaactacttagtcttaggtaccagcaagaaagtagacagcctacctaaactcctgtatttacgtgggtcttccgtacccgggctacggttccccggggttaccctaaccggtattccagttcggcgtacggccggggttcgtacggggaccgtactttccacctcctaccacctacgtccagccacgcctgcgaggctagaagtgtggtggacttaagttttactacgtgtaccaagacctaaacttatttaactttacctttccgtttaccgttacttaccggtttccgggacgggacgggtaaccggtaagggtacggaagtaagtaaccgaaacgtacgtacggtcggactcggacctacctacttactcgttcctcgtaccg

SEQ ID NO: 63795 - DNA, 752 bp, Homo sapiens
  misc_feature: GYAE6OF01DRALY.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcattttctctgttgctctggatctctggtgcctacggggacatcgtagatgagcctagttccagacctcctggctgtgtctcgtgggcgaggacggccaccatcaactgacaagtccagccagtgttgtttttacgttccggacccccaactaaataaacctaacttaacttagtccgttacggtaccaagacaaggtaaagtaggacacgtaccctaccttaaacctccttagttactttacggtcggtaccgttccggtacccgggacttaccggttacccggggttaccctaaccgtattcctagttcggactagggtccgggttcggtacggggtaaccttatttaccaaacgttcctaccacctacgtaccgtaacggtcccgacgtacccgtacggaccgtacggtaccgtaagtaacggtacgttacgggtacggttacgtttaacgttttaacgtttacgtacgttacgacgtaacctaatttaactttaacttttaccgtttaccgttttccgttacgttaccggtttacgggacgggtaacgggtaaccgaagggttacggaagtacgtaacgaaaccgtagtcggtacgtacgtcggtacctacgtactttaccgcgttccttactacccg

SEQ ID NO: 63796 - DNA, 580 bp, Homo sapiens
  misc_feature: GYAE6OF01A36CW.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagtagttgttttattcggccccaacaataacaacttacttagcttggtaccagcaagaaagtaggacagccctacctaaactcctgtactttacgtgggtccttccgtacccgggctacgttcccgggggttacctaaaccgtattccaagtttcggcctagggccgggtcgtggggacctatttccactcctacaccatcgagcacgcctgcgaggctagaagagtggtaggtctagtttatactgtacagactaactattatacttcttcgtactacgttcggacggtacggacgtaaggtgagactacgaaacgtacgtggtcggctcgacacctattctcgtctcgtac

SEQ ID NO: 63797 - DNA, 665 bp, Homo sapiens
  misc_feature: GYAE6OF01EKQ72.31.78.H01.1.454.CMB.1.raw
  modified_base (358)..(358): a, c, t, g, unknown or other
  misc_feature (358)..(358): n is a, c, g, or t
  modified_base (439)..(439): a, c, t, g, unknown or other
  misc_feature (439)..(439): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagtacctcccgtggctgtgtctcgtgggcgagacggcccaccatcaactgacaacgtccagccagtagttgttttattcggaccccaacaataacaactacttagtcttagtaccagacaagaaagtaggacacgtaccctacctaaactcctagtactttacgtcgggtccttccgacccgggtntaccgttcccgggttaccctaaaccgtacttcagttcggaccgtagggtccgggtacgtcgggaccttatttccacttccncacctatcgacgcacgtcctagccgaggctagaagtgtggtggacttagttttacttacgtcgtacagtacctaactatttaacttacttttccgttcgttacttaccggtttcgggacgggtaacggtacgtaaggggtagtaacgtaacttaaccgaaaacgtagttcggtacggtccgtacgacccgtaccgtagttaccgttacgtttcttacccgtacccg

SEQ ID NO: 63798 - DNA, 724 bp, Homo sapiens
  misc_feature: GYAE6OF01CYFD2.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagactccctggctgtgtctcgtgggcgaggacgggccacatcaactgacaacgtccagccaaggtagttgttttaatccggaccccaacaaataacaactacttagcttaggtaccagacaagaaagtcggacacgccctacctaaactcctagtactttacgtggtccttaccgtacccgggctacggttcccggggttacctaaaccggtacttacgaacgtttcggaccgtaacgggtccgggtcgttacggggaacccgttaacgttttccaaccttccgtacccaaccgtaagttacccgaacggtccaaccggtccttacggaccgtacgggtccgtaagggtaaacgtgttacgggtacggtaccttaagggttttaacttaccgtagtaccgaagtacctaaagttactttaacttaccgttttcgttaccgtacttaccggtttcgggaaccgggtacggtaaccggtaaggtcggaagaacttaccggaaacgtacgttgcggtactacggactacctattacgttacgtccttacgtacccg

SEQ ID NO: 63799 - DNA, 701 bp, Homo sapiens
  misc_feature: GYAE6OF01CBWLZ.31.78.H01.1.454.CMB.1.raw
  modified_base (676)..(676): a, c, t, g, unknown or other
  misc_feature (676)..(676): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagacctcccgtggctgtgtctcgtgggcgagagggccaccatcaactgcaagtccagccagagttgttttattcggccccaacaataacaactacttagcttaggtaccagcaagaaagtagacagcctacctaaactcctgtattacgtggtccttccgtacccgggctacggttcccggggtttaccctaaccggtacttcgtagtttcggcgtagggtccggggttccgtacgggtaacccgtagttttccaacgttcctaccaacccgtactaccgaacgtccacggtcccttggacgtacggcgtaggaaagtacgttggtcggaccttagttttaacttacttcggtactaacggtacctaaacgttatttaacctttacctttccgttttccgttaccgttaccggttttccgggaccgggtaacgggtaacccgtaaggggtaggaacgtaacgtaaccgaaaacggtacgttaggtcggtactacggcctaacgtnttaccgttcgttccttacgtacccg

SEQ ID NO: 63800 - DNA, 574 bp, Homo sapiens
  misc_feature: GYAE6OF01DGGPP.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctcgtgggcgagacggccaccatcaactgcaagtccagccagagttgttttatcggccccacaataacactacttagcttgtaccagcaagaaagtaggacacgcctacctaaactcctagtattacgtcgggtccttccgtacccgggactacgttcccggggttacctaaccgattcagttcggacacggtcgggtcgtcgggaccgtattcgactctcactatcagcagctgcagctagaatagtgtggactagtttactacgtgtacacgacaactattacttacttcttacgtctacgtttcggagggtacgacgagggtagagtatacgaaacgacgttggtcgactcgacctaaccgtaacttcttgtcttcgtacccg

SEQ ID NO: 63801 - DNA, 795 bp, Homo sapiens
  misc_feature: GYAE6OF01CG5OF.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgacgcctagttccagacctcccgtggctgtgtctcgtgggcgaggacggccaaccactacaacgtgacaacgtccagccgaagtagtttgttttacgtccggacccctaacaaactaaactaacttaacttacgcttacggaaccagacaagaagtaggacacgcctacctaactctagtattacgtggtcttccgaccgggtctacggttcccgggttacctaacgtcttacacgttcggacgacgggtcgggtacgtacggggtaaccgttacttaccgtaccctcgtacctaacctacgtccgacggcctacggtcccgtacgacgtacgggtacctaaggaaacgttacgtacggttacggtaccgtttaaacgttttaccgttaacgttacggtaacgaacgtaaccttaaacgtttagttttaaccttttaacccgttttacccgtttaccgttaccgggttttaaccggtttaccggggggtaaccggggtaaacggggtaacccggtaaaggggttaacggtaaacggtaaaccgtaaaccgtaaaaccgggttagttacgggttaccggtaccgttaccgtacccttaacgttaacttccgttaaccgttccttccgttaaacccgg

SEQ ID NO: 63802 - DNA, 565 bp, Homo sapiens
  misc_feature: GYAE6OF01BDO4Z.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacaactacttagcttggtaccagcagaaagtaggacagcctcctaaactcctgatttactgggcttcgtacccgggctagtccggggttacctaaccgattcagttggcaggcgggtctgggaccgtatttcgactctcaccatcagcagcctgcaggctagaagatggtggctagtttatactgtcagcaactattatactttctttacgtctaccgtttcggacgggaggtaaccgtaagggtggaacgtactaccgaaaacgtaacgtcggtcggacgtcgacctaccattaccgtcgttcttcgtaccg

SEQ ID NO: 63803 - DNA, 655 bp, Homo sapiens
  misc_feature: GYAE6OF01C9S5E.31.78.H01.1.454.CMB.1.raw
  modified_base (369)..(369): a, c, t, g, unknown or other
  misc_feature (369)..(369): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagacgggccaccatcaactgacaagtccagccagagttgttttacttcggccccacaataaaccaactacttagcttggtaccagcaagaaagtaggacagcctacctaaactcctagtatttacgtgggtccttccgtacccgggctacgttcccgggttacctaaccgtnttcagttggaccaggcgggtctcgggacctattcactctacacctatccagcacgcctgcgacggtctagaagtagtggtcggacttagttttaattactagtcagactaacgtatttaacttactttcctttacgtacctacgttttccgggaccgggtacgggtaaccgtaagggttcggaacggtaacttaaccggtaaaaaccgtaacggttacgggttcgggtacccgttacgacccgtaacccgtaacgtttcccgttacgttccgtttacccgtaaccg

SEQ ID NO: 63804 - DNA, 564 bp, Homo sapiens
  misc_feature: GYAE6OF01CGJ53.31.78.H01.1.454.CMB.1.raw
  modified_base (433)..(433): a, c, t, g, unknown or other
  misc_feature (433)..(433): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggccccacaataacaactacttagcttggtaccagcagaaagtaggacagcctcctaaactcctgtatttactgggcttcgtaccccgggcacgttcccgggggttacctaaccggtattcattggcaggcggggtcgtcggggaccgtatttccactcctcaccatcagcagcctgcaggctagaagatgngctagtttattacgtgtcagcaactattactactttcttcgtctacgtttcggacggtaggaccgtagggtgacgtagtaccaaaacggtacgtggtcggctgcctaacctatccgttgtccttcgtaacc

SEQ ID NO: 63805 - DNA, 644 bp, Homo sapiens
  misc_feature: GYAE6OF01BJ7QO.31.78.H01.1.454.CMB.1.raw
  modified_base (235)..(235): a, c, t, g, unknown or other
  misc_feature (235)..(235): n is a, c, g, or t
  modified_base (252)..(252): a, c, t, g, unknown or other
  misc_feature (252)..(252): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcggtgatgacgcctagtttccagacctccctggctgtgtctcgtgggcgagagggccaccatcaactgcaagtccagccagnttgtttatcgccccaanaataaccaactacttagcttaggtaccagcaagaaagtaggacagcctacctaaactcctagtactttacgtggtccttccgtacccggctacgttccccgggttacctaaaccgtattcgagttcggaccgtaggtcggggtctacggggaccctatttccgaccttcctaccaaccgatcgagccacgtcctcgcgacggctaggaacgtagttcggtggtacgttagtttaacgttacgtcggtacacgtactaacttactttacttacctttctttcgtaccttacggtttacggacggtaacgggaccgtaagggtacggtacgtaagtaaccgaaacggtacgtggtcgcgtacggacctaccgtacttcttcgttccttcgtacc

SEQ ID NO: 63806 - DNA, 572 bp, Homo sapiens
  misc_feature: GYAE6OF01CV3L3.31.78.H01.1.454.CMB.1.raw
  modified_base (326)..(326): a, c, t, g, unknown or other
  misc_feature (326)..(326): n is a, c, g, or t
  modified_base (368)..(368): a, c, t, g, unknown or other
  misc_feature (368)..(368): n is a, c, g, or t
  modified_base (413)..(413): a, c, t, g, unknown or other
  misc_feature (413)..(413): n is a, c, g, or t
  modified_base (417)..(417): a, c, t, g, unknown or other
  misc_feature (417)..(417): n is a, c, g, or t
  modified_base (546)..(546): a, c, t, g, unknown or other
  misc_feature (546)..(546): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagtttccagactccctggctgtgtctcgtgggcgaggcgggccaccatcaactgcaagtccagccagagttgttttattcggccccacaaataacaacttacttagcttaggtaccagacaagaaagtaggacagccctacctaaacctctagtatttacgngggtccttcgtacccgggctacgttccgggttcctaaccgtnttaccagttggcaggtcggtctcgggacctattccactctacacntcancacgcctgcaggctagaagagttggtacgtacttagtttattacgtgtacagactaactatttaactactttcgtttacgtcttacgttcgggacggaggtaccaagggtgaatataccaaacgatggngtctagcctacctatcctatctctac

SEQ ID NO: 63807 - DNA, 667 bp, Homo sapiens
  misc_feature: GYAE6OF01DGYUV.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatcctgtggtcgccgtacggggacagtcgtgatggagcctagtttccagacctcccgtggctgtgtctcgtgggacgaggacggccaccatcaactgacaacgtccagccagtagttgtttacgtccggaccccaacaaataacaactacttagcgttaggtaccagacaagaaagtagacacgtcctacctaaactcgtagtacttacgtggtaccttaccgaccggctacggttcccgggttacccaaacgtacttcagttcggacgtacggtcgggtcgtacgggaacctcttcacctcgtaccactactcgacgtcacgcctgaccgaggactagtaaagagttcggtacgtacttagtttaactacgtacgtacaacgaactaacttaactttaacttaccgtttacgtttacgtaccttacgggtttccgggaacgggtacggaaaccgtaagggtacggagtaaacgtacgtaaaaacgtgttacggtcgacgtacgaaccctacgtacttccttcgttcctcttaacccg

SEQ ID NO: 63808 - DNA, 545 bp, Homo sapiens
  misc_feature: GYAE6OF01B6TXB.31.78.H01.1.454.CMB.1.raw
  modified_base (390)..(390): a, c, t, g, unknown or other
  misc_feature (390)..(390): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacaactacttagcttggtaccagcagaaagtaggacagcctcctaaactcctgatttactgggcttctacccgggcagtccggggttcctaaccgattcattggcaggcgggtctgggaccgtatttcactctcaccntcagcagcctgcaggctgaagatgtggctagtttattactgtcagcaactattatacttctttcgtctacgtttcggcggtaggaccgtaagggtaggagtataccgaaacggtaactggttcggcttgacctacctattctgttccttcgtacc

SEQ ID NO: 63809 - DNA, 598 bp, Homo sapiens
  misc_feature: GYAE6OF01CE20F.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagttgttttattcggccccacaataacaactacttagcttggtaccagcaagaaagtaggacagcctacctaaactcctgtactttacgtgggtcttccgtacccgggctacgttcccggggttaccctaaccgtacttcacgtttggcgtaggcgggtcgtcggggacctatttcactctaccaccatcacgcacgcctgcaggctagaagagtgtggtactagtttacttacgtgtacagactaactattacttactttctttcgtccttacgtttcggacggtacgggtaccgtaagggtggagtaactaccgaaacggtacgtcggtggacttcgacctacctactccgttcgttcttcgtaccg

SEQ ID NO: 63810 - DNA, 738 bp, Homo sapiens
  misc_feature: GYAE6OF01C5TK3.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctcgtgggcgagagggccaccatacaactcgacaagtccagccagtagttgttttattcggaccccaacaaactaacaacttactagcttacggtaaccagacaagaaagtaggaacacgacctacctaaactcctagtactttacgtgggcctttaccgtacccgggactacggtcccggggtttaccctaaaccgtacttccaagtttcgggacctaacgggtccggggttcgtacgggggtaacccgttacttttccgaaccgttccctacccaacctaactacgacgtaccgaacgtccctaggaccgtagggtcctaagaaacggtatacgggttacggtacttaagggtttttaacttacgtcggttaccagtaaccgtaactaagttttaactaccttttcctttacggtaccttaacggtttccggggaacgggtaacggtaaccgttaagggtacggtaacgtaagtaaccggtaaaaacggtacgttaggtcgggtaccttgaccctaccgtatttaccggtacttccgttactaacccg

SEQ ID NO: 63811 - DNA, 562 bp, Homo sapiens
  misc_feature: GYAE6OF01DIHMG.31.78.H01.1.454.CMB.1.raw
  modified_base (315)..(315): a, c, t, g, unknown or other
  misc_feature (315)..(315): n is a, c, g, or t
  modified_base (350)..(350): a, c, t, g, unknown or other
  misc_feature (350)..(350): n is a, c, g, or t
  modified_base (432)..(432): a, c, t, g, unknown or other
  misc_feature (432)..(432): n is a, c, g, or t
  modified_base (443)..(443): a, c, t, g, unknown or other
  misc_feature (443)..(443): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaaagtccagccagagtgttttattcggccccacaataacaactacttagcttggtaaccagcaagaaagtaggacagcctactaaactcctgatttacngggcttcgacccgggcacgtccgggttccaaccgnttcattcggcagcgggtctgggacctattcactctcacatcagcacgcctgacagctagaagatgtgactagtttattacgngtcagcaactnttaatcttactttcgtactacgtttcggacggtacgggtaaccaagggtacggacgtaactacgaaaacgtacgttggtcggacgtcgactaccgtaatccgttacgtccttcgtaccg

SEQ ID NO: 63812 - DNA, 598 bp, Homo sapiens
  misc_feature: GYAE6OF01BOTIF.31.78.H01.1.454.CMB.1.raw
  modified_base (461)..(461): a, c, t, g, unknown or other
  misc_feature (461)..(461): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctcgtgggcgagagggccaccatcaactgcaagtccagccagagttgttttattcggaccccacaataacaactacttagcttggtaccagacaagaaagtaggacacgcctacctaaactcctagtatttacgtggtccttaccgtacccgggctaacggttcccggggttacctaaccgtattccagtttcggcgtaggtccggggttacgtacggggaacccgtatttccacttcctcaccatcagcacgcctgcgaggtctaggaagtntggtgacttagtttattactgtacagacaatattactctttacttcgtactacgttcggacgggacggaccgtaggtcggataagacctaaacgtagtggtcggctagtaccactacgttactcgttctcgtacccg

SEQ ID NO: 63813 - DNA, 589 bp, Homo sapiens
  misc_feature: GYAE6OF01ENQ9B.31.78.H01.1.454.CMB.1.raw
  modified_base (341)..(341): a, c, t, g, unknown or other
  misc_feature (341)..(341): n is a, c, g, or t
  modified_base (367)..(367): a, c, t, g, unknown or other
  misc_feature (367)..(367): n is a, c, g, or t
  modified_base (440)..(440): a, c, t, g, unknown or other
  misc_feature (440)..(440): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagttgttttattcggccccacaataacaactacttagcttaggtaccagcaagaaagtaggacagccctactaaactcctagtactttacgtgggtccttccgtacccgggntacgttcccgggttaccctaaccgtnttcagttggcaggtcgggtctcgggacctatttccactctcaccatcagcagccctgcaggctagaagatggngactagtttatacgtgtcagacaatatttactactttcttcgtcttacgtttcgggacggtagggaccgtaagggtggaacgtacgttaacgaaacggtattggtacggtctacggaccctacctattccgttcgttccttcgtacccg

SEQ ID NO: 63814 - DNA, 967 bp, Homo sapiens
  misc_feature: GYAE6OF01BKYQ7.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagtttccagtacctccctggctgtcgtctcgtgggacgaggtacgggcccaacctatacctaaaccgttggacctaaaacggttccccgaaacggtccccgtaaagggttacggttttacggtttttttaaaccgttttcccggggaacccccccctaaaaccgtaaaaacttaaaaccctaaaacccgtttaaccgttttaaacggtcccgttttaacggggtaaaccccaaaggtacctaaagggtaaaaacgggttacgggaaacctaccggtaccccttacccttaaaaaccgttcccgttagttaacgttttaccgtcggggttaccctttacccggtaaccccggggtactacggtttaccccgggggtttacccttaaacccggtatttaccgtaacgtttcgggaccgtagggtcccggggttcgtacggggtacccgttagttttccacgtttccgtacctaacccgtataccgacggtacctaccggtacccgttcggaccgtaacggggttaccttaagggaaacggtacgttacgggttaccgggtacgtttaacggtttttaacgttaacgttacggttaccctaaggttaaccttaaaccgttaacgttttccgtttaacccgttttcgttttcccggtaccgtttaaccggtttaccggggtaacgggtacgggtaacccgtaaggggttacggtaacgtaacgttaaccgtaaaccggttagttcgggtacggttaccgacgtacccgtaaccgttacgttaccgtttcgttaccgttcttaacccg

SEQ ID NO: 63815 - DNA, 755 bp, Homo sapiens
  misc_feature: GYAE6OF01AYQRX.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgacaagtccagccagtagttgttttattcggaccccaacaataacaactacttagtcttagtaccagacaagaaagtaggacacgcctacctaaactcctagtactttacgtcggtcttccgtacccgggctacgttcccggggttaccctaaaccggtacttaccgagttcggacgtacgggtccggggtaccgttacggggacccgttattttccaccgttcctaccgaaccctataccgagaccacgtcccgtacggacgacgggtctaggaacgtagttggtacggtacctaagttttacttacgttcgtacgacgtacctaaactaagttttaacttaccgtttcgttttacccgtacgtttaccggtttaccggggaccgggtaacggggtaacccggtaaaggggttacgggaaacggtaaccgttaaaccggtaaaacccggttaacggttacgggttacgggtacccgttacggaacccctaacccggtttacttacccgtttacggtttacccgtttacccgttaacccg

SEQ ID NO: 63816 - DNA, 595 bp, Homo sapiens
  misc_feature: GYAE6OF01ESUO9.31.78.H01.1.454.CMB.1.raw
  modified_base (479)..(479): a, c, t, g, unknown or other
  misc_feature (479)..(479): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctcgtgggcgaggacgggccacatcaactgcaagtccagccagagttgttttattcggccccacaataacaactactagtcttaggtaccagcaagaaagtaggacaagtccctacctaaactcctagtactttacgtcgggtccttccgtacccgggcacggttcccggggttacctaaccgtattcagttggcaggcgggtcgtgggacctattcactctcaccatcagcacgtcctggcaggctagaagagtggtggacttagttttactacgtgtacagactaactntttactactttacctttcgtacttacggttcgggacgggtaacgggtactaaggggtcgaagtaactacgaaacgtagtggtcggactgacctaaccattcgtacgttctccgtac

SEQ ID NO: 63817 - DNA, 831 bp, Homo sapiens
  misc_feature: GYAE6OF01AYK2A.31.78.H01.1.454.CMB.1.raw
  modified_base (323)..(323): a, c, t, g, unknown or other
  misc_feature (323)..(323): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagacctccctggctgtgtctctgggcgaggacggccaccatcaactgcaagtccagccagagttgttttattcggccccaacaataacaactattagcttggaccagcaagaaagtaggacacgcctacctaaactcctagtattttacgngggtctttccgtacccgggctacggttcccggggttacctaaaccgtatttcacgtttcggaccgtagggtccggggttcctacggggtaacccgtattttacccgaaccttccctacctaacccctaattacccgaaggcccgtaacggtccccttaggaccgtaacggggtaccgttaacggaaaagggtacgtacgggttacgggaccgtttaaagggttttttaaccgttaaccgttcggttaaccgtaaacggtaaccctaaaactttaacttttaacgtttaaccctttttacccggttttacccggttacccgtttaaccggttttacccgggggaaccgggggttaaacgggtaacccggttaaagggggttacgggtaaacgtaaacgttaaacccggaaaaaccggttaacggttcggggttacgggtacccgttaaccggtaacccgtaaacccgttacgtttacccgtttacgttaccccgttttacgtaaccccg

SEQ ID NO: 63818 - DNA, 793 bp, Homo sapiens
  misc_feature: GYAE6OF01EDDA1.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacgggacatcgtgatgagcctagttccagacctccctggctgtgtctcgtgggcgagacggccaccatcaactgacaagtccagccagtagttagttttacttcggaccccaactaaactaaccaactacttagtccttacggtaaccagacaagaaagtacggacacgtacctacctaaactccgtagtactttacgtcgggtccttaccggacccggtctaacggttcccggggttacctaaccggtacttccgaagtttcggcctagggtcccggggttacgtcggggtaacccgttagttttccgaccttccgtacctaaccaagttaccaacggtccaccgtcccgtacggaccgtacggtaccgtaagtaaagtacgtcgggttacgggttaaccttaacggtttttacttaaccgttcgtaaccgtaacggtaaccttaaacgttaacttttaactttaaccgtttttaccgtttccgtttaaccgttaccggttttacccggggaaccggggtaaccggtaaccggtaaagggtacgggtaaacgtaaacgttaaccggtaaaaccgtacggttacggtacgggacccgttacgacccgttaaccctacgttcgttaccgtttaccgttcccgttaacccgg

SEQ ID NO: 63819 - DNA, 669 bp, Homo sapiens
  misc_feature: GYAE6OF01BW9HJ.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagttgttttattcggccccacaataacaactacttagcttggtaccagcaagaaagtaggacagccctacctaaactcctagtatttacgtgggtccttccgtaccccgggctacgttcccggggtttacctaaccgtattacagttcggacctaggccggggtcgtacggggacccgtatttccacttcctccaccactcacgccgagcccgtgacgacggacgtagaaagtatggtacggtacttagttttacttacgtgttacacgtactaaacttattaacttacctttcctttacgtacttaccgtttccggggacggtaacgggtaaccgtaaggggtacggtaagtaacgtaaccggaaaaccggtaacgttgggtaccggtccgtacggacccgtaacccgtacttaccgttcggttcccttcgttaacccg

SEQ ID NO: 63820 - DNA, 597 bp, Homo sapiens
  misc_feature: GYAE6OF01DIX39.31.78.H01.1.454.CMB.1.raw
  modified_base (294)..(294): a, c, t, g, unknown or other
  misc_feature (294)..(294): n is a, c, g, or t
  modified_base (324)..(324): a, c, t, g, unknown or other
  misc_feature (324)..(324): n is a, c, g, or t
  modified_base (373)..(373): a, c, t, g, unknown or other
  misc_feature (373)..(373): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagttccagactccctggctgtgtctcgtgggcgagacgggcccaccatcaactgcaagtccagccagtagttgttttattcggaccccacaataacaactactagcttggtaccagcaagaaagtaggacncgtccctacctaaacctctagtatttacgngggcctttccgacccgggtctacggttcccggggttaccctaaaccgtnttcgaagttcggcacgggtcgggtcgtggggacccgtatttcgacctctaccgacctatcacgtcacgtcctgactaggctagagtatggtcggactagtttactcgtggtcagtactaatatttaacttaccttcgtttcgtccttcggttcggaccggtagggactaagggtgacgtatacgtaaacgtattggcgatcgactacctagtctgtcttcgtac

SEQ ID NO: 63821 - DNA, 625 bp, Homo sapiens
  misc_feature: GYAE6OF01EKUGJ.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttcctctgttgctctggatctctggtgcctacggggacatcgtgatgagcctagtttccagacctccctggctgtgtctcgtgggcgagacgggcccaccatcaactgacaagtccagccagtagttgttttacttcggcccccaacaataacaactacttagcttcggtaccagacaagaaagtagacacgcctacctaaactcctagtactttacgtgggtccttccgtacccgggctacgttcccggggttacctaaccgtattcagttcggcaggtcgggtctcggggacctattcactccgacaccatcgagtcacgtcctgcgaggctagaagtgtgtggctagtttattacgtgtcacgactaatattacttactttccgttcgttaccttacgtttcggacgggtacgggtaaccgtaagggtacgtaagtaacgttaaccgaaaccgtacgttacggtcggtacctacggacctaccgtattccgtcgttccgttacgtaccg

SEQ ID NO: 63822 - DNA, 711 bp, Homo sapiens
  misc_feature: GYAE6OF01AC2PH.31.78.H01.1.454.CMB.1.raw
  modified_base (322)..(322): a, c, t, g, unknown or other
  misc_feature (322)..(322): n is a, c, g, or t
  modified_base (339)..(339): a, c, t, g, unknown or other
  misc_feature (339)..(339): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctcgtgggcgagacgggccaccatcaactgcaagtccagccagtagttgttttattcggaccccacaataacaactacttagcttaggtaccagcaagaaagtgacagccctacctaaactcctgtatttacgnggtccttcgtacccggnacgtccgggttacctaaccggtattcgagttcggacaggtccgggttctacggggtaccgtatttccgaaccttcctaccgaacctagtccgaagccacggtccctaggaccgaacggtccgtaggaaacgtagttacggtaggtaccgttagtttttacgtgtccttgttaccaagtacctaaactttaatttaacttaccgttttccgttttacgtcccgtttaaccgttttccggggaagggtaaccgggtaaacccgaagggggtttacggaaacgtaaccgttaaaccgtaaaaccgggtaacgttcgggttaccgaccgttacgaccccgtaaccttaacgttcccgttcgttttcccttaacccg

SEQ ID NO: 63823 - DNA, 835 bp, Homo sapiens
  misc_feature: GYAE6OF01ECA5H.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctcgtggtgcctacggggacatcgtgatgagccagtttccagtacctccctggctgtgtctcgtgggcgagagggccacatcaactgacaacgtccagccagtagttgttttacttcggaccccaactaaataaccaactacttacgtcttcggtaccagacaagaaacgtacggacacgtaccctacctaaactcctagtactttacgtcgggtaccttaccgtacccgggctaccgttacccggggttacctaaccggtacttaccgagttacggactacgggtccggggtacgtacggggtacccttaatttcccgaccttaccgtaccctaacccgtaacgttaccgaacggtacccgtaacgtaccccggttacggaccgggtaacgggtacggttaaacggtaaacgggtacggttacggggtttaacgggttacggtttaaacgggttttttaaaccgttaaccgggtttacggtaaccggtaacgttaacccgttaaaactttaacgttttaaccctttacccgttttaccgttttacccggttaccgtttaaccggttttccggggaaccgggtaccggggtaacccggtaagggttacgggtaacgtaacgttaacccggaaaccggttacgttacgggtccggtacctacgggaccctaaccgttacgtacgttcgttcccttcgtaaccccg

SEQ ID NO: 63824 - DNA, 565 bp, Homo sapiens
  misc_feature: GYAE6OF01AHTC3.31.78.H01.1.454.CMB.1.raw
  modified_base (391)..(391): a, c, t, g, unknown or other
  misc_feature (391)..(391): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgaggagggccaccatcaactgcaagtccagccagagttgttttattcggccccacaataacaactacttagcttggtaccagcagaaagtaggacagcctacctaaactcctagacttttactgggtcttccgtaccccgggcacgttcccggggttacctaaaccggattcattggcagcgggtctgggaccgtntttcactctacaccatcagcagcctgcaggctagaagatgtgctagtttatactgtacagactaactattactactttctttcgtctacgtttcgggacggtagggtacccgaaggtcggaagtatacgtaaaacgtacgttggtcggactgactaccatactgtcttctaccg

SEQ ID NO: 63825 - DNA, 725 bp, Homo sapiens
  misc_feature: GYAE6OF01C4YL4.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagacctccctggctgtcgtctcgtgggcgaggacgggccaccatacaactgacaacgtccacgccagtagttgttttacttcggaccccaaccaataaaccaactacttagcttaggtaccagacaagaaagtagacacgacctacctaactcctgtacttacgtggtccttacgtaccggctacgttccggggttaccctaaccgtacttcgtacgttcggcgaggtcgggtcgtcgggtacctacttccgactcgtacaccgtatcgacgtcacggtcctacggacgaggcttagaacgtgttacggtcggtacttaaggttttacttaacgtcggttactaacgtaactaacgttaacttttaactttaccgttttaccgtttacccgttacgttaaccggtttacccggggtaacgggtaacccggggtaaaccgttaagggggtaacggtaaagtaccgtaaacgtaaaccgggtaaccgttcgggttacgggtacccgtacgtaccgtaacccgttacgttccgtttacggtcctttcgtaaccccg

SEQ ID NO: 63826 - DNA, 670 bp, Homo sapiens
  misc_feature: GYAE6OF01EN2NF.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagttccagacctccctggctgtgtctcgtgggcgagacgggcccaccatcaactgacaagtccagccagtagttgttttacgttcggaccccctaacaaataaacctaactacttagtcttacggtaccagacaagaaagtagacagtaccctacctaaacttccgtagtactttacgtcgggtaccttccgtacccgggctacgttacccggggttaccctaacggtacttctagttcggacgtacggtcgggtccgtagggtaccctagttccactacctccacctatcgtacgcacgtccgtacggacgtggacgtagaacggtagtggttcggtattaacgttttacgttagtcgtactaacgtactaactatttacttacctttcgtttaccgtacttacgttcggacggtacgggtaacctaagggtcgaagacgtaacgaaacggtacgttcggtcggtcctaggaccctaacgtacttacgtcttccttactaccccg

SEQ ID NO: 63827 - DNA, 706 bp, Homo sapiens
  misc_feature: GYAE6OF01BTEV2.31.78.H01.1.454.CMB.1.raw
  modified_base (377)..(377): a, c, t, g, unknown or other
  misc_feature (377)..(377): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtcgtctcgtgggcgaggacgggccaccatcaactgacaagtccagccagtgttgttttattccggccccaaccaataacaactacttagcttacggtaccagcaagaaagtaggacagccctacctaaactcctagtactttacgtgggtccttccgacccgggtctacgttcccggggttacctaaccgtnttacctacgttggcgaggtccgggtcgtacggggaccgtagtttccaccttctaccgaccatccgacgtccacgtccctaggcgacggtctagaagtgttggtacggaccttaagttttacttacgtcgttacgacgtaactaactagttttaaccttaccttttacgtttccgttaccgttaccggtttccggggaccgggtaacgggttacgtaaggggtacgggtaactaacggtaaccgtaaaaccgggtaacgtttggtccgggtaccttacggtacccgtaccgttaacgtttccggttacctttccgttacccgttaccccg

SEQ ID NO: 63828 - DNA, 687 bp, Homo sapiens
  misc_feature: GYAE6OF01B2T1R.31.78.H01.1.454.CMB.1.raw
  modified_base (237)..(237): a, c, t, g, unknown or other
  misc_feature (237)..(237): n is a, c, g, or t
  modified_base (350)..(350): a, c, t, g, unknown or other
  misc_feature (350)..(350): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagttccagacctccctggctgtgtctcgtgggcgagacgggccaccatcaactgacagtccagccagtgttntttacgtcgaccccaacaaataacaactactagtcttaggaccagacaagaaagtaggacacgacctacctaaactcctagtacgtttacgtcggtccttaccggacccggtntacggttccccgggttacctaaaccgtacttcgacgttcggacgacgggtccgggtacgtacgggacctatttccgacgttcctaccaccgtactcgacgcctacgtccctaggcgacgggtctaaggaagtagttcggtacggtacgttaagttttacgttactcggtacagtaacctaacttattaacgttactttaccgtttcgttaccgttaccgtttacggggaccgggtacggtaaccggtaagggtacggtaacgtaaacgtaaccgtaaaacggtacgtagggtccggacgttacggaccttaccgacttacgttcgtttctccgtacc

SEQ ID NO: 63829 - DNA, 755 bp, Homo sapiens
  misc_feature: GYAE6OF01D7V8C.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacgggacatcgtgatgagcctagtttccagtacctcccgtggctgtgtctcgtgggcgagaacgggccaccatcaactgacaacgtccgagccagtagttgtttactccggaccccaactaataacaactactacgcttaggaaccagcaaggaaagtacggacacgtccctactaaactccgtagtattacgtcggtcttaccgtacccgggctacgttcccggggttacctaaccgtacttcgtaacgttcggacgtacggtccggggtacgtacggggtaaccccttagttttacccgacttaccgtaccgtaaacccgtacgttccgtaaacgcccgtaacggtccccgttacggaccggaacgggtaccgttaggaaaacgttacggttcggtacgggttaaccttaaggttttaacctttacgtacgttaccgaacgtaaccctaaactttaacgttacctttaaccgtttcgtttaccgtactaccggtttcgggaaccgggtacgggtaaccgtagggtacgtacgtaacgtaaccgtaaacggtacgttggtaccggacgttacggacctaaccgtacgttccgtactttccgtaccttaccg

SEQ ID NO: 63830 - DNA, 791 bp, Homo sapiens
  misc_feature: GYAE6OF01B0V1Z.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtcgccgtacgggacatcgtgatggagcctagtttccagactccctggctgtgtctcgtgggcgaggacggccacatcaactgacaacgtccagccaggtagtttgttttacgttccggaccccaactaactaaactaacttacttacgtcttacggtaccaagcaagaagtaggacagtaccctactaactctagtacttacgtcggtccttccggtacccggctacggttccccgggttacctaaccgtattcgtacgttcggacgacggtcgggtcgtacgggaccgttacttcctacgtacctaccacctaatccgtacgaccgtaccgtaccgtcggaccgacggtcgtaaggtaacgaggttacgggtaggttaccgtttaacgtttttaacgttaaccggttcgtaacccgaagttaaccctaaactttaacgttttacctttaacccgtttttccggttttacccgttaacccgggtttacccgggtttacggggtaaccggggtaaccgggtaacccggttaaggggtacggtaaacgtaaaccgttaaccgggtaaaaccggttaggttacgggttaccggacccgttacggaaaccccttccgttaacgttccgtttaccgtttcccgttaacgtttacccccg

SEQ ID NO: 63831 - DNA, 659 bp, Homo sapiens
  misc_feature: GYAE6OF01ADSZL.31.78.H01.1.454.CMB.1.raw
  modified_base (233)..(233): a, c, t, g, unknown or other
  misc_feature (233)..(233): n is a, c, g, or t
  modified_base (649)..(649): a, c, t, g, unknown or other
  misc_feature (649)..(649): n is a, c, g, or t
tcagcagtagacgtcacgaccggtgctcgatttagtgtgagtagtttgggtttgggggagctacaacaggcaggcagggcagcaagatggtgttgcagacccaggtcttcatttctctgttgctctggatctctggtgcctacggggacatcgtgatgagccagtttccagactccttggctgtgtctcgtgggacagcgggccaccatcaactgcaagtccagccagagttntttatcggcccctacaataacaactacttagcttcggaccagtcaagaaagtacggacagccctacctaaactcctagtactttacgtcgggtcttccgtacccgggctacgttacccggggttcctaacgtacttcgagtttcggcaacggtcgggtacgttcggaccgttatttccgacctttccgacctaccgtataccgacgtaccgacgtccgtaacgccgtacggtctaggaacgtagtcgttacggaacttatttacgtacgttacgtactacgtaactaacgttaacttacgtttaacctttcgtttacccgtagttaccgttacgggccggttaacgggaccgtaagggtacggaacgtaataccggaagtacgttacggtgaccgtgaccctacgtattaccggtnttcgtctacg

SEQ ID NO: 63832 - DNA, 722 bp, Homo sapiens
  misc_feature: GYAE6OF01AFMIM.31.78.H01.1.454.CMB.1.raw
  modified_base (328)..(328): a, c, t, g, unknown or other
  misc_feature (328)..(328): n is a, c, g, or t
  modified_base (348)..(348): a, c, t, g, unknown or other
  misc_feature (348)..(348): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgaggacgggcccaccatcaactgacaagtccagccagagttgttttattcggccccaacaataactaactacttagcttaggtaccagcaagaaagtaggacagccctacctaaacctcctagtatttacgngggtccttccgtacccgggntacgtcccggggttacctaaccgtattccgtagttcggacgtaggtcggggtcgtacggggacccgtatttccgactcctacaaccctattccacgtccaccgtcccgtggaccgaggcctaggaagacgtaggtacggactttaaggttttactacgttggtaccaaggtacctaaacttagttttaacttacttttccgtttaccgttacgttaccggtttacggggaccgggttaacgggtaacccggtaagggtcggtaaacgtaaccgttaaaccggtaaaacccggttaacgttcggggttacggtacccgttacggaaccccttaacccgttacgttaccggtttcgttaccctttcgttaaccccg

SEQ ID NO: 63833 - DNA, 700 bp, Homo sapiens
  misc_feature: GYAE6OF01BVWLI.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgaggacgggcccaccatcaactgacaagtccagccagagttgttttattcggccccacaataacaactacttagcttggtaccagcaagaagtaggacagcctacctaactcctgactttacgtcgggtcttaccgtacccgggctacgttaccccggggttaccctaaccgtactttccgtagttcggaccgaacgggtccggggtccgtacgggggtaaccctaagttttccgaccttcctacccgaaccctattaccgagtaccgaccgtcctacggccgtaacgggtacctaggaaagtacgttagggttaggcgttaaggttttacgttacgttggtaccgtaacgtacgtaaaccttaagtttacttaccttttcgtttaccgttaccgttaccggtttaccgggacgggtaacggtaaccgtaagggtcgtagtaacgtacgaaacgtacgttggtacggactacggacctaaccgtactacgttcgtcttctaccg

SEQ ID NO: 63834 - DNA, 691 bp, Homo sapiens
  misc_feature: GYAE6OF01DBL6L.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagacctccctggctgtgtctcgtgggcgagagggccaccatcaactgacaagtccagccagagttgttttattcggacccaacaataacaactacttagcttaggtacagacagaaagtagaacagaccctacctaaactccgtgtactttacgtgggtcttccgtacccgggctacgtccggggttacctaaccgattcagttcggacgaggtccgggtcgtacggggtacctagtttccgactcctacgacctataccgagtccgacgccctaggtaccacgggacttaaggaaacgtagtacggtacggtacttaacgttttaacgttcgttacggtactaacggaactaacttaagtttaactttacgtttcttttacccgtaccgttacgtttaccggggacgggtaacgggtaacgtaaacgggttggaaacgtaagtaccggtaaaaacgtaccgttgggtacggacctcgtaacccgtaaccgtacttccgttcggttccttaccgttaccg

SEQ ID NO: 63835 - DNA, 660 bp, Homo sapiens
  misc_feature: GYAE6OF01BHICZ.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgaggagggccaccatcaactgacaagtccagccagtagttgttttattcggccccaacaataacaactacttagtctaggtaccagacaagaaagtaggacacgaccctacctaaactcctagtactttacgtggtccttccgtacccgggactacgttcccggggttaccctaaaccggtattaccgagttcggcgtagggtccgggtcgtacgggaccgtatttccgactcctacacctatcagcacgtcctcggcgacggtctagaagactggtgtatagtttatactacgtacagtactaacgttattacttacctttacgtttcttacgtaccgtttcgggacggtacgggtaaccgtaaggggtacggtaacgtacgtaaccgtaaaacgttacggttacggtcgggtaccgtcggacctaaccgtacttaccggttcgttacccgttccgttacccg

SEQ ID NO: 63836 - DNA, 934 bp, Homo sapiens
  misc_feature: GYAE6OF01BZ8XE.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctcgtgggcgagagggccacatcaactgacaagtccagccagagttgttttattcggccccaacaataacaactacttagcttggaccagcaagaagtggacagcctacctaaactcctgtactttacgtgggcctttccgtacccgggctacggttccccgggggtttacctaaacccggtatttaccgaagtttcggaccgtaacgggtcccggggttaccgttacgggggtaaccccgtaagtttttcccgaaaccgtttccgtaccctaaaccccgtaacgttaccgaacggtacccgtaacggtcccccgtttacgggaccccgtaacgggggttaccccttaagggtaaaaccggggtaacgttttaacgggggttacggggttaacccggttttaaaacgggttttttttaacgtttaacccgtttaacgggtttaccgtaaaccgggttaaccttaaaaacccgttagttttttaaaaccctttaacccggttttttacccgtttttacccggttaacccgtttaacccggtttttacccgggggaccggggttaaaccgggggtaaccccggttaaaaggggttccggggtaaaacgttaaccggtttaaacccggtaaaaaaccgggttaaaccgtttcggggtaaccgggttacccgttaaccgggtaccccgttaaaccccgttacggtttaccccgtttacgggtttccccttttaaacccgtttaaccccgg

SEQ ID NO: 63837 - DNA, 676 bp, Homo sapiens
  misc_feature: GYAE6OF01BXPOV.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggcccccacaataacaactacttagcttggtaccagcaagaaagtaggacagccctacctaaactcctagtatttacgtgggtcctttccgtaccccgggctacggttcccggggtttaccctaaaccgtactttcaagttcggccagggtcggggtcgtcggggtacccgtactttcacttctaccaaccataccagaccacgcccgtgcacgggtctacggaagtacgttggtcggtacttaaggttttaacttacgtgtacacgacctaaacgttatttaactttacctttccgttttcgttaccgttaccgttttaccgggaccgggtacgggtaaccgtaagggtacggtaaagtacgtaaccgaaaacggttacttacgggtcggtacctcggaccctaccgtactttaccgttcgttccttcgtaccg

SEQ ID NO: 63838 - DNA, 617 bp, Homo sapiens
  misc_feature: GYAE6OF01ELSXH.31.78.H01.1.454.CMB.1.raw
  modified_base (372)..(372): a, c, t, g, unknown or other
  misc_feature (372)..(372): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagacgggccaccatcaactgcaagtccagccagagttgttttacttcggaccccaacaataacaactacttagcttggtaccagcaagaaagtaggacacgcctaccgtaaactcctagtactttacgtcgggtccttccgacccggctacgttcccggggttacctaaccggtnttcgattcggcaggcgggtctgggactattcactctcaccatcagacacgccgtcgcgtaggctagaagattcggtgacttagtttactacgtagtcaagtacaacttattacttactttcgttccgtactaccgttcggacgggtacggaccgtaagggtacgacgtaactaccggtaaaacggtacgttgggtacggtccgtacgacccgtacttacgtaccgttcgttaccctcgttacccg

SEQ ID NO: 63839 - DNA, 618 bp, Homo sapiens
  misc_feature: GYAE6OF01ANICF.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagttgttttattcggccccacaataacaactacttagcttggtaccagcaagaaagtaggacacgccctacctaaactcctgatttacgtgggtccttccgtacccgggcacgttcccgggggttaccctaaccgtattacctagtttcggccacggtccggggtcgtggggacccgtatttcactctaccaccatcagcagcctgcaggactagaaagtgtacggtactagtttacttacgtgtacagactaactactttattacctttctttccgtaccttaccgtttccgggacgggtaacgggtacgaagggtggagacgtaacgaaacgtacgtggtacggtcgtacgaccgacctacttcgtacgttccttcgtaccttcccg

SEQ ID NO: 63840 - DNA, 708 bp, Homo sapiens
  misc_feature: GYAE6OF01COHMJ.31.78.H01.1.454.CMB.1.raw
  modified_base (416)..(416): a, c, t, g, unknown or other
  misc_feature (416)..(416): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgaggagggccaccatcaactgacaagtccagccagtagttgttttacttcggccccaaccaaataacaaccttacttagcttggtaccagacaagaaagtacggacacgcctacctaactcctagtactttacgtcgggtcctttccgtacccgggctacgttcccggggttaccctaaccgtacttcagttcggcgagggtcgggtcgtcgggaccgtnttccactcctacaccatcacgcagtccctgccgaggcgtaggaagtgtggtacggacgttaagttttactacgtgtacaacgtacctaaacgttaacttttacttaccttttccgttttaccgttaccgttaccggttttacggggacccggggtaacggggtaacccgtaaaggggggttacggtaaacggtaacgttaaacccgtaaaaccgggtacgttacggggttccgggacctaccggtaccctaaccgttacgtttccgttaccgtttacttccccgttaacccg

SEQ ID NO: 63841 - DNA, 739 bp, Homo sapiens
  misc_feature: GYAE6OF01B6E7P.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagttccagacctcccgtggctgtcgtctcgtgggcgaggacgggccaaccatccaactggacaagtccagccaagtagtttgttttacgttccggaccccaactaataaccaaccttacttagcttggtaccagacaagaaagtaggacagccctactaaactcctagtactttcgtggtccttccgacccgggctacggttcccggggttacctaaccgtacttaccgtagttcggaccgaagggtccgggtaccttcggggaacccttatttccgacttccgttaccaaccgtactacgacgtctacgccgtagccgaacggtctaaggtaaacgtagttcggtaggtaccttaaggtttactacgtcgttacacgtactaaacttacgttttaacttaaccgttttcgtttaccgttaccggtttaaccggtttaccggggtaaccgggtaacggggtaaacccgttaagggggtacggtaaccgtaaccgttaaacgtaaaaacccggtacggttggtaccggcttacggaacctaccgttacgttactcggttccttacgttaaccccg

SEQ ID NO: 63842 - DNA, 809 bp, Homo sapiens
  misc_feature: GYAE6OF01B26PY.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagactccctggctgtgtctcgtgggacgagacgggccaccatcaactgacaacgtccagccagtagtttgttttatcggccccaacaataacaacttactagtcttggtaaccagacaagaaagtaggacacgcctacctaaactcctgtaatttacgtcgggtcttccggtacccggctacggttcccggggtttacctaaaccggtacttacgacgtttggacacggtcggggtcgtacgggaccgttacttccgtaactcctaccaaccgtacttaccgaacgccgtaacgtcccgttacggaccgaacgggttacgtacggaaaaggtcgtttacgggtacgggtacctttaaaggtttttaaccgttacgttaggttaaccgtaacggtaaaccttaaactttaagttttaaacctttaccgtttttaccgttttacccgttaccggtttaacccggttttcggggaaccggggttaaacgggtaaccggttaaaggggttaacgggtaaacgttaaaccgtaaaccggtaaaaacgggttaaccggttcggggttacccggtacgttacccggaacccttaacccggttactttacccgggtttactttacccgtttccggttaaaccccg

SEQ ID NO: 63843 - DNA, 688 bp, Homo sapiens
  misc_feature: GYAE6OF01DQMUX.31.78.H01.1.454.CMB.1.raw
  modified_base (425)..(425): a, c, t, g, unknown or other
  misc_feature (425)..(425): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtcgccgtacggggacatcgtagatgagcctagtttccagacctccctggctgtgtctcgtgggacgaggacgggccaccatcaactgacaacgtccagccaggtagttgttttacttcggaccccaaccaaataaaccaaacttactagacttggtaaccaggactaagaaaacgtggaacagccctacgtaaactccgtatactttacgcgggtcttcgacccggatacgtacccgggttaccaacggattcagttggaccaggtccgggtacgtcggggaaacctntttcgacctcgtaccaccgatcgaagtccacgtctacgacgagcgtagaagtacgttggacgtctaagttttaactaccgtagtaccacggtactaaacttaatttactttaaccgtttccgtttaccggttacctacggttttacgggcgggtaaccgggtaaccgaagggttagtaaacgtacgttaaccgaaaacgttaccgtaggtcggtacctacggacctaaccctagttaccttggttacccttccggttaacccg

SEQ ID NO: 63844 - DNA, 607 bp, Homo sapiens
  misc_feature: GYAE6OF01E2UPY.31.78.H01.1.454.CMB.1.raw
  modified_base (595)..(595): a, c, t, g, unknown or other
  misc_feature (595)..(595): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagacgggccaccatcaactgcaagtcccagccagagttgttttattcggcccccacaaataacaactacttagcttggtaccagcaagaaagtaggacacgccctacctaaactcctagtactttacgtgggtcttccgtacccgggctacgttcccggggttaccctaaccgtattacagttggcaggtccggggtctcggggaacccgtattttaccacttcctaccaacctatccaacgccacgcccgtagccaggtcctagaaagtagtggtaggacttagtttacttacgtcgtcaacgtacaaacttatttacttactttctttcgtacttaccgttcggacggtacggaccagggtagagatacgaaacgtagtgtggctgacctctactntcttctcgtacc

SEQ ID NO: 63845 - DNA, 787 bp, Homo sapiens
  misc_feature: GYAE6OF01B4EW9.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgaggacgggccaccatcaactgacaacgtccagaccagtagttgtttattcggccccaacaataacaactacttagtcttagtaaccagacaagaaagtaggacacgcctacctaaactccgtagtactttacgtcgggtcttaccggacccggctacggtcccgggttacctaacgtacttcgagttcggactagggtccgggttacgtacggggtaacccgtattttaccgaccgttccttacccaacctaacgttaccgaacggacctaaccggtcccgttacggacccgtaaggggttcccgtaaacgggtaaacgggtaacgtttccgggtaacgggttaaccgttttaacgggttttttaaaccttaccggtttacggtaaccgtaaaccggtaacttaaaaccgtttactttttaaccttacccgtttttcccgtttacggttacccgtttaaccgggtttcggggaaccgggtaaccggtaaccggttaaggggtccgaaaggtacctaaaccggtaaacgtacgttcgggtacgccgttacgaccctaccgtactttaccgtacgtttcctaccgttacccg

SEQ ID NO: 63846 - DNA, 582 bp, Homo sapiens
  misc_feature: GYAE6OF01DSKDT.31.78.H01.1.454.CMB.1.raw
  modified_base (408)..(408): a, c, t, g, unknown or other
  misc_feature (408)..(408): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctcgtgggcgagagggccaccatcaactgcaagtccagccagagttgttttattcggccccaaccaataacaactacttagcttggtaccagacaagaaagtaggacacgcctacctaaactcctgtatttacgtgggtcttccgtacccgggctacgttccggggttaccctaaccgtattctagttcggcgaggtcgggtcgtgggactattcactcncacatcagcacgcctgcaggctagaagatgtggactagtttactactgtcagactaatattacttacttctttaccgtctacgtttcgggacggtacgggaccgtaaggtggacgtagtacgaaacgtagtggtcgacgtgaccctacgtacttacgttgtcccttcgtacccg

SEQ ID NO: 63847 - DNA, 740 bp, Homo sapiens
  misc_feature: GYAE6OF01AORVF.31.78.H01.1.454.CMB.1.raw
  modified_base (324)..(324): a, c, t, g, unknown or other
  misc_feature (324)..(324): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagtgttttattcggccccacaataacaactacttacgcttacggtaccagaccaggaaagtggaccagtccctacctaaactcctgactttacgngggtccttccgacccgggcacgttcccggggtttaccctaaacgcttccagtttcggcaacgggtccgggtcgtacggggtacctagtttacaccgttacctccgaaccctagttccgaagtcccgacgtccgtcgtaccggacgggtcttacggaaaggtacgttcggtacggtacctttaacggttttatttaaccgtggtaccgtaacggtacttaaacctagttttaaccttaacgttttcccgtttacggttacccgtttaaccggtttaccggggaccggaacggggttaaccctaagggggttcgaaacggttaactaaccggtaaaaccggtaacgggttcggttacgggaccgtttacggaacccggttacctaaccgttgttaaccgtttcctacgtttaccccgg

SEQ ID NO: 63848 - DNA, 697 bp, Homo sapiens
  misc_feature: GYAE6OF01AT9NW.31.78.H01.1.454.CMB.1.raw
  modified_base (455)..(455): a, c, t, g, unknown or other
  misc_feature (455)..(455): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagactccctggctgtgtctcgtgggcgaggacgggccaccatcaactgacaacgtccagccagtagttgttttacgttccggaccccaactaaataacctaacttacttacgtcttcggtaccagacaaggtaaaacgtaggaaccacgacccttacctaaactcctagtacttttaccgtgggtccttaccgtaccccgggctacggttccccggggttacctaaaccgtacttacagttcggcgacgggtcggggtccgtacggggaccgttacttttaccncttaccctccgtaaccctagtaccgacggtactacggcccgtagtccgaagggtctaaggaacgtagttggtcggtacttagttttactactcggacagtaacctaacttatttaactttactttccgttacgtaccttaggtttccgggaaggtaacgggacgtaagggtggaacgtactaacgaaacggtagtacgggtcgcctagacctaccgacttagtcccgtttatcttaaccccg

SEQ ID NO: 63849 - DNA, 608 bp, Homo sapiens
  misc_feature: GYAE6OF01E0NKG.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagtgtttattcggccccaacaataacaactacttagcttggtaccagcaagaaagtaggacagcctacctaaactcctagatttacgtgggtcttaccgtacccgggcacggttcccggggttacctaacccggtattccgattcggcaggcgggttctcgggtacccgtatttcacgttctacaccatcagccagcctgcacggctagaagtacgtgtcggactagtttattacgtacgtcacgtactaactatttacttactttctttacgtccgttacgtttcgggacggtacgggaccgtaagggtggaagtaactaacgaaacggacttaggtcggtctacggccctaacctattccgtcgttccttcgtaccg

SEQ ID NO: 63850 - DNA, 625 bp, Homo sapiens
  misc_feature: GYAE6OF01AHL28.31.78.H01.1.454.CMB.1.raw
  modified_base (366)..(366): a, c, t, g, unknown or other
  misc_feature (366)..(366): n is a, c, g, or t
tcagcagtagacgtcacgaccggtgctcgatttagtgtgagtagtttgggtttggggagctacaacaggcaggcaggggcagcaagatggtgttgcagacccaggtcttcatttctctgttgctctggatctctggtgcctacggggacatcttgatgagccagtttccagactccctggctgtgtctcgtgggcgagagggccaccatcaactgacagtccagccagagttgttttattcggccccaacaataacaactacttagcttgtaccagacagaaagtaggacagccctacctaaactcctagtactttacgtgggtcttaccgtacccgggtctacgttcccgggttacctaaccgtnttcacgttggcctaggcggtcgtagggtacccgatttcgacctctaccgacctatcacgtcacgtcctacgcgaggccttagaagtagtgtcggacttagtttatacgtgtaccgagactaagtactttagtaccctttcgtttaccgtcgttaccgtttccgggacggtacggtaacgtaggtacggagacgttaaccgaaacgtaacgttggtccggtacgtcgaccctaccgtacttccgtcgttcttcgtacccg

SEQ ID NO: 63851 - DNA, 760 bp, Homo sapiens
  misc_feature: GYAE6OF01BNU4F.31.78.H01.1.454.CMB.1.raw
tcagcagtagacgtcacgaccggtgctcgatttagtgtgagtagtttgggtttgggggagctacaacaggcaggcaggggcagcaagatggtgttgcacgacccaggtcttcatttctctgttgctctggatctctggtcgccgtacggggacatcggtgatgacgcctagtttccagacctccctggctgtgtctcgtgggcgagagggccaccatcaactgacaagtccagccagtagttgttttattcggccccacaataacaactacttagcgttggtaccagacaagaaagtacggacacgccctacctaaactcctagtactttacgtcgggtcctttccggtaaccccgggctaccgggtttccccggggttaccctaaaccggtactttacgagtttcgggaccgacggggtccggggttccgtacgggggtaaccccttaatttttccgaacccgtttcctacccgtaacctaccttaccgacggaccgtacggtcccgtggaccgacgggtaccgtaaggaaaggttatcgggtacggtaccgttaagttttacttacgttcgtacgagtactaaacgtactttaactttaccttttcgtttaccgttaccgttaccggtttaccgggaccgggtaacggggtaaccgttaggggtacggtaaacgtaaccgtaaccggtaaaaccgtaggttacgggtcgttaccgtacggaccctaaccttattcccgttacgttcttccgttacccg

SEQ ID NO: 63852 - DNA, 690 bp, Homo sapiens
  misc_feature: GYAE6OF01DDVEE.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagactccctggctgtgtctcgtgggcgaggacgggccacatcaactgacaacgtccagccgagtagtttcgttttattcggaccccaactaaataacctaactacttagtcttaggtaccagacaagaaagtaggacagcctactaactccgtagtacttacgcggtccttacgaccgggctacggttcccggggttacctaaccgtattcgtacgttcggacgaggtccggggtcgtacgggggaacccttactttacctacgtcctacctaacctactaccgaggacctaccggtcctcggaccgacgggctaggaaacggtagtggttacggacttaacggttttattaaccgtgttaccgaagtaactaactaatttacgttacctttctttccgtaccgttaccgtttcggggacggtaacggggaccgttaagggcgtaacgtacgtaaccgtaaacggtacgtaggtcggctacgacgtaacccttagtcgtttcgttccttacgttacccg

SEQ ID NO: 63853 - DNA, 610 bp, Homo sapiens
  misc_feature: GYAE6OF01CZQNS.31.78.H01.1.454.CMB.1.raw
  modified_base (313)..(313): a, c, t, g, unknown or other
  misc_feature (313)..(313): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacgggacatcgtgatgagccagtttccagactccctggctgtgtctctgggcgagagggccaccatcaactgcaagtccagccagagttgtttattcggccccactaataacaactacttagcttggtaccagcagaaagtaggacagcctactaaactcctgtatttacngggtcttacgtacccgggctacgtcccggggtttacctaaccggtattcgaagttcggcaagggtccgggtctcggggaaccgtatttcgactcctaccaccatcagccagccctgcaggctagaagatcggtgactagtttaactactgtacagactaatacgtttatacctttctttacgtactaccgtttcgggcggtaacggaccgtaaaggtcgggacgtaagtaaccgaaaaccggtattacgggtggtaccgttacgaccgtaccaattccgttacgtccttacgtaccc

SEQ ID NO: 63854 - DNA, 701 bp, Homo sapiens
  misc_feature: GYAE6OF01D5P4X.31.78.H01.1.454.CMB.1.raw
  modified_base (683)..(683): a, c, t, g, unknown or other
  misc_feature (683)..(683): n is a, c, g, or t
tcagcagtagacgtcacgaccggtgctcgatttagtgtgagtagtttgggtttgggggagctacaacaggcaggcaggggcagcaagatggtgttacagacccaggtcttcatttctctgttgctctggatctctggtcgccgtacggggacatcgtgatgagcctagttccagactcctggctgtgtctcgtgggcgagcggccacatcaactgcaagtccagccagtagttgttttattcggaccccaacaactaacaactacttagtcttacggaccaagacaagaaagtacgacacgtcctacctaaactcctagtactttacgtggtaccttcgtacccgggctacggttacccgggtacctaaccgtactttcagttcggcgtacgggtcggggttacgtacgggggtaccttacgtttaccaccttcctaccgtaacctactcgaacgccgacgtcccgtaggtcgacgggtctagggaagtagtcggtagtacgttaacgttttacttacgttgtaccgtaacgtacctaacttaacttttacttacccttttctttaccgttaccgtaccggttttaccgggacgggaaccggttaaccggtaaggtcggtaaacgtcgtaaaccggaaacggttacgttacggtacgtccgtacgaccgaacctgttaccttnttaccttcacgttccccg

SEQ ID NO: 63855 - DNA, 614 bp, Homo sapiens
  misc_feature: GYAE6OF01CMCEY.31.78.H01.1.454.CMB.1.raw
  modified_base (327)..(327): a, c, t, g, unknown or other
  misc_feature (327)..(327): n is a, c, g, or t
  modified_base (368)..(368): a, c, t, g, unknown or other
  misc_feature (368)..(368): n is a, c, g, or t
  modified_base (390)..(390): a, c, t, g, unknown or other
  misc_feature (390)..(390): n is a, c, g, or t
  modified_base (471)..(471): a, c, t, g, unknown or other
  misc_feature (471)..(471): n is a, c, g, or t
  modified_base (479)..(479): a, c, t, g, unknown or other
  misc_feature (479)..(479): n is a, c, g, or t
  modified_base (560)..(560): a, c, t, g, unknown or other
  misc_feature (560)..(560): n is a, c, g, or t
tcagcagtagacgtcacgaccggtgctcgatttagtgtgagtagtttgggtttgggggagctacaacaggcaggcagggggcagcaagatggtgttgcagacccaggtcttcatttctctgttgctctggatctctggtgccgtacggggacatcgtgatgagcctagttccagacctccctggctgtgtctcgtgggcgaggacgggcccaaccatacaacgtcgacaacgtcccagccgagtagtttgttttacgttccggaccccctaacaaattaaacctaacttacttaacgtcttacggtaaccagacaagaaagtagacncgacctacctaactctagtagttcgcggtctcgtacccggntacgtccgggttaccaaccgtntcagttcgcgacggcggtcggtacggacgtacttccgtacctctacacctatcacgtcacgtcctcggcaggctagaacgngtagtgtnttagttattctagtcacgactaatatttacgtactttcgttccgttacgtcttcgggacggtacggaaccgtagggtgaanactaacggaaacgtgtggtcggctacgacctacgcttactcgttcttccgtacc

SEQ ID NO: 63856 - DNA, 686 bp, Homo sapiens
  misc_feature: GYAE6OF01BK8NX.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagttccagactccctggctgtgtctcgtgggcgaggacgggccaccatcaactgcaagtccagccagtagttgttttacttcggaccccaacaaataacaactacttagcttaggtaccagacagaaagtaggacacgccctacctaaactcctagtactttacgtcgggtcttccgtacccgggctacgttcccggggttacctaaccgtattctagttggactaggtcgggtcgtcggggtacctatttccacttcctaccgacctagtccgagtccgacgtcccgtagacgtacgggtctaggaagtgtggtacggtacttaagttttacttacgttggtacaacgtacctaacgttatttactttaccttttccgtttaccgttaccgttaccggttttaccgggacggggtaacgggtaacccgtaagggtacggaagtaacgtaaccgtaaacgtaacgttcggtcggacctacggaccctaccgtacgttccgttacgtttcgttccgttaacccg

SEQ ID NO: 63857 - DNA, 730 bp, Homo sapiens
  misc_feature: GYAE6OF01DIOYB.31.78.H01.1.454.CMB.1.raw
  modified_base (412)..(412): a, c, t, g, unknown or other
  misc_feature (412)..(412): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagttccagtacctcccgtggctgtgtctcgtgggcgaggacggccaccatcaactgacaacgtccacgccaggtagtttgttttacttccggacccccaactaaataacctaacttaacttacgtcgttacggtacccagacaaagaaagtacggaccacgtaccctacctaaaccttccgtagtacttttacgtcgggtaccttaccggtacccgggtctacggttcccgggttaccctaaccgtnttcgtagttcggacgtacggcgggttccgtacgggtaccgtactttaccgaccttcctaccaaccgtatccgaacgcgtaccgtcccgtacgccgtacggtctaaggaagtacgtgggttacggtactttaagttttactcgttagtacaacgtactaattatttaacttaccgtttcctttcgtaccgttacggttccgggacgggaacggtaaccgtaagggtacgtacggtaaacgttaaccgaaaacgtacggttggtaccggtaccgtacgaaccccttactacgtttacgtccgttcgtttacctaccccgg

SEQ ID NO: 63858 - DNA, 757 bp, Homo sapiens
  misc_feature: GYAE6OF01C3434.31.78.H01.1.454.CMB.1.raw
  modified_base (182)..(182): a, c, t, g, unknown or other
  misc_feature (182)..(182): n is a, c, g, or t
  modified_base (194)..(194): a, c, t, g, unknown or other
  misc_feature (194)..(194): n is a, c, g, or t
  modified_base (414)..(414): a, c, t, g, unknown or other
  misc_feature (414)..(414): n is a, c, g, or t
  modified_base (457)..(457): a, c, t, g, unknown or other
  misc_feature (457)..(457): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtcgccgtacggggacagtcgtgatgagcctagtttccagctccgnggctgtgtctgngggcgaggacggccacatcaactgacaacgtcagccaggtacgtttgttttaacgtccggaccctaactaaacttaaaccaacttacttaacggctttacggtaaccagaacgaaggaaaggtacgaacacgtaccctaacgtaaactccgtagtacttaccggtcggtcctttaccggtaccggactaccgttccggggttaacctaacggtcttacgngtttcggacgtacggtcgggtcgcgggtactacgttcaccgtntccacctagtccgacgtacgccggtacctagggaccgtaggtaccgtaacggtaaagtacggttaagggtcggttaaccgttttaaagggttttacgtaaccgtttacggtcctaaacggtacctaaaacggtttctttaacgtttaccgtttccgttttaccgtacggttaccggttttcgggaaccgggaacgggttaaccgtaggggtacgacgggttaaaccaacggttaaacggtaccgtgggttcccggacgtacgaaccctacgtactacggtttcgtaccttacgttacccg

SEQ ID NO: 63859 - DNA, 797 bp, Homo sapiens
  misc_feature: GYAE6OF01EJA6S.31.78.H01.1.454.CMB.1.raw
tcagcagtagacgtcacgaccggtgctcgatttagtgtgagtagtttgggtttgggggatctacaacaggcaggcaggggcagcaagatggtgttgcagacccaggtcttcatttctctgttgctctggatctctggtgcctacggggacatcgtgatgagccagtttccagacctcctggctgtgtctcgtgggcgaggacgggccaccatcaactgacaagtccagccaggtagttgttttattcggaccccaacaaataacaacttactagcttaggtaccagacaagaaagtaggacacgcctacctaaactctagtatttacgtcggtccttaccgtacccgggctacggttcccggggttaccctaaaccggtattacgtacgtttcggaccgtacgggtccggggttacgtacggggtaacccgtactttaccgaacctttcctacccaaccctagtaccgacgtccgaacgtcctacggaccgacggtaccgttaggaaacggtagttggtacgggtaccgtttaaggttttaacgtttacgttacgtaccgtaacggaacctaaaccgttaattttaacctttaaccgttttcccgtttttaccggtttacccgttaaaccgggttttccggggtaacccggggttaaccgggggaaacccggttaaaagggggttccgggtaaaacggtacgtttaaaacccggtaaaaccgtaacggttacggtacgggtaccgtacgaaccccgtaaccgttacttaccgttccgtttacttaccgttaaccccg

SEQ ID NO: 63860 - DNA, 777 bp, Homo sapiens
  misc_feature: GYAE6OF01C3SZ2.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagacctccctggctgtgtctcgtgggcgaggacggccaccatacaactgacaagtccagccagagttgtttatcggcccaacaataacactactagcttacggaccagacaaggaaagtacggacacgtaccctacctaaacctccgtgtaactttacggtacgggtcctttaccggtaccccgggctaccggttccccggggtttaccctaaaccggtattaccgtaagttcggacgtacggggtaccggggttccgtacggggaaacccttcgttttaccgaacccgttccttaacccgaaccctaagttacccgaacgtccgtaacggtcccgtaggacccgtaagggtacctaagggtaaacgtaggtcggttacgggtactttaaggttttaaccttacgtcggtaacgacgtaactaaacgttaactttaacgttaccttttaccgtttcgttaaccgttacccggtttcggggaaccgggtaccggggttaaaccgaagggttacgggaaacgtacgtaaaacccggtaaacggtacgttggggacgtaccgttacggaccctaaaccgtcttcggttaaccgttcttacgtaacccg

SEQ ID NO: 63861 - DNA, 603 bp, Homo sapiens
  misc_feature: GYAE6OF01BG7IW.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagtagttgttttattcggccccacaataaccaacttactagcttggtaccagcaagaaagtaggacacgcctacctaaactcctagtactttacgtggctttccgtacccgggctacgtcccggggttacctaaccgtattccagttcggcgaacggtcgggttcgtcggggaacctatttccgactctacaaccatccgagtaccacgccctggacgtagggcctaggaacgtagtggtcggtactaggttttaacttacgtgtacagtacaactattactactttcttcgtactccgtttcgggacggacggacgtaggtgatagtaccaaaggtactggtcgctagacctacgtattacgtctccttcgtaccc

SEQ ID NO: 63862 - DNA, 646 bp, Homo sapiens
  misc_feature: GYAE6OF01BE7ES.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttacatttctctgttgctctggatctctggtgcctacggggacatcgtgatgagccagtttccagactccctggctgtgtctcgtgggcgagagggccaccatcaactgcaagtccagccagagtgttttattcggccccaacaataacaactacttagcttaggtaccagcaagaaagtaggacagccctacctaaactcctagtaactttacgtcgggtcctttccgtaccccgggctaacggttcccggggtttaccctaaaccggtatttcacgtttcggcagggtcgggtcgtacggggaccctatttccgacttctcgaaccatcacgcacgcctgcgtacggctagaagtcgtgtggcttagtttatacgtgtacacgactaactatttaactactttcgtttccgtacttaccggtttcgggaccggtacgggtaacccgtaagggtacggacgtaactaccggaaaacggtaccgttgggtacggaccgtagaccctaacgtacgttcgttcggttcctttcgtacccg

SEQ ID NO: 63863 - DNA, 759 bp, Homo sapiens
  misc_feature: GYAE6OF01C3K7W.31.78.H01.1.454.CMB.1.raw
  modified_base (335)..(335): a, c, t, g, unknown or other
  misc_feature (335)..(335): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagactccctggctgtgtctcgtgggcgagacgggccaccatcaactgcaagtccagccagagttgttttatcggccccaacaataaacactacttagacttcggaaccagaccaagaaaagtaggacacggtccctaccgtaaaactccgtagttactttacgngggtacctttaccggtaccccgggtactacggttaccccggggtttaccctaaaccggtacttacgtaacgtttcgggacctaagggtcccggggtcttacgggggaaccccttatttccgaccgttccctacaacccgtatccgaacgccacgtcccgtggaccgtacggtactaacggtaaagtacgttaggtcggtacgttaacgtttttaacgttactcggtacctaacggacctaaaccgttacttttaaacgttccttttaacccgttttccgttaccgtttaaccggtttccggggtaacgggtacggggtaaacccgtaaaggggtacggtaaacgtacgtaaaccggtaaaccgtaacgttcggtacggctacggacctaccgaacgtttccgtacgttccgttaccgtaacccg

SEQ ID NO: 63864 - DNA, 702 bp, Homo sapiens
  misc_feature: GYAE6OF01DYL4M.31.78.H01.1.454.CMB.1.raw
  modified_base (461)..(461): a, c, t, g, unknown or other
  misc_feature (461)..(461): n is a, c, g, or t
  modified_base (490)..(490): a, c, t, g, unknown or other
  misc_feature (490)..(490): n is a, c, g, or t
tcagcagtagacgtcacgaccggtgctcgatttagtgtgagtagtttggggtttggggggagctacaacaggcaggcaggggcagcaagatggtgttgcagacccaggtcttcatttctctgttgctctggatctctggtgcctacggggacatcgtgatgagcctagtttccagacctccctggctgtgtctcgtgggcgaggacgggccaccatacaactcgacaacgtccagaccagtagtttgttttacgttccggaccccaactaactaacaaacgttactacgtcttacggtaccagacaaaggaaacgtacggacacgtaccctacctaaactcctagtactttacgtcggtaccttccgtacccgggactaccggttcccggggttacctaaccggtacttactagttcggacgacgggtccgggtcgtacgggaccttacttcactcacacntcgacgcgacgctagcgaggtctaggaanggtcggtagtacttagttacttacgtgtacgagtaactaagttactttcttaaccttttccgtttaccgttacgttaccgggtttacgggaacggggtacggtaaccggtaaggggtcgggtaaataaaccgttaacggtaaaaccgtgggttacggtcggaccgttaacggaccctaacggtctttaccggttcttccgttacgtaccccg

SEQ ID NO: 63865 - DNA, 593 bp, Homo sapiens
  misc_feature: GYAE6OF01AW4MU.31.78.H01.1.454.CMB.1.raw
  modified_base (339)..(339): a, c, t, g, unknown or other
  misc_feature (339)..(339): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtcctctgggcgagacgggccaccatcaactgacaagtccagccagagttgttttacttcggacccccaacaaataactaactactttagcttaggtaccagtcaaggtaaagtagggacaggtccctaccgtaaactccgtagacttttacgngggtaccttccgtacccgggctacgttcccggggttacctaaaccggtcttactacgttcggctaacggcggggttctacggggtacccgtatttccaacgttctacgacctagtcagccagcctgcagtctagagatgtgactagttatactgtcagacactagttacttcttactttcgtactcgttcggacgtacggactagggtgatacacgtaacacgtggtcgcgtagctacattctcttctctaccg

SEQ ID NO: 63866 - DNA, 642 bp, Homo sapiens
  misc_feature: GYAE6OF01BXDM8.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgaggacgggccaccatcaactgcaagtccagccagtagttgtttattcggaccccaacaataaccaactacttagcttaggtaccagcaagaagtagacagcctacctaactcctagtactttacgtcggtccttccgtacccgggctacggttcccggggttaccctaaccgtattctaagttcggacacggtccgggtcgtcggggacctatttccactctacaccatcagccacgcctagccgaggctaggaagtagtgtaggaccttaagtttacttacgtagtccagtactaaacttatttaacttactttccgtttcgtaccttaccgtttcgggacggtacggaaccgtaagggtcggaaacgtacgtaacgtaaaccggtagttcggtcggacctacggaccctaacctacgttaccttacggttccttcgtaacccg

SEQ ID NO: 63867 - DNA, 686 bp, Homo sapiens
  misc_feature: GYAE6OF01BR4L1.31.78.H01.1.454.CMB.1.raw
  modified_base (454)..(454): a, c, t, g, unknown or other
  misc_feature (454)..(454): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagaggccacatcaactgacaacgtccagccagtagttgttttacttcggaccccaactaaataaccaacttacttagacctttggtaacccaggctaaggaaagtaggacacgccctacctaaacctccgtagtactttacgtcgggtccttccggtacccgggctacggttcccggggttacctaaccgtacttcagttcggcacggtcgggtctggggaccctagtttcactctcacgtatcagccagcctgacnggctaggaagtcgtggtacgtacgtagtttactacgttagacgtacgtacctaattagttacttaccttcttacgttaccgttacgtttacgggaccggtaacggtaacccggtaagggtacggaacgtaacgtaccggtaaaaccggtacgttacgggtaccggtacccgttacggtacccccgttaaacgtaccgtttacccgttacgtttcccgttaccgttaccccgg

SEQ ID NO: 63868 - DNA, 630 bp, Homo sapiens
  misc_feature: GYAE6OF01DGQ06.31.78.H01.1.454.CMB.1.raw
  modified_base (334)..(334): a, c, t, g, unknown or other
  misc_feature (334)..(334): n is a, c, g, or t
  modified_base (381)..(381): a, c, t, g, unknown or other
  misc_feature (381)..(381): n is a, c, g, or t
  modified_base (444)..(444): a, c, t, g, unknown or other
  misc_feature (444)..(444): n is a, c, g, or t
  modified_base (482)..(482): a, c, t, g, unknown or other
  misc_feature (482)..(482): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactcccgtggctgtgtctcgtgggcgaggacgggcccaaccataccaactgacaagtccagccagtagttgttttattcggaccccacaaataacaacttaacttagcttaggtaccagacaagaaagtaggacacgacctactaaactctagtatttacgngggtccttcgacccgggctacggttcccggggttacctaaacccgtnttccagttggccaggcgggtcgtacgggaccgtacttcacgtctaccactatcagcacgtccngcgagctagaagagtgcgactagtttaatacgtgtacngacaactagttacttactttctttacgtacgttacgttcgggaccggaggaacccgaagggttacggaagtacgttaaccgaaaaacgtacgttcggtacgtaccgtcgaccgtaacctaagttccgttacggttccttctaaccccg

SEQ ID NO: 63869 - DNA, 662 bp, Homo sapiens
  misc_feature: GYAE6OF01CLA3F.31.78.H01.1.454.CMB.1.raw
  modified_base (321)..(321): a, c, t, g, unknown or other
  misc_feature (321)..(321): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagtagttgttttattcggccccacaataacaactacttagcttaggtaccagcaagaaagtaggacacgcctacctaaactcctgtatttaccgngggtccttaccgtacccgggctacggttccccggggttacctaaccgtacttactagttcggacacgggtcggggtcgtcggggtacccgtatttccaccttctaccgtaccatccagcacgcctgcgaggcgtagaagtagtggtggtctaagttttatacgtgtacagtaccaactatttacttactttcctttccgttcttaccgtttccgggacgggtacggtaacccgtaagggtacggaacggtaacgtaaccgtaaaaaccggtacgttcgggttacggtacgttaccggaccctaaaccgtactttaccgttcgtttacccgttcgtaacccg

SEQ ID NO: 63870 - DNA, 816 bp, Homo sapiens
  misc_feature: GYAE6OF01BDMXM.31.78.H01.1.454.CMB.1.raw
  modified_base (370)..(370): a, c, t, g, unknown or other
  misc_feature (370)..(370): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctcgtgggtgccgttacggggacatcggtgatgaagtcctagtttccagactcccgtggctgtgtctcgtgggcgagcggccacatcgaactgcaagtccagccagtacgttgttttacgttcggaccccaactaataacctaactacttagtcttaggtaccagtcgaagtaaacggtaggacaggccctaacctaaactccgtgtacgtttacgtcggtaccttaccgtaacccggntacggttccggggttaccaaacgtagttacaaggtttcggacacggtcggggttacgtacggggtaccgtacttttaccgacctttaccgtaccgtaacctaacgtacgtaacggtacgtaaccggtacccgttaggaccggtaacggtccgttaaaggtaaacggtacggtttacgggtacgggtaaccgtttaacggtttttaacggtaacgtttacggtacgtaacgaccttaaacgtttaacgtttaactttaacccgtttacgttttaccggttaaccttacgggttttaccgggaaccgggtaacgggtaaccgttaaacggggtggtaaaccggtaacgttaaaccggaaacggtttaacggttacggttcgggttaacctaccggttaaccgtaaccgttacgttaccggtttaccggttaccttaccgttaacccgg

SEQ ID NO: 63871 - DNA, 777 bp, Homo sapiens
  misc_feature: GYAE6OF01DKVL2.31.78.H01.1.454.CMB.1.raw
  modified_base (334)..(334): a, c, t, g, unknown or other
  misc_feature (334)..(334): n is a, c, g, or t
tcagcagtagacgtcacgaccggtgctcgatttagtgtgagtagtttgggtttgggggagctgcaacaggcaggcagggggcagcaagatggtgttgcagacccaggtcttcatttctctgttgctctggatctctggtgccgtacggggacatcgtgatgagcctagtttccagacctccctggctgtgtctcgtgggcgaggacgggccaccatcaactgacaagtccagccagtagttgtttagttcggaccccaacaaactaacaactacttagcttaggtaccagacaagaaagtaggacacgcctacctaaactcctagtatttacgnggtcttacgacccgggctacggttcccgggttacctaaccgtattaccgagttcgggactacgggtcgggttaccgtacggggtaacccgttaattttcccaaccgttccttaccaacctaacgttaccgaacgtacccaacggtccccgttggaccggtaacgggtaccctaggtaaaaggtacgttcgggttacgggtacctttaaagggtttttactttaacccgttaggttaaccgaacgtaacctaaacgttaacttttaacgtttacccttttccgttttacgttacccgtttaccggttttacggggaccggggtaaccgggtaaccggtaaggggtacgggaacggtaaacgttaaaccgaaaaaccggttacgtttacgggtacgggttaccctacgggtaccccaacgttacttccgttcgtttccttacccg

SEQ ID NO: 63872 - DNA, 580 bp, Homo sapiens
  misc_feature: GYAE6OF01BRMZ5.31.78.H01.1.454.CMB.1.raw
  modified_base (459)..(459): a, c, t, g, unknown or other
  misc_feature (459)..(459): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggcccaccatcaactgcaagtccagccagagttgttttattcggccccacaataacaactacttagcttggtaccagcaagaaagtaggacagccctcctaaactcctagtatttacgtgggtccttcgtaccccgggcacgttcccgggggttccctaaccggtattcagttcggcaggcgggttctcgggaccgtactttcgactcctcaccatcagcagcctgcagctagaagatggtgcttagtttacttacgtntacagtactaactattaactactttcgtttacgtctacgtttcgggcggtacgggacctaagggtgtaagactacgaaacggtactggtcggactcgactacctactctcgttctctaccg

SEQ ID NO: 63873 - DNA, 574 bp, Homo sapiens
  misc_feature: GYAE6OF01BZIN4.31.78.H01.1.454.CMB.1.raw
  modified_base (328)..(328): a, c, t, g, unknown or other
  misc_feature (328)..(328): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttgtaccagcagaaagtaggacagcctcctaaaactcctgatttacgtgggcttctacccgggnagtccggggttcctaaccgattcattggcagcgggtctgggaccgatttcactctcacatcagcagcctgcaggctagaagagtgtggacagttttaattaccgttgtccagacaaacctaatttaacttacgtttcttttccgtactacgtttcgggacgggtaagggaccctaaagggtggaaacgaattacgaaaaaccgtagtaggtcgggctacggcctaccgaattctagtccttctaac

SEQ ID NO: 63874 - DNA, 780 bp, Homo sapiens
  misc_feature: GYAE6OF01B9TIE.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagactccctggctgtgtctcgtgggcgagacgggccaccatcaactgacaagtccagaccaggtagttgttttagttcggaccccaacaataaccaactacttagcttggtaaccagacaagaaagtaggacacgcctacctaaactcctagtactttacgtcgggtccttaccgtaccccgggtctacggttaccccgggggttaccctaaaccggtattccgtaagtttcgggaccgtacggtcgggggttccgtaggggtaaccccgtatttccgaccttacctaccaacccgtactacgaacgtcgaccggcccttggaccgtaagggtcctagggtaaagtacgttagggtacggtacgttaacggttttaatacccgtaggtaccgtaagtacctaaactttaatttaacgtttaacccttttccgttttaccgttaccgtttaaccggttttccggggaccgggtaaccgggggaacctaaagggggttacggaacgtaaaccgtaaacccggaaaacggttaaccgttgggtacgggtacccgtacggtaaccccgttaaccgtacgttacccttacggtttacccgttccttaaaccccg

SEQ ID NO: 63875 - DNA, 664 bp, Homo sapiens
  misc_feature: GYAE6OF01DIRSM.31.78.H01.1.454.CMB.1.raw
  modified_base (324)..(324): a, c, t, g, unknown or other
  misc_feature (324)..(324): n is a, c, g, or t
  modified_base (367)..(367): a, c, t, g, unknown or other
  misc_feature (367)..(367): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagttccagactccctggctgtgtctcgtgggcgagacgggccaccatacaactgacaagtccagccagtagttgttttatcggaccccacaataacaactacttagcttaggtaccagcaagaaagtaggacacgcctacctaaactcctagtatttacgnggtccttcgtacccggtctacgtcccggggttacccaaccgtnttccgattcggacgacgggtcgggtcgtacggggacctacgttccacgtcctacacctatccaagccgacgccgtcggcgtacggctaggaacgtagtaggtcggtacttaacggttttacttaacgtcgttacgagtactaaaccgtatttaactttacctttccgttttaccgtcctttaccggtttccgggaccgggtacgggtaaccgtaaagggttagggactaacgtaacgaaacgtaccgttggtaccggacgtacggacctaccattcccgttactccgttactacccg

SEQ ID NO: 63876 - DNA, 747 bp, Homo sapiens
  misc_feature: GYAE6OF01AKCNC.31.78.H01.1.454.CMB.1.raw
  modified_base (334)..(334): a, c, t, g, unknown or other
  misc_feature (334)..(334): n is a, c, g, or t
  modified_base (382)..(382): a, c, t, g, unknown or other
  misc_feature (382)..(382): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagacggccacatcaactgacaacgtccagccagtagttgttttaacgttcggaccccacaataacctaactacttagcttaggtaccagacaagaaagtacggacacgtccctacctaaactcctgtaactttacgngggtaccttcgtacccgggctacggtcccggggttacctaaaccggtnttccgtacgttcggaccgtacgggtcggggttaccgtcggggaacccgtacgtttccgaaccgttcccgtacctaacccgtacgttaccgacgtacccgtacgtccctacggtaccgaacgggtcctaaggaaaggtcgttaggtacggtcttaacggttttactacgtcggtaccgaagtaactaaacttatttaactaaccgttttcgtttaccgttaccgttacggtttccggggaccggtaacgggtacccgtaagggttacggtaaccgtaacgttaaccggtaaaacgtacgggttcggtacggtaccctaggacccgtaacccgttatttacccggtcgtttcccgttccgttacccg

SEQ ID NO: 63877 - DNA, 616 bp, Homo sapiens
  misc_feature: GYAE6OF01BTPKF.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagacgggccaccatcaactgcaagtccagccagagttgttttacttcggccccaacaataacaactacttagtcttaggtaccagacaagaaagtacgacagccctacctaactctagtattacgtgggtcttaccgtacccgggctacggttcccgggttacctaaaccgtattctagttcggacgacgggtccgggtcgtcgggacccgtatttccgacttcctaccacctatcagcacgcctgcgaggctagaagtgtgtcggacttaagttttactacgtgtacgtagacctaactatttaacttacctttccgttcgttaccttacgtttcgggacgggtaacggccgtaagggtcgagactacgaacgtacgtggtcgcgtacgactaccgtattaccgtgttcctcgtaccc

SEQ ID NO: 63878 - DNA, 702 bp, Homo sapiens
  misc_feature: GYAE6OF01DUA4K.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagtttccagtacctccctggctgtgtctcgtgggcgaggacgggccaccatcaactgacaagtccagccagtagttgttttatcggaccccaacaataacaactacttagcttaggtaccagacaagaaagtagaccacgtaccctaacctaaactccgtagtaactttacgcgggtcctttaccggtacccggggtctaaccggttcccggggtttaccctaaaaccggtctttcgaacgtttcgggcgtacgggtccgggtacggtacggggtaacccgttattttaccaccgttcctacctaacccgtatccgaacggcctacggtccctcgaccgacggtccgtaaggaaacgtacgtgggtacggtacttaagttttacttacgtgttacaagtacaacttattacttactttccgtttcgtaccttacggtttcgggacggtacgggtaacctaagggtcggaacgtaagtaaccgaaacggtaagtggtacggtcctagaccctaactagttaccgtcgttcttcgtaccg

SEQ ID NO: 63879 - DNA, 529 bp, Homo sapiens
  misc_feature: GYAE6OF01D36IO.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaaactgcaagtccagccagagtgttttattggccccacaataacaactacttagcttggtaccagcagaaagtaggacagcctcctaaaactcctgatttactgggcttctacccgggcatccggggttcctaaccgattcattggcagcgggtctgggaccgatttcactctcacatcagcagcctgcaggctgaagatgtggcagttttatactgtcagcaaacattaatactttctttcgtctactttcggcggtagggaccaaagggtggagatacaaaaacgaatggtggctgaccaccaatctgtattctaac

SEQ ID NO: 63880 - DNA, 609 bp, Homo sapiens
  misc_feature: GYAE6OF01D7CSL.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgacaagtccagccagtagttgttttatttcggcccccaacaaataaactaactacttagcttggtaccagacagaaagtagacacgcctacctaaactcctagtactttacgtgggtccttccgtacccgggctacgttcccggggttacctaaccggatttcgagttcggcgaggcgggttccgtggggaccgtactttcgaaccttcgtacaccatcagcagccctgcagctagaagatgtacggcttagttttactactgtcagtactaatattaacgttcttaccgtttcgtcttacgtttcgggacgggtacggtaacgaagggtcgtaagtataccgaaaaggtacgttggtggactggacctacctagtctcggttccttgtacccg

SEQ ID NO: 63881 - DNA, 827 bp, Homo sapiens
  misc_feature: GYAE6OF01CPS63.31.78.H01.1.454.CMB.1.raw
  modified_base (325)..(325): a, c, t, g, unknown or other
  misc_feature (325)..(325): n is a, c, g, or t
  modified_base (347)..(347): a, c, t, g, unknown or other
  misc_feature (347)..(347): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctcgtgggcgaggacgggccaccatcaactgacaagtccagccagtagttgttttatcggccccacaataacaactacttagcttggaccagcaagaaagtaggacacgcctacctaaacctcctgtaactttacgngggtcctttccgtaccccgggntacggttcccggggtttaccctaaaccggtactttcgtaagtttcgggaccgtaacgggtccgggggttacctacgggggtacccgttacttttcccaaccgttccgttacccaacccgtaattccgaaccggtccgaacggtccccgtacgggtaccgtaacgggtaccgttaaacgggtaaacggttacggttacgggttacggggtactttaaacgggttttttaacgtttaccggttacggttaccgtaacggtaacctaaaccgtttaactttttaaccgtttaacccgtttttccgttttttacccggttacccgtttaaccgggtttttaccggggaaccgggggttaacggggtaaacccggtaaagggggttacggaaacggttaacgtaaccggtaaaacggtacccggttaggtccgggtacgtaccggacctaacccgtacgttacgttcgttccgttcgttaccccg

SEQ ID NO: 63882 - DNA, 594 bp, Homo sapiens
  misc_feature: GYAE6OF01BNSON.31.78.H01.1.454.CMB.1.raw
  modified_base (229)..(229): a, c, t, g, unknown or other
  misc_feature (229)..(229): n is a, c, g, or t
  modified_base (317)..(317): a, c, t, g, unknown or other
  misc_feature (317)..(317): n is a, c, g, or t
  modified_base (335)..(335): a, c, t, g, unknown or other
  misc_feature (335)..(335): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccacatcaactgcaagtccagccagngttgttttattcggccccacaataacaactacttagcttggtaccagcagaaagtaggacagcctacctaaactcctagtatttacgngggtcttcgtacccgggntacgttcccggggttacctaaccggtattcattggcaggcgggtctgggaccgtattcactctacaccatcagcagcctgcgaggctagaagtgtgtagctagtttactatgtcagtcaactacttattacctttctttccgtacgttacgtttcggggacggacgggtaaccgtaggggtagacggtaacgtaaccgaaaacggtacgtcggtcggtactcgacgtaaccctagttcgtcgttaccgttcgtaacccg

SEQ ID NO: 63883 - DNA, 738 bp, Homo sapiens
  misc_feature: GYAE6OF01DH9HB.31.78.H01.1.454.CMB.1.raw
  modified_base (373)..(373): a, c, t, g, unknown or other
  misc_feature (373)..(373): n is a, c, g, or t
tcagcagtagacgtcacgaccggtgctcgatttagtgtgagtagtttggggttgggggagctacaacaggcaggcaggggcagcaagatggtgttgcagacccaggtcttcatttctctgttgctctggatctctggtgccgtacggggacatcgtgatggacgccctagtttccagcctcccgtggctgtgtctcgtgggcgaggacgggccaccatccaactgacaagtccgagccagtagtttcgtttattcggaccccaactaaataaccaacttacgttagcgtttacggaaccagaccaagaaacgtgacacgcccttaacctaacctccttagaactttacgtgggtccctttccgaacccgggtntaaccggttccccgggttaacctaaccgtagttaccgagttcggacgaacgggtccggggtccgtacgggggtacctaaccgttttcacccgttctacccgaacctactacgacggtccgaccggcctcggaccgagggtaccttaggaaacgtcggttgtacgggtaccttacggttttaaattaccggttacgttccgaaacgtaacctaaataacgttttacctaccttttccgttaccgttacgttaccgggtttacgggaaccgggtacgggtaaccgaggggttagaaacccgtagtaaaccaacggtacgtcggtacggcgtagacctacccgattaccgtcgttcctcgttaacccg

SEQ ID NO: 63884 - DNA, 713 bp, Homo sapiens
  misc_feature: GYAE6OF01CARNC.31.78.H01.1.454.CMB.1.raw
  modified_base (362)..(362): a, c, t, g, unknown or other
  misc_feature (362)..(362): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagacctccctggctgtgtctcgtgggcgagacgggccacatcaactgacaagtccagccagtagttgttttacgttcggaccccaacaaataaccaaaccttacttagtcgttaggtaaccagacaaggaaaagtacggacacgtcctacctaaactccgtgtactttacgtggtccttccggacccggntacggttcccgggttacctaaccgtacttcgtagttcggacgacggtcgggtcgtacgggtaccgtactttccacttccgtaccaccgtatcgacgcacgcccgtcgcgtacggctaggaaagtgttacggtacggtacgttaagtttacttaacgtcgtaccaacgtactaaaccttatttaaccgtttctttaccgtttacgtacccgttaaccggtttacgggaaccggggtaaccgggtaaccgtaaaggggttaggaaaccgtaagtaaccggtaaaccggtacgttacggtcggtaccgtacgaccgtacctacgtttaccgttccgttacctttccgtaacccg

SEQ ID NO: 63885 - DNA, 654 bp, Homo sapiens
  misc_feature: GYAE6OF01B1OPA.31.78.H01.1.454.CMB.1.raw
  modified_base (327)..(327): a, c, t, g, unknown or other
  misc_feature (327)..(327): n is a, c, g, or t
  modified_base (357)..(357): a, c, t, g, unknown or other
  misc_feature (357)..(357): n is a, c, g, or t
  modified_base (364)..(364): a, c, t, g, unknown or other
  misc_feature (364)..(364): n is a, c, g, or t
  modified_base (384)..(384): a, c, t, g, unknown or other
  misc_feature (384)..(384): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgacgccagtttccagacctccctggctgtgtctcgtgggccgagacgggccaccatcaactgacaagtccagccagtagttgttttattcggccccaacaataaactaactacttagcttggtaccagcaagaaagtaggacagcctacctaaactcctagtattacnggtctcgaccggcagtccgggtactaacgntcatggnacgtcgggtctcgggacctntttcacttcgtaccactacgtcaagcgacgtccgtagccgaagggtctacggaaaggtagttacggtgggtactttaaggttttaacttacctaggtacctaacggtaactaaacctttaatttaacgttaaccttttcgttttaccgtaccttaccggtttacggcgggtaacggaaccgtaagggtacggtaactaagtaaaccgtaaaccgtaaggtggttcgggacttcgaaccttacccgattccgttacgttccttactacccg

SEQ ID NO: 63886 - DNA, 844 bp, Homo sapiens
  misc_feature: GYAE6OF01BXHWF.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagacgggccaccatcaactgcaagtccagccagagttgttttattcggccccacaataacaactacttagcttggtaccagcaagaaagtagacagcctacctaaactcctagtactttacgtgggaccttccgtacccggggctacgttcccggggttacctaaccgtatttcgagtttcggactaggtccggggtctacggggaacccgtaattttccgaaccttccgtaccaaccctattccgaacgtaccaacgtccccgttacggaccgtaacgggtccttaagggaaaacggtacgttacgggttacgggtaccgtttaacggttttttaacgtttaacccgttcggttaacccgtaaggtaacccgtaaaaccgtttaacgtttttaaccgtttaaacccgttttttcccgtttttaccggtttaacccgtttaacccggttttttaccgggggacccggggttaaaccggggttaaccccggtaaaagggggtttaccgggtaaacggtaaaccgttaaacccggtaaaaaacccgggttaaacgtttaccggggtacgggttacccgttaacgggaccctaaaccccggttaacgtttacccggtttacggtttacccgttttacccgttaaaccccgg

SEQ ID NO: 63887 - DNA, 701 bp, Homo sapiens
  misc_feature: GYAE6OF01C2FFF.31.78.H01.1.454.CMB.1.raw
  modified_base (398)..(398): a, c, t, g, unknown or other
  misc_feature (398)..(398): n is a, c, g, or t
  modified_base (441)..(441): a, c, t, g, unknown or other
  misc_feature (441)..(441): n is a, c, g, or t
tcagcagtagacgtcacgaccggtgctcgatttagtgtgagtagtttgggtttgggggagctacaacaggcaggcagggggcagcaagatggtgttgcagacccaggtcttcatttctctgttgctctggatctctggtgccgtacggggacatcgtgatgagccagtttccagactccctggctgtgtctcgtgggcgaggacgggccaccatcaactgcaagtccacgccagtagttgttttacttcggccccaacaataacaactacttagcttaggtaccagcaagaaagtagacacgccctacctaaacctcctagtactttacgcgggtcctttaccgtaccccgggctacggttacccggggttaccctaaaccgtacttcagttggacgnggtcggggtcgtcggggaccttattccgacctctaccaacctntaccgacgccgacgcccgtcgacgtacggtcctaaggaacgtagttacgggttggactttaagttttaacttacgtcgtactacgactaaactattttaacttacttttccgttttacgtacccgttaccggttttaccggggacgggtaccgggtaaccggtaagggttacggaacgtaacgtaaccgaaaaccggtacggttacgggtacggccttacggaacctaccgtaacttccgttacgttccttacctacccg

SEQ ID NO: 63888 - DNA, 611 bp, Homo sapiens
  misc_feature: GYAE6OF01EAVBW.31.78.H01.1.454.CMB.1.raw
  modified_base (319)..(319): a, c, t, g, unknown or other
  misc_feature (319)..(319): n is a, c, g, or t
  modified_base (340)..(340): a, c, t, g, unknown or other
  misc_feature (340)..(340): n is a, c, g, or t
  modified_base (386)..(386): a, c, t, g, unknown or other
  misc_feature (386)..(386): n is a, c, g, or t
  modified_base (394)..(394): a, c, t, g, unknown or other
  misc_feature (394)..(394): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctcgtgggcgagagggtcaccatcaactgcaagtccagccagagttgtttattcggaccccacaaataacaactacttagcttggaccagcaagaaagtggacagcctacctaaactcctagtatttacgngggtccttaccgtacccgggntacgtcccggggttacctaaccgtattcagttcggcaggcgggtcngggacctnttccactcctacaccatcagcagcctgacaggctagaagtatggtagctagtttactactgtacagactaaatatttaacttactttctttcgtacgttaccgtttcgggacggtaacgggaaccgtaagggtaggtaagtaacgtaacgtaaaaccggtaacgttggtcggaccttcgaccctaacctacgttaccttcggttccttcctaacccg

SEQ ID NO: 63889 - DNA, 560 bp, Homo sapiens
  misc_feature: GYAE6OF01CYKS7.31.78.H01.1.454.CMB.1.raw
  modified_base (551)..(551): a, c, t, g, unknown or other
  misc_feature (551)..(551): n is a, c, g, or t
tcagcagtagacgtcacgaccggtgctcgatttagtgtgagtagtttgggtttgggggatctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagtagttgttttattcggccccaacaataacaactacttatcttggaccagcaagaaagtaggacagcctacctaaactcctagtatttacgtgggtcttcgtacccgggcacgttcccggggttacctaaccgtattcattggctaggcggtctcgggaccgtattcacgtctacacctatcagctagcctgcgaggctagaagtatggtgactagtttatactgtcagactaactatttatactttctttcgtactacgtttcggacgggaggaacctaagggtgaagtatacgaaacgagtggtcgctagctaccattctnttctctacc

SEQ ID NO: 63890 - DNA, 729 bp, Homo sapiens
  misc_feature: GYAE6OF01CUTHX.31.78.H01.1.454.CMB.1.raw
  modified_base (329)..(329): a, c, t, g, unknown or other
  misc_feature (329)..(329): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagacctccctggctgtgtctcgtgggcgagacgggccaccatcaaactgcaagtccagccagagttgttttacttcggaccccaacaaataacaactacttagcttaggtaccagacaagaaagtaggacagccctacctaaactcctagatttacgngggtccttaccgacccgggctacgttcccggggttaccctaaccgtattacgagttcggacaacgggtcggggtcgtacggggaaccctagtttccacgttcctccaaccgatcgacgccacggccctaggacgaggtctaggaagtagtggtagacgttaaggtttacttacgtcgtacgacgtactaaactaacgtttaacttaaccttttccgtttaccgttaccgttaaccggttttccgggggaaccgggttaacgggggaaccccgttaaaggggtacgggtaaacggtaaacttaaacccggaaaacggttaaccggttacggtacgggtacccgtacggtaccccgtaaacctaggtttacccttcgggtttaccctttaccgttaacccgg

SEQ ID NO: 63891 - DNA, 570 bp, Homo sapiens
  misc_feature: GYAE6OF01E0ALP.31.78.H01.1.454.CMB.1.raw
  modified_base (434)..(434): a, c, t, g, unknown or other
  misc_feature (434)..(434): n is a, c, g, or t
tcagcagtagacgtcacgaccggtgctcgatttagtgtgagtagtttgggtttgggggagctacaacaggcaggcagggggcagcaagatgggtgttgcagacccaggtcttcattttctctgttgctctggatctctggtgcctacgggggacatcgtgatgagccagtttccagactccctggctgtgtctcgtgggcgagagggccaccatcaactgcaagtccagccagagtgttttattcggccccacaataacaactacttagcttggtaccagcagaaagtaggacagccctacctaactcctgtactttacgtgggtccttcgtaccccgggctacgttcccgggggttacctaacccgattcagttcggcaggcggggtctggggaccatttcactctcaccatcagcagcctgcagctgaaagntgtgctagtttatactgtacagcaatatttactacctttcgtttacgtcttacggtttccggacgggtacgggacctaagggtggacgactacgaaaccgtagtggtgctacgacactactgttcgtcttctaccg

SEQ ID NO: 63892 - DNA, 517 bp, Homo sapiens
  misc_feature: GYAE6OF01AO09T.31.78.H01.1.454.CMB.1.raw
  modified_base (305)..(305): a, c, t, g, unknown or other
  misc_feature (305)..(305): n is a, c, g, or t
  modified_base (322)..(322): a, c, t, g, unknown or other
  misc_feature (322)..(322): n is a, c, g, or t
  modified_base (431)..(431): a, c, t, g, unknown or other
  misc_feature (431)..(431): n is a, c, g, or t
  modified_base (506)..(506): a, c, t, g, unknown or other
  misc_feature (506)..(506): n is a, c, g, or t
tcagcagtagacgtcacgaccggtgctcgatttagtgtgagtagtttgggtttggggagctacaacaggcaggcaggggcagcaagatggtgttgcagacccaggtcttcatttctctgttgctctggatctctggtgcctacggggacatcgtgatgagccaagtttccagactccctggctgtgtctctgggcagaggccaccatcaactgcagtccagccagatgtttattggccccacaataacaactacttagcttggtaccagcagaagtgacagcctcctaaactcctggattttacngggtcttctacccgggnatccggggttcctaaccgattcattggcagcggtcctgggacccatttcactctcaccatcagcagcctgcaggctgagatgtgctagtttattactgtcgagcaaacntttatacgtttcttgtcactttcggccggtagggaccaggtgagatacgaaacgactggtggctgcacccatctnttcttcgtacc

SEQ ID NO: 63893 - DNA, 656 bp, Homo sapiens
  misc_feature: GYAE6OF01B3QTV.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagttgttttattcggaccccaacaataacaactacttagcttggaccagacaagaaagtaggacagccctacctaaactcctagtatttacgtgggtccttccgtacccgggctacgtcccggggtttaccctaaccgtattaccagttcggccgtaggtccggggttcgtacggggacccgtagtttccaccttctaccaacccgtatccaagccagccctgcgaggtcctagaagtatggtcggcttaagtttactacgtcgtacagtactaactacttacttactttcgtttccgtacttaccggttccgggtacgggacgggtacccgtaaagggttcggaacgtaacgtaacgtaaaacggtaacgttggtcggtacgtccgaaccgtacctaacgttcgttacgttcccttacttaacccg

SEQ ID NO: 63894 - DNA, 873 bp, Homo sapiens
  misc_feature: GYAE6OF01DUBI4.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctcgtggtgccgtacggggacatcggtgatgacgcctagtttccagacctccgtggtctgtcgtctcgtgggcgaggcggccaaccatacaactgaccacgtccacgccaggtacgtttagtttacgtccgacccctaaactaacttaaacaacttacttagtacgttacggaccagacgaaaggtaaacggtacggaaccacgtacccttaacctaaacgttccgttagtacgttttaccggtcgggtccctttaccgggacccgggtacgtaccgggtttaccccggggtttaaccctaaacggttacttcgtaacggtttcgggaccgtacgggggttccggggttacgtaccggggttaaccgtttactttacccgaaccctttccgttaaacccgaacccgtaacttcggaaccggtacctaccggtacccttagggaccggaacggttccgtaaaggtaaacggtcgttcgggtaacggttactttaacggtttttactacgttacgtaacccgagttaaactaaccttagttttaacctttaaccgttcccgttttacggttacccgttaaaccgggtttcggggaacccgggttaacggggtaaacccgttaaggggaaccggtaaagttaacccgtaaaccgggtaaaaccgtagggtttacggtacggttaccccgtaggtaaccccttaacgtttccgttacgttacccgttacctttacccgtaccccgg

SEQ ID NO: 63895 - DNA, 816 bp, Homo sapiens
  misc_feature: GYAE6OF01B3PVT.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagacctccctggctggtgtctcgtgggcgaggacgggcccaccatcaactgacaacgtccagccagtagttgttttagttccggaccccaacaaataaacctaacttaacttagtcttacggtaccagacaagaaagtaggacacgcctacctaaactcctagtacttacgtcgggtccttaccggtacccgggctacggttcccgggttaccctaaccgtattcgagttcggacgacggtcgggttacgtacggggaccctagtttaccacgttcctaccgaacctagtccgaacggtaccgaacggtcccgtaggacccgtaagggtacccgttaaagaaacggttacgtacgggttacgggtaacctttaaagggtttttaaacttacccggttacggttaaccgaacggtaaccctaaaacgtttaacgttttaaccttttaacccgttttaccgttttaccggttaccctttaaccgggttttaccggggaaccgggggtaaccgggtaaacccgtaaagggggttacggaaacgtaaaccgttaaacccggaaaaacgggttaaccgtggggttacccgtacggttaacgacccgttaacccgtatttaccccggttacttaccgtttcctaacccgg

SEQ ID NO: 63896 - DNA, 762 bp, Homo sapiens
  misc_feature: GYAE6OF01AZIY6.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagttgttttattcggccccacaataacaactacttagcttggtaccagcagaaagtaggacagcctacctaaactcctgtactttacgtgggtccttccgtaccccgggctacggttccccggggttaccctaaccggtattccgtagttcggccacgggtccggggtaccgtcggggaacccgtatttccaccgttcctaccgaccctattccgaacgccgtacggtccctaggaccgtacgggtccgttaacggaaaggtacgttacgggttacggtaccgttaaggtttttacttaaccgttcgttaccgaacggtacctaaaccttaacgttttaactttaaccgttttcccgttttacccggtttaccgttaacccggtttttccggggaccggggtaaccggggtaacccggtaaagggggttacggaaacggttaacgttaaacccggtaaaaccggtaacggttacggtacgggtacctacggaccctaacccgtattaccgtttcgttcccgttccgttacccg

SEQ ID NO: 63897 - DNA, 670 bp, Homo sapiens
  misc_feature: GYAE6OF01AMOJC.31.78.H01.1.454.CMB.1.raw
  modified_base (244)..(244): a, c, t, g, unknown or other
  misc_feature (244)..(244): n is a, c, g, or t
  modified_base (254)..(254): a, c, t, g, unknown or other
  misc_feature (254)..(254): n is a, c, g, or t
  modified_base (271)..(271): a, c, t, g, unknown or other
  misc_feature (271)..(271): n is a, c, g, or t
  modified_base (349)..(349): a, c, t, g, unknown or other
  misc_feature (349)..(349): n is a, c, g, or t
  modified_base (410)..(410): a, c, t, g, unknown or other
  misc_feature (410)..(410): n is a, c, g, or t
  modified_base (455)..(455): a, c, t, g, unknown or other
  misc_feature (455)..(455): n is a, c, g, or t
  modified_base (631)..(631): a, c, t, g, unknown or other
  misc_feature (631)..(631): n is a, c, g, or t
  modified_base (662)..(662): a, c, t, g, unknown or other
  misc_feature (662)..(662): n is a, c, g, or t
tcagcagtagacgtcacgaccggtgctcgatttagtgtgagtagtttgggtttgggggtaggcgtacaacaggcgaggcgaggggcgagcgaagatggtgttgcagacccaggtcttcatttctctgttgctctggatctcgtggttgccgttacggggacatcgtgatggagccagttttccagtacctccctggactgtgtctccgtagggcgaggaggcccacatcaactgccaagtccanccagtagttnttttatcggcccctaanaataacacttacttagccttaggaccagtcaaggtaaaacgtcggacacgccttacctaaacgtcctgtacgtttcgngggtccttcccgtaccgggctaacggttcccggggttacctaaacggtttcctagtcggcngtacggggtctacgggctattcgactcctacgccctaatccgaanccgcgtctcggactacggcctagaacgagttcggacggtacgtatttttaagtacctgccgtaagactaaacggtatttaactcccgttttacttcgttacccgtagttcccgggaggaacggtacgtaagggtgaacgttaagtaccgaaacggtaccgttggacgggtcctaancccgttaaccctagttcgtttactcccgttnttaccccg

SEQ ID NO: 63898 - DNA, 810 bp, Homo sapiens
  misc_feature: GYAE6OF01DR91K.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctcgtggtgccgtacggggacagtcgtgatgagcctagtttccagcctcccgtggctgtcgtctcgtgggcgaggacgggcccacatcaactgacaagtccagccagtagttgttttactccggaccccaactaaactaactaacttactacgtcttacggtaccagacgaagtaaacggtacgacacgtaccctaccgtaaacctccgtagttacgttaccgtacggtcccgtttaccgacccgggtctaccggttcccgggttaaccctaaccggtatctaggttcggcgtaacggtcgggtcggtacggtacccgttagtttccacgttcctaccgaacctagtaccacggtacctaccggtcccgttacggacgtacgggtaccgttaaaggaaacgtgggttacgggtagtacccgtttaacgggttttaacttaccgttaccggaactaacccggtactaaaaccgttttactttaaccgttttaccccttttccgtttaacccggttaaccgtttacccgggtttaaccggggtaccgggggaaaccgtaccgggtaaagggttcggaaacttaaaccggtaaaccggtaaacgtaaccggttcggttaccggtacccgttacaccgttaacccctgtttaccggttaacctttccgttacccggtaacccg

SEQ ID NO: 63899 - DNA, 645 bp, Homo sapiens
  misc_feature: GYAE6OF01CD93I.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagtttccagacctccctggctgtgtctcgtgggcgaggagggccaccatcaactgcaagtccagccagtagttgttttattcggccccaacaataacaactactagcttgtaccagcaagaaagtagacacgcctacctaactcctgtactttacgtgggtccttcgtacccgggctacgtccgggttacctaacgtattcagttcgcgaggtcggtcgtgggacctattccactctacgaccatcgagcacgcctgcgacggctagaagtatggacggtactagtttacttacgtcgtacaacgactaaactatttacttacttttaccgtttccgttaccgttaccggttttccgggacggggtaacgggtaaccggtaagggtacggtaacggtaacgtaacgaaaaccggttagttacgggttacggtaccgttagacccgtaaccgttatttccgttacgttccgttcttaacccg

SEQ ID NO: 63900 - DNA, 589 bp, Homo sapiens
  misc_feature: GYAE6OF01CBHYR.31.78.H01.1.454.CMB.1.raw
  modified_base (424)..(424): a, c, t, g, unknown or other
  misc_feature (424)..(424): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccaaccaataaaaactcttagcttggtaccagcagaaagtaggacagcctcctaaactcctgtatttacgtgggccttcgtacccgggctacgtcccggggttcctaaccggattcgattcggcaggcggtctcgggacgtatttcgactctcaccatcagcagcctgcaggctagaagntgtgactagtttactactgtacagctaatattatacttctttacgacttacgtttcgggacgtagggaccctaagggtcggaagtacgtaacgaaaaccgtacgttggacggtcctacggacctaacccgtagttacccgttagtaccctttcgtaattcccccg

SEQ ID NO: 63901 - DNA, 713 bp, Homo sapiens
  misc_feature: GYAE6OF01CL8GV.31.78.H01.1.454.CMB.1.raw
  modified_base (347)..(347): a, c, t, g, unknown or other
  misc_feature (347)..(347): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagtagttgttttattcggacccaacaataacaactacttagcttagtaccagcaagaaagtaggacagcctaccgtaaactccgtagtactttacgcgggtacctttccgtaccccgggntacggttccccggggttacctaaccggtacttcgacgtttcggacctaagggtccggggttacgtacggggtaacccgtattttaccgaacttccgtacacctatcgacgtcacgcctgacgaacggtcttaggaaacgtgtcggtacggacttaagttttactacgtgttacacggactaaacttacgtttaacttaccttttccgtttaccgtaccgttaccggttttccgggaccgggtaacgggtaacccgtaagggttacggtaacgtaacgttaaaccgaaaccgggtaagttcgggttacgggaccttacggaccgtaacccgtaagtttcccgttacggttcccttccggttaacccg

SEQ ID NO: 63902 - DNA, 719 bp, Homo sapiens
  misc_feature: GYAE6OF01BCOQ7.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagacctccctggctgtgtctcgtgggcgagacgggccaccatcaactgacaagtccagccagtagttgttttattcggaccccaccaataacaactacttagcttagtaccagacaagaaagtaggacacgcccttacctaaacctcctagtactttacgtcgggtcttccgtacccgggtctaccggttcccggggtttaccctaaccgtcttccaagttcggacgaggtccgggtcgtaggggtacctatttccgaccttctacaccgtactcgagacctcgcccgtggaccgtaggcgtaaggaagtagttacggtcggtacttacgtttttaaacgttcgtaggtacccaggtaacctaaacgttacttttaacgtttaacccgtttttccgttttacccgtaccgtttaacccgggttttccggggacgggtaacgggggtaaccctaaggggttacggaagtaaccgttaaacgaaaaccgggtacgttggtaacggcttagacccgaaccgttcttacgttccgttacttacgttacccg

SEQ ID NO: 63903 - DNA, 921 bp, Homo sapiens
  misc_feature: GYAE6OF01D03ZM.31.78.H01.1.454.CMB.1.raw
  modified_base (201)..(201): a, c, t, g, unknown or other
  misc_feature (201)..(201): n is a, c, g, or t
  modified_base (362)..(362): a, c, t, g, unknown or other
  misc_feature (362)..(362): n is a, c, g, or t
  modified_base (389)..(389): a, c, t, g, unknown or other
  misc_feature (389)..(389): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagttccagactcctggctgtgtctcgtgggcgaggngggccaccatacaactggcaagtccagccaagtagttagtttttacgttccggccccaacctaaactaaacaacttacttagtcgttggtaaccagcgaagaaagtaggacacgaccctacctaaactcctagtactttacgtcggtccttccgaccgggntacggttcccgggttacctaaaccgtnttcaagttcggactacgggtccgggtcgttacggggaaccttactttacgaaccttacctccgtaacctacgttacgacgtccgaaccgtccgttggaacccgggtaggtaccgtaaagggtaaacgggtatttcggggtaaccggtttaaccgttaagggttttttttaaacctaccgggtttacgggttaaacccgtaacggtaaccccttaaaaacggtttaaccttttttaacgttttaacccccggtttttaacccgggtttttttccgtaacccgggtttttaaacccggggttttaccccgggggggaaaccgggggtaacccggggtttaaaaccccgggttaaagggggttttaacgggggaaaaccctttaaaacccggggttaaaacccggttaaaaaaccggggttaacccggttttcggggtaccggggttaaccccgtaccgggttaaacccccttaacccggggttaacccttttccgggttttaccgttaccccgtttttacccggtaacccccgg

SEQ ID NO: 63904 - DNA, 779 bp, Homo sapiens
  misc_feature: GYAE6OF01C26H1.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgacgcctagtttccagtacctcccgtggctgtgtctcgtgggcgaggacggccacatcaacgtcgacaacgtccacgccaggtagtttcgtttttacgttccggacccctaactaaactaaacctaaccttacgttacgtccgtttacggtaaccacggacaaaggtaaacggtacggaaccaacgtaccccttaaccctaaactcccgttagttaacttttaccggcggggttaccttaccggtacccggctaccggttccccggggttaccctaaccggtacttacgaacgttcggacgtacgggtccggggtacgtacggggtaacccttattccgaccttcctacccgaacctatcccgacggtccacggtcctaggaccgaggtcgtaaggtaagtgttcggtacgtacgttttaaagttttactaacggtgtaccggtaactacttaaacgttacttttacgttaaccgtttcgtttaccgttaccgttaccggttacgggacgggtaccggtaaccggtaagggttagaaaccgtaccgtaaacggtaaaccgtagttacgggtcgaccgttagaccctacgttattcccgttacttccgttaccgttacccg

SEQ ID NO: 63905 - DNA, 684 bp, Homo sapiens
  misc_feature: GYAE6OF01CKWOA.31.78.H01.1.454.CMB.1.raw
  modified_base (406)..(406): a, c, t, g, unknown or other
  misc_feature (406)..(406): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtcgccgtacggggacatcgtgatgacgcctagttccagtacctccgtggctgtgtctcgtcgggcgaggacggcctacatacaactgacaacgtccagccgtaggtagtttgttttacgtccggacccctaacaaataacctaacttacttagtcgttacggtaacagacgaagtaaagtacggacacgtaccctaacctaaactcctagtactttacgcggtaccttaccggtacccggctaacggttcccgggttacctaaaccgtnttacgtacgttcggacgtacgggtccgggtacgtacgggtaaccttctttcgaaccttctactaaccataccgagtccacgtcctgacgtaggacgtagacgtagtacggtacgtacttaagtttactacgtgactaagtactaattattacttacgtttcgttacgtaccgttacggttacgggacggtacgggtaaccgtaaggtacgaacgtaactacgtaaacgtagtggtcgtaccgtacgaccgtaacctacgttctacttcgtacgtcccg

SEQ ID NO: 63906 - DNA, 635 bp, Homo sapiens
  misc_feature: GYAE6OF01BNUA0.31.78.H01.1.454.CMB.1.raw
  modified_base (321)..(321): a, c, t, g, unknown or other
  misc_feature (321)..(321): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagctccctggctgtgtctcgtgggcgaggacgggccaccgatcaactgacaagtccagcagagttgtttattcggccccacaataacaactacttagccttaggtaccagacaagaaagtagacacgcctacctaaactcctgtatttcgnggtccttcgacccggctacgtcccggggttacctaaccgtattcagttggctaggcgggtctgggaccgtatttcgactctcacctatcagcacgcctgcgacggctagaagtactggtagactagtttacttacgtgtacagtactaactattacttactttccgtttacgtacgtaccgtttacgggaccgggtacgggtaacccgtaaggggttacggtaacgtaacgtaaccgaaaacggtaaccgttcgggtacggtaccttacggacccgtaccgtacgttaccgtttcgttcctttaccgtaacccg

SEQ ID NO: 63907 - DNA, 805 bp, Homo sapiens
  misc_feature: GYAE6OF01CVGFJ.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctcgtggatctcgtggtcgccgtacgggacagtcgtgagtgacgccgtaggtttccacgtacctcccgtggtctggtcgttcctggtcgggacgaggacggcccaacctagtaccgaacgtgacgaacgtaccacgacctagtacgtttgttttacgtccggaccccaaactaacttaaaccgaacttaccgttagacgtttaccggaacctagaccaaaggtaaacgtggaacaccgtaccctaaccgtaacttccgtagttacgttacggcggtacttaccgaccgggtctacggttacccgggttacctacgtgttcgaacgttcgggaacctaggggtccgggtacgtacggggtaaccttccggtttcaccgtttacgaccctaacgtagtcccgaaggtccgacggtccgtaggtaccgtagtaccgttaaggaaacggttcgttacgggttagtacgtttacgtttaacgtacgttacggtacgtaacgtaaccttaaacgttacgtttaaccgttacgtttaccgtttaccgtaccgtttaaccggttcgggaacggttacggtaacggtaacgggtacgtaccgtaacgtaaccgtaaacgggtacgttacggtccggtaccgtaacccggtctaaccccgttataccgtttaccggtcttccggttaccccg

SEQ ID NO: 63908 - DNA, 597 bp, Homo sapiens
  misc_feature: GYAE6OF01B37QA.31.78.H01.1.454.CMB.1.raw
  modified_base (433)..(433): a, c, t, g, unknown or other
  misc_feature (433)..(433): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagttgttttattcggccccaacaataacaactacttagcttggtaccagcagaaagtaggacagcctcctaaactcctagtactttacgtgggtccttcgtaccccgggctacgttcccgggggttaccctaaaccgtattcagttggcaggcgggtctgggaccgtatttcactctcaccatcagcagcctgcaggctgaagngtgtggactagtttactactgtcagcaactattacttacttcgtttcgtacttacgtttccgggacgggtacgggaccgtaagggtggaagtaacgttaccgaaaacggtacgttaggttcggacttacgaccctaccgtacttacttcgttccgttctacccg

SEQ ID NO: 63909 - DNA, 724 bp, Homo sapiens
  misc_feature: GYAE6OF01BSQOG.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggaccccaacaataacaactacttagcttaggtaccagacaagaaagtaggacacgaccctacctaaacctcctagtacttttacgtcgggtcctttaccgtacccgggcctacggttcccggggtttaccctaaaccggtattccgtaagttcggccgtacggtcggggtccgtacggggtacccgtattttaccgacctcctaccaacctattaccgaacgtccaacggtccctaggaccgacgggtacctaggaaacgtagttggtcggtacttaagttttacttaccgttcgtaccaagacctaaacttactttaactttacctttacttttaccggtccttacgttttacgggaccgggtaacggggtaaccctaaaggggtcggtaagtaacggtaaccgtaaaacggtaacgttaggttacggtaccgttacgacccttaacctaacgttcctttaacgttcccgttcttaacccg

SEQ ID NO: 63910 - DNA, 680 bp, Homo sapiens
  misc_feature: GYAE6OF01AOHB4.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagactccctggctgtgtctcgtgggcgaggagggcccaccatcaactgacaagtccagccagagttgtttattcggccccaacaataacaactattagcttggaccagacagaaagtggacacgcctacctaaactcctagtactttacgcgggtcttaccgtacccgggcacgttcccggggttacctaaccgtattacagttcggcacgggtccggggtcgtacgggacccttagtttccaccttaccgtaccaacctatcgacgcacgccctggcgaaggtcctaaggaagtagttcggtagtaccttagtttacttacgtagtaccagtaccaacgtaatttaacgttacctttcgtttaccgtacgttaccggtttccggggaacggtacgggaaccgttaaggggtaggtaacgtacgtaaacccgaaaacggtacgttacgggtcggtaccctggtaaccccgtaaccgtacgtttccgtacgtttacccgtcgttaacccg

SEQ ID NO: 63911 - DNA, 819 bp, Homo sapiens
  misc_feature: GYAE6OF01B6J5D.31.78.H01.1.454.CMB.1.raw
tcagcagtagacgtcacgaccggtgctcgatttagtgtgagtagtttgggtttgggggagctacaacaggcaggcaggggcagcaagatggtgttgcacgacccaggtcttctatttctctgttgctcgtggatctcgtggtcgccgtacgggacagtcgtgatgacgcctagtttccacgtacctccgtggcttggtcgtctcggtgggacgaggacgggcccacactacaacgtcgactaacgtccacgaccgaaggttagtttgtttttacgttcccggacccctaaactaaaactaaaccaaacttacgttacgtacgttacggtaaccagacgaaaaggtaaaacggtacggaacctaaccggtaccccttaaaccttaaaccgttccgttacggtttaacgttttacgggtccgggttacctttccccgggtaaccccggggtctaaccgggtttccccggggtttaacccctaaaccgttcttacgttacggttcggacgtacgggtcgggtcgtacgggtaaccttacgtttccaccttcgaccacctacgtcgacgtacctacgtccgtcgacgtacggtacgtacgtaagtcgttcggtacggtacgtttaacgttttacgtacgtagtactacgtaacctaaacgtacttttaaccttacttttacggttaccttaccgttacggtttaccggggacgggtaaaccggtaccggtaagggtacggtaacgtaaaccgttaaccgaaaaccggttagtacgggtcgtcgtaacgaccctacgtacttacgtaccgtttcttacgtaccg

SEQ ID NO: 63912 - DNA, 723 bp, Homo sapiens
  misc_feature: GYAE6OF01CS84N.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagactccctggctgtgtctcgtgggcgagacggccaccatcaatcgacaagtccagccagtagttgttttagttcggaccccaactaataaccaacttacttagacttaggtaccagacagaaagtaggacagaccctactaaactcctagtactttacgtgggtaccttccgtacccgggctacgttcccggggttaccctaaaccgtacttacgtacgtttcggaccgtacgggtccgggtcgtacggggaaccctacgttttccaacctttctaccaccctaattcgacgacctacgtccctggtaccgacgggtacctaggaacgtagttacgggtacgtactttaagttttattaccgtgtacgaacgtactaaacgttaatttacttaccgtttccgttttacgtacgttaccgtttcgggacggtacgggtaacccgtaagggtacggaacgtaacttaacccggaaaacggttacgtacggttacggcccttaaagcccgttaacccgtaagtttccgtacggtttacccgttccgttaaccc

SEQ ID NO: 63913 - DNA, 670 bp, Homo sapiens
  misc_feature: GYAE6OF01CUST8.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagcctccctggctgtgtctcgtgggcgagacgggccaccgatcaactgacaagtccagccagtagtttgttttacttcggccccaacaaataaactaacctaacttagcttaggtaccagacaagaaagtaggacacgcctaccgtaaactcctagtatttacgcgggtcttccgtacccgggactacgtcccggggttacctaaccggtacttacgagtttcggacgtacggccggggttactcggggaaccctatttccactcctaccacctatcgagcacgcctgcgaggctaggaagtacgtggtacggtacgtaagttttaactacgtcgtacgtaacactaaacgtaactttaacttacctttcgttttacgtccttaacggtttccggacgggtacgggtaaccgtaagggtgaaacgtagtaaaccggaaacgtacggttacggtcggtacctgaccctaccgtagttccgttacgttccgttacgtacccg

SEQ ID NO: 63914 - DNA, 698 bp, Homo sapiens
  misc_feature: GYAE6OF01BPVZD.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagacggcccacatcaactgacaagtccagccagtagttgttttattcggccccaacaataacaactacttagcttggtaccagcaagtaaagtaggacacgcctacctaaactcctagtatttacgtgggccttccgtaccccgggctacggttccccggggtttaccctaaaccggtatttaccgagtttcgggaccgtacgggtccgggggttcgtacgggggtaaccccgttattttcccgaacctttccctacctaacccctaacgttcccgaacgcccgtaaggtccccgttacggaccgtacgggtaccttagggtaaacgtagttcgggtacggtacctttaaggtttttaacgttacgttacgtacacgtacctaaacgttattaactttacctttctttccgtacgttacgtttcgggacgggtacggaccgtaagggtgtaagtactacgaaacgtagtcggtgctagacctacactctctcttctacccg

SEQ ID NO: 63915 - DNA, 770 bp, Homo sapiens
  misc_feature: GYAE6OF01BJ4A1.31.78.H01.1.454.CMB.1.raw
  modified_base (405)..(405): a, c, t, g, unknown or other
  misc_feature (405)..(405): n is a, c, g, or t
  modified_base (438)..(438): a, c, t, g, unknown or other
  misc_feature (438)..(438): n is a, c, g, or t
  modified_base (509)..(509): a, c, t, g, unknown or other
  misc_feature (509)..(509): n is a, c, g, or t
  modified_base (759)..(759): a, c, t, g, unknown or other
  misc_feature (759)..(759): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtcgccgtacggggacagtcgtgatgagcctagttccagctccctggctgtgtctcgtgggcgaggacggcccaacatcaactgacaacgtccagcctaggtagtttcgttttacttccggacccctaacctaaactaaacctaacgttacttacgcctttacggtaaccaggaacgtaaagaaaaggtacgaaccgtaacgtaccccttaaccgtaaaacctccttaagttaccttttaccggcgggtacctttaccggaccccggtntaacccgggttcccgggttaacctaaaccggtnttacgtagttcggacgacggtcgggtctacgggaccgtactttcgaccgttctacccaccttagcacgacncgcctagcgagtcagtaagcgtgtgtactaagttttctacgcgttacgattactaaactttacgttaactttacccgttttccgtttaccgtaccttaaacgggtttcccgggaacgggtaacgggtaccttaaagggaccggttaaacggtaacgttaaaccggtaaacgggttaaccggttgggtacccgttaccgggaacgttaaccccgttaacggttacttcccggtttaacgtaaccccgtttnttaaaccccgg

SEQ ID NO: 63916 - DNA, 582 bp, Homo sapiens
  misc_feature: GYAE6OF01AUSL7.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagttgttttattcggccccaacaataacaactacttagcttggtaccagcagaaagtaggacagccctacctaactcctgatttactgggtcttcgtacccgggcacgtccgggttccctaacgattcagttcggcaggcgggtctgggaccgtattcactctcacctatcacgcacgtcctggaccaggctagaacgtatcggtggctaagtttacttacgtcgtacagactaactattaacttactttcttcgtaccttacggttcggacgggtacggaccgtaaggtcgagtacgtaacgaaacgtacgtaggtcgaccgtgaccctactactcgtacttcttctacccg

SEQ ID NO: 63917 - DNA, 664 bp, Homo sapiens
  misc_feature: GYAE6OF01DXE1V.31.78.H01.1.454.CMB.1.raw
  modified_base (142)..(142): a, c, t, g, unknown or other
  misc_feature (142)..(142): n is a, c, g, or t
  modified_base (305)..(305): a, c, t, g, unknown or other
  misc_feature (305)..(305): n is a, c, g, or t
tcagcagtagacgtcacgaccggtgctcgatttagtgtgagtagtttgggtttgggggagctacaacaggcaggcaggggcagcaagagtggtgttgcagacccaggtcttcatttctctgttgctcgtggactctctggtncctacggggacatcgtgatgagccagtttccagactccctggctgtgtctcgtgggcagacgggccaccatcaactgacaagtccaagccagtagttgtttttacttcggcccctaacaagtaaacaactacttagcttggtacctagcagaaacgtaggacnggacctacctaaactccttgatttaactggcttcgtaccgggtcactccggggttccctaacggacttctattcggactagtcgggtctggggacctatttccacgtcctcaaccacttcgacgtcgaacgacccttcgacgacggactagaaagtacttggtacggtacgtaagtttttaacgttaccgttgtaccaacggtacaaacgtactttaactttactttccgtttacgttccttaacgtttcggacgggtacgggaacccgtaagggttcggacgtaacgttacgaaaaccggtaagttggttacgcgttagacccttaccgtaacttccgttcgtccctttcgtaacccg

SEQ ID NO: 63918 - DNA, 679 bp, Homo sapiens
  misc_feature: GYAE6OF01C0WPR.31.78.H01.1.454.CMB.1.raw
  modified_base (369)..(369): a, c, t, g, unknown or other
  misc_feature (369)..(369): n is a, c, g, or t
  modified_base (474)..(474): a, c, t, g, unknown or other
  misc_feature (474)..(474): n is a, c, g, or t
  modified_base (511)..(511): a, c, t, g, unknown or other
  misc_feature (511)..(511): n is a, c, g, or t
  modified_base (627)..(627): a, c, t, g, unknown or other
  misc_feature (627)..(627): n is a, c, g, or t
  modified_base (659)..(659): a, c, t, g, unknown or other
  misc_feature (659)..(659): n is a, c, g, or t
tcagcagtagacgtcacgaccggtgctcgatttagtgtgagtagtttgggttgggggagctacaacaggcaggcaggggcagcaagatggtgttgcagacccaggtcttcatttctctgttgctctggatctctggtcgccgtacggggacatcgtgatgagcctagtttccagtcctccgtggctgtgtctcgtgggcgaggacggccacatacaactgacaacgtccagccaggtagtttgttttacttccggaccccaacctaaataaaccaacttaacttagctttacggaaccagacaaggaaagtaggacagccctaaccgtaaactcgtagtacttacgtcgggtaccttccgtacccgggntaccggtccgggttacctaacgtatcagttcggctacggtcggtacgtacggtactactcgaactcacactagtacagccagtcgtagacgtagtctaggtaagngtcggtacgtacgttagtttacgtagtcgtacgtaanaacttaacttacgttaacctttaaccttttccggttaacccgttacggttaaccggttcggggtaaccggacgggttaaaccgagggtaacgggtactaaacgtacgtaaaacggnggttacggcgttacgacacccgtattacgttntccgttacgttcgttaaccc

SEQ ID NO: 63919 - DNA, 623 bp, Homo sapiens
  misc_feature: GYAE6OF01BHSUW.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagtagttgttttattcggccccaacaataacaactacttagcttggtaccagcaagaaagtaggacacgccctacctaaactcctgtatttacgtgggtccttcgtacccgggctacgttcccggggttacctaaccgtattcagttggcaggtcgggtctgggacccgtatttcactctcaccatcagcacgcctgcgaggctagaagagtggtaggacttagtttacttacgtgtcagtactaactattacttactttctttaccgttaccgttacgtttaccgggacgggtacgggtaaccgtaagggtagggacgtaacgtaacgaaaaccggtaacgttagggtcggaccttacggaccctaccgtacttccttacggttccttcgtaccc

SEQ ID NO: 63920 - DNA, 612 bp, Homo sapiens
  misc_feature: GYAE6OF01ATEDP.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggccccacaataacaactacttagcttggtaccagcagaaagtaggacagcctacctaaactcctagatttacgtgggccttccgtacccgggctacgttcccggggttaccctaaccgattcagttcggcaggtcgggtcgtcgggtaccgtatttccacgttcctcaaccatccaacgcacgcctgccgaggtctagaagtatgtggctagtttactactgtcagtactaacgtatttactactttctttacgtcttacgtttcggacgggtacggaccgtaagggtcgtaacgtaacgtaaccgtaaacggtacgttacgggtcggtactacggacctacccgtaattccgttggttccttcgtaccg

SEQ ID NO: 63921 - DNA, 722 bp, Homo sapiens
  misc_feature: GYAE6OF01DKHLN.31.78.H01.1.454.CMB.1.raw
  modified_base (403)..(403): a, c, t, g, unknown or other
  misc_feature (403)..(403): n is a, c, g, or t
  modified_base (436)..(436): a, c, t, g, unknown or other
  misc_feature (436)..(436): n is a, c, g, or t
  modified_base (455)..(455): a, c, t, g, unknown or other
  misc_feature (455)..(455): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacagtcgtgatgagcctagttccagacctccctggctgtgtctcgtgggcgaggcgggcccacatacaactgacaacgtccagccagtagtttgttttacgtccggaccccaacaaataacctaacttacttagtcgttacggaccagacaaggaaagtacggacacgacctaacctaaacctctagtactttacgtcgggtccttaccgacccggtctaccggttcccggggttaccctaaccggtcttacgngttcggcgagggtccggtcgtacgggtaccgtnttcactctacacatcgacncgagtccctgacgacggtctaggaacgtagttggtacggtacttagttttaactactacgtacaaacgaccttaacttactttactttaccttttccgttttaccggtaacctttaccgggtttccggggaacgggtaaccgggtaaccggttaagggttacggaaccgttaaacgtaaaccggtaaaacggttacggttagggtaccggtaccgttacggaacccttacgttaacttccggtttacttcccgttcgttacccccgg

SEQ ID NO: 63922 - DNA, 592 bp, Homo sapiens
  misc_feature: GYAE6OF01E2K6J.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagtttccagactccctggctgtgtctcgtgggcgagagggccaccatcaactgcaagtccagccagtagttgttttattcggcccccacaataacaactactagcttcggtaccagacagaaagtaggacacgcctcctaaactcctagtatttacgtggcttccgtacccgggcacgttcccggggttacctaaccgtattcattcggcaggtcgggtctgggtacctatttcactctcaccatcagcacgcctagcgaggctagaagtagtgtcgtctagtttactagtcgtacagtacaatacttacttactttacctttcgtccttacgtttacggacggtacggtaccgtaagggtggtaacgtacgtaacgtaaacgtaacgtggtggcctcgaccactacttacgtcgttccttcctaccg

SEQ ID NO: 63923 - DNA, 589 bp, Homo sapiens
  misc_feature: GYAE6OF01EF3ZU.31.78.H01.1.454.CMB.1.raw
  modified_base (321)..(321): a, c, t, g, unknown or other
  misc_feature (321)..(321): n is a, c, g, or t
  modified_base (366)..(366): a, c, t, g, unknown or other
  misc_feature (366)..(366): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgacaagtccagccagagttgttttattcggccccacaataacaactacttagcttggtaccagcaagaaagtaggacagccctactaaactcctagtactttacgngggtccttccgtacccgggctacgttcccgggttacctaaccgtnttcattggcaggcgggtctgggacctatttcactctcaccatcagcagcctgcgaggctagaagtagtggtaggcttaagttttatacgtgtacagtacaaactatttacttactttctttcgtaccttacgtttcgggacggtagggaacctaagggtggagaacgttacgaaaacggtaacgtggtcggactgacctacctattccttgttccttcgtacc

SEQ ID NO: 63924 - DNA, 594 bp, Homo sapiens
  misc_feature: GYAE6OF01A7P6Q.31.78.H01.1.454.CMB.1.raw
  modified_base (443)..(443): a, c, t, g, unknown or other
  misc_feature (443)..(443): n is a, c, g, or t
  modified_base (457)..(457): a, c, t, g, unknown or other
  misc_feature (457)..(457): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttatttcggccccaccaataacaactacttagcttggtaccagacacgaaagtacggacacgacctcctaaactcctgactttacgtcggtcttccgtacccgggctacgtccggggttacctaaccgtattctacgttcggcacggtcgggtcgtagggaccgtatttcacgtctcaccatcgacgcacgtcctgcaggctagaacgntcgtggctagtttntacgtgtcagctaacgtattactacttcgttcgtctacgtttcggacggtaggacctaaggtggtacgaacttccggaaaactaggtcgtacgggaccgttgaccgtacctagttccgttcggttccgttcgtaccg

SEQ ID NO: 63925 - DNA, 752 bp, Homo sapiens
  misc_feature: GYAE6OF01EPVBT.31.78.H01.1.454.CMB.1.raw
  modified_base (379)..(379): a, c, t, g, unknown or other
  misc_feature (379)..(379): n is a, c, g, or t
  modified_base (405)..(405): a, c, t, g, unknown or other
  misc_feature (405)..(405): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagttccagactccctggctgtgtctcgtgggcgaggacgggccaccatcaactgacaacgtccagccagtacgttgttttacgttcggaccccctaactaaataaaccaacttacgttaacgtcgtttacggtaaccagacgaaaggtaaaggtacggaacacgtacccttacctaaactccttagtactttacggtgggtccttccgacccgggntacggttcccgggttacctaaccgtnttcgagttcggacgtacgggtccgggttcgtacggggtacccttagtttcccaacgttcctaccaaccgtacgttaccgaacggccctaacggtccccttagggaccgacgggtcctaaggaaaggtacgttcgggtacggtactttaaggtttttaacttccgtagtaccgaacgtacctaacttactttaacgttaccttttccgtttaccggttaccttaccgggtttccgggacggggtaccgggaactaaggggttacgaacgtaactaaccggtaaaacgtcggttggtcggtacgttagacccgtaccgttaattccgttaggtttaccctcgttacccg

SEQ ID NO: 63926 - DNA, 611 bp, Homo sapiens
  misc_feature: GYAE6OF01DU7LX.31.78.H01.1.454.CMB.1.raw
  modified_base (325)..(325): a, c, t, g, unknown or other
  misc_feature (325)..(325): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagttccagacctccctggctgtgtctcgtgggcgaggaggccaccatcaactgcaagtccagccagtagttgttttattcggccccaacaataacaactacttagcttaggaccagacaagaaagtaggacacgccctacctaaactcctagtatttacgnggtccttcgaccgggctacgtcccgggttacctaaccgattcgagttcggcaggcgggtcgtgggaccctatttccactcctacaccatcgagcacgcctgcaggctagaagatgtggatagtttatacgtagtctaatcaactattacttactttctttacgttcttaccgtttcgggacgggtacgggaacgtaaggttggaaggtaacgtaacgtaaaccggtaacgttgggtcgggtacctaggtacctacccgtacttcctttcgtcctttaccttacccg

SEQ ID NO: 63927 - DNA, 751 bp, Homo sapiens
  misc_feature: GYAE6OF01EJ30O.31.78.H01.1.454.CMB.1.raw
  modified_base (722)..(722): a, c, t, g, unknown or other
  misc_feature (722)..(722): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagttccagcctccctggctgtgtctcgtgggcgaggacgggcccacatccaatgacaagtccagccaagtagttgtttttagttcggacccctaataaactaactaactacttagtcttaggaccctagacgtaagaaagtacggacacgtaccctaactaacctcgtagttacgttacggtcggtaccttacccggtaccggacgttaccgggttcccgggttaaccctaacgtcttacgtaggttcggacgtcgggtccggtaccggtcggaaccctttattaccgacttacccgtacctaccgtacgtacaccggtaccgtacctccggtacggagtacggtacgtaaaggtacgtggttacgggaccggtttaatttacggttttaactcggttacctactaaacggtaaccttaacttaactttttccgttaaccgttttcgtacccgttaacgtttaccggggttaccgggaaccgggtaacgtaaccggtaagggtccgtaaagtaacccgtacggtaaacgtggtccgggactcctacgaacttaccgtnttacccttaggttccctccggttaccccg

SEQ ID NO: 63928 - DNA, 761 bp, Homo sapiens
  misc_feature: GYAE6OF01CKHDU.31.78.H01.1.454.CMB.1.raw
tcagcagtagacgtcacgaccggtgctcgatttagtgtgagtagtttgggtttgggggagctacaacaggcaggcaggggcagcaagatggtgttgtagacccaggtcttcatttctctgttgctctggatctctggtgcctacggggacatcgtgatgagccagtttccagacctccctggctgtgtctcgtgggcgaggacgggccaaccatacaactgacaagtccagccaagtagttgttttaattccggacccctaactaaactaaactaaaccttaacttaacgtcgttacggtaaccaaggacctaaaggtaaaaggtaacggaacacgtaccttaaccctaaaactccgtagtactttaacgtcgggtccttaccggtacccgggctaacggttccccggggttacctaaaccggtacttcgtaagttcggcgtacggtccggggttcgtacggggtaccctagtttaccaacttcctaccgtaacctatccaacgcacgtcctgacctaggactacggaagtagttggtacggtacttaaggtttaacttacgtcgtacgtacgaactaaacttaatttaacttaccgtttacctttcgtaccgttaacggttcgggaccggtaacggggtaacccgtaagggtacggtaacggtaaactaaccggaaaaccggtaacggttaggtaccggtacgttaccggacctaaacccgtatttacccgttagtttaccttccgtaccgtttaccccg

SEQ ID NO: 63929 - DNA, 769 bp, Homo sapiens
  misc_feature: GYAE6OF01EO9MK.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacaactactagcttggtaccagcaagaaagtaggacagaccctacctaaactcctagtattactgggctttccgtaacccgggcaacgttcccggggtttacccaaccgtatttccagttcgggaccaggtccggggttcgtcgggggtaacccgtacttttaccgaaccttccgtaccaacccgattccgaacggtcctaacgccccgttaggaccgtaacggggtacttaacggaaaacgtagttcgggtacggtaccgttaagtttttaacgtttaactcggttaccgaacgtaacctaaacgtaacttttaacctttaaacccgtttttcccgttttaccgttacccgttaaccgggttttacccggggaccggggtaaacggggtaacccgtaaaggggttacgggtaaacgtaaacgtaaccggtaaaaccgtaacggttacggttcgggtacttacggtaccccgtaaacccgttacttacccgttcggtttcccgttaccgttaacccg

SEQ ID NO: 63930 - DNA, 778 bp, Homo sapiens
  misc_feature: GYAE6OF01B50MR.31.78.H01.1.454.CMB.1.raw
  modified_base (357)..(357): a, c, t, g, unknown or other
  misc_feature (357)..(357): n is a, c, g, or t
tcagcagtagacgtcacgaccggtgctcgatttagtgtgagtagtttgggtttgggggagcgtacaacaggcaggcaggggcagcaagatggtgttgcagacccaggtcttcatttctctgttgctctggatctctggtgccgtacgggacatcgtgatgagcctagtttccagactcccgtggctgtcgtctcgtgggcgaggacgggcccacctataccaacttgaccaagtcccagcctagaggtttgttttacgttcggaccccaactaaagtaacaactacttacgacttcggtaaccagtacaaggaaagtaggacaacgtccctaacctaaacttcctagtatttaccgnggtctttaccgacccgggtctacggtcccggggttacctaaccggtattactaggttcggacgtagggtcgggtcgtcgggacccgttagtttccaaccgttcctaccgacctacgtcgaaccgtcgaacgtcccgtacgaccgtaacggtaccgtaggtaaaggtacgtgggtacggttaccgttaaggttttacttaaggttcgtacgtaacgtacctaaacttaacttttacttaaccgtttttacgtttccccgggttacttacccgggttttaacggggcgggtaaccgggttaacccgtaaagggggttccggtaaagtaaccgttaaacgggtaaaacccgttaagtcgggttaacggtccgtacgtaccgtaaccctacggttaaccttcgtttcccgttaccgttaaccccg

SEQ ID NO: 63931 - DNA, 609 bp, Homo sapiens
  misc_feature: GYAE6OF01C7QAL.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagactccctggctgtgtctcgtgggcgaggacgggccaaccatcaaactgacaagtccagccagagttgttttattcggcccaacaaataacaactactagcttaggaccagacaagaaagtacggacacgtcctacctaaactcctagtactttacgcgggtcttaccgtacccgggctaacggtcccggggtttaccctaaaccggtacttacgagttacggcaagggtcggggtctagggggaccctatttcacttctaccaaccatacagcacgctgcgagctagaagatgtgactagtttatacgtgtacagactaactattacttacttctttacgtctaacgtttcgggacggagggaaccgtaaggtcggaagtacgtaacgaaaacggtaactggtacggctagacctacctatctacgtcttcgtacc

SEQ ID NO: 63932 - DNA, 609 bp, Homo sapiens
  misc_feature: GYAE6OF01C0I7H.31.78.H01.1.454.CMB.1.raw
  modified_base (345)..(345): a, c, t, g, unknown or other
  misc_feature (345)..(345): n is a, c, g, or t
  modified_base (371)..(371): a, c, t, g, unknown or other
  misc_feature (371)..(371): n is a, c, g, or t
  modified_base (407)..(407): a, c, t, g, unknown or other
  misc_feature (407)..(407): n is a, c, g, or t
  modified_base (430)..(430): a, c, t, g, unknown or other
  misc_feature (430)..(430): n is a, c, g, or t
  modified_base (441)..(441): a, c, t, g, unknown or other
  misc_feature (441)..(441): n is a, c, g, or t
  modified_base (444)..(444): a, c, t, g, unknown or other
  misc_feature (444)..(444): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctcgtggtcgccgtacggggacatcgtgatgagccagtttccagacctccctggctgtgtctcgtgggcgaggacgggccaccatcaactgcaacgtccagccagagtttgtttattcggaccccaacaataacaacttacttagctttggaaccagacaagaaagtggacagccctacaactcctagtactttacgcggcttccgaaccgggntacggttcccgggtacctaaccggtnttcagttcggctacgggtcggtacgtcggggacctntttcactctcacatcagcagccngcagctgaagntgngactagttactactgtacagtactaatatttaactacctttcttaccgtcttaaccggttcgggaacggtagggaccgtaagggttcggaactagttaaacccggaaagtacggtacggcgtactaccggacctaactaacgttcgttccgttctcgttaccccg

SEQ ID NO: 63933 - DNA, 644 bp, Homo sapiens
  misc_feature: GYAE6OF01EXNMJ.31.78.H01.1.454.CMB.1.raw
  modified_base (241)..(241): a, c, t, g, unknown or other
  misc_feature (241)..(241): n is a, c, g, or t
  modified_base (338)..(338): a, c, t, g, unknown or other
  misc_feature (338)..(338): n is a, c, g, or t
  modified_base (363)..(363): a, c, t, g, unknown or other
  misc_feature (363)..(363): n is a, c, g, or t
  modified_base (411)..(411): a, c, t, g, unknown or other
  misc_feature (411)..(411): n is a, c, g, or t
  modified_base (444)..(444): a, c, t, g, unknown or other
  misc_feature (444)..(444): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagacctccctggctgtgtctcgtgggcgaggacgggccaaccatcaactgacaagtccagccagtagttnttttattcggccccaacaataacaactacttagcttaggacagcaagaagtagacagcctacctaactctagtattacgtggtcttccgtacccggntacggttccgggttacctaaccgtnttcagttcggctaggcgggtctggggaccctatttcacttcgacaccntcacgcacgccgtgacgtaggtactaggtaagngtggtaggtaccgttagtttactacgtactcggtaccacggtacctaagttaactttacgttacctttccgtttaccgttccgttacccgtttcgggaccggtaacggggtaaccgtaaggggtaggtaacgtaacgtaaccgaaacggtacgttcggtacggtctacggtacccactagttccgttcgttccgttaccg

SEQ ID NO: 63934 - DNA, 632 bp, Homo sapiens
  misc_feature: GYAE6OF01BZHX5.31.78.H01.1.454.CMB.1.raw
  modified_base (363)..(363): a, c, t, g, unknown or other
  misc_feature (363)..(363): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgaggacgggccaccatcaactgacaagtccagccagagttgttttattcggccccacaataacaactacttagcttaggtaccagcaagaaagtagacagcctacctaaactcctgactttacgtgggcttccgacccggtctacgtcccggggttacctaaaccgtnttacagttcggcgaggcgggttctcgggaccgtatttccgacttccctactacctataccaggtccacgcctacggcgacggctaggaagatggtggtctaagttttaacttacgtcgtacagtactaagtaatttaacttacctttcgtttcgtaccgttacgttttaccggacggggtaacggtaaccgtaagggtacgagtaactaaccgaaacgtacggtaggttcggaccgtacgacctaccattcctcgttccttctaacccg

SEQ ID NO: 63935 - DNA, 593 bp, Homo sapiens
  misc_feature: GYAE6OF01ENAT6.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagttgttttattcggccccaacaataacaactacttagcttggtaccagcaagaaagtaggacacgtcctacctaaactcctagtactttacgtgggtccttccgtacccgggctacgttcccggggttacctaaccgtattcagttcggcaggtcgggtctggggaccgtatttccgacttcctacaccatcaagtcagtcctgcaggcgtagaagtagtgtggtactaagtttattacgtgtcagtacaactatttacttactttcgtttacgttactacgtttcgggacgggacggtaccgtaagggtcggagtactacgaaacgtacgtgtcgctcgacctacctatcgtctctcgtacc

SEQ ID NO: 63936 - DNA, 682 bp, Homo sapiens
  misc_feature: GYAE6OF01DTJTC.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacaactacttagcttaggtaccagcagaaagtaggacagcctacctaaacctcctagtactttacgtcgggcttcgtacccgggtcacgttcccggggttaccctaaaccggatttccgagtttcggaccaggtcgggttcgtacggggaacccgtatttccgactccgttacaccgtatccaagtcaacgcctcgcgaggtctagaagacttggtacggtactaaggtttttacttaacgttgtaccgaagtacctaaactagtttaattacccttttaccgtttttaccgtacctttaacgttttccggggaaccgggtacgggtaaacccgtaacggggtggaaccggtaatacccgaaaaacggtaacgttgggttacgggacctaggacccgtaaccctattccgttacggtcctttcctaaccg

SEQ ID NO: 63937 - DNA, 606 bp, Homo sapiens
  misc_feature: GYAE6OF01E2XGX.31.78.H01.1.454.CMB.1.raw
  modified_base (200)..(200): a, c, t, g, unknown or other
  misc_feature (200)..(200): n is a, c, g, or t
  modified_base (391)..(391): a, c, t, g, unknown or other
  misc_feature (391)..(391): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagngggccaccatcaactgcaagtccagccagagttgttttattcggccccacaataacaactacttagcttggtaccagcaagaaagtaggacagccctacctaaactcctgatttacgtgggtccttcgtacccgggctacgtcccggggttacctaaccgattcattcggctaggcgggtctggggacctnttcactctcacatcagcacgcctgcaggctagaagagtgtaggtacttaagttttacttacgtcgttacagtacctaaactatttacttaaccttttcgtttccgttacgtttaccggtttcgggacgggtaacgggtaaccgaagggttcggaagtaacctacgaaaacgtagttggtcggtacgtgaccctaacacttcttcttcttctaccc

SEQ ID NO: 63938 - DNA, 802 bp, Homo sapiens
  misc_feature: GYAE6OF01DVBTT.31.78.H01.1.454.CMB.1.raw
  modified_base (776)..(776): a, c, t, g, unknown or other
  misc_feature (776)..(776): n is a, c, g, or t
tcagcagtagacgtcacgaccggtgctcgatttagtgtgagtagtttgggtttggggagctacaacaggcaggcaggggcagcaagatggtgttgcagacccaggtcttcatttctctgttgctctggatctctggtgcctacggggacagtcgtgatgagcctagttccagtacctcccgtggctgtgtctcgtggcgagacggccaccatcaacgtgaccaagtccagccaggtgttgttttacgttccggaccccctaacgtaaacttaaaccgtaaccttaacgtttacggtccgtttacggtaaccctaaggaccgaaggtaaaacggtacggaaccacggtcccttaacctaaacctcgtaggtaactttaccggtgggtcccttaccggtaccccgggactacggttccccggggttacctaaaccgtcttacgtagttcggaccgtacgggtccgggttacgtacggggaccttacgtttacccaacgtttcctaccgtaccctacgttaccgtaacggtccgtaacgtccccgtggaacccgtacgggtactaacgggaacggtaacgttcgggttaccggtaaccgtttagttttaacgttaccgtcgttacgacgttaaccgtaaacgttatttaaccgttacctttccgttaccgttaccttaccggtttacggaccgggtaacggtacccgtaaggggttagaaaccgtacgttaaccggaaaccggttacgttcggtaacgggcctaggacccctaacgttnttaccgttcgttcccgttcgtacccg

SEQ ID NO: 63939 - DNA, 825 bp, Homo sapiens
  misc_feature: GYAE6OF01AFF6E.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgaggagggccaccatcaactgacaacgtccagccagagttgttttattcggccccaacaataacaactacttagcttggtaccagcaagaaagtggacagtccctacctaaactcctagtactttacgtgggtccttaccgtaccccgggtctaacgtccccggggtttaaccttaaacccggactttccgtaaaggtttcgggaccgtaacgggccggggttaccgtacgggggtaacccgtacttttaccgaaccttccttaccgaaccctagttaccgaacgtccgacgtacccgtacggacgtaacgggtacttaacgggaaagttacgttcggttacgggacctttaacggtttttaacgttaaccgtacggttaccgaaggtaaccctaaaacttaacgttttaacctttaacccgttttcgttttaccggttacccgttaaaccggttttccggggtaaccgggggtaaccggggttaaccctaaacgggggttacggtaaaccgtaaacggttaaacccggtaaaaccggttaaacggttcgggttaacgggtacccgttaccggtaacccgtaaccctaacgttaccggttaccgtttacccgttttacgtaaaccccgg

SEQ ID NO: 63940 - DNA, 734 bp, Homo sapiens
  misc_feature: GYAE6OF01A7NT1.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagttgttttattcggccccaacaataacaactacttagcttgtaccagacaagaaagtagacagcctacctaaactcctagtactttacgtggtccttacgtacccgggctacgttcccggggttacctaaccggtattcgtagttcggacgtacggtcggggtcgtacggggtacccgtaatttccgaaccgtcctaccaacctagttaccgacggacctacgtcccttacggaccgacgggtactacggaaacggtagtcgggtacggtacttaaggttttaacttacgttacgttaccgtaacttacctaaacttaactttaacgttaccttttcgtttacccgttaccgttaaccggttttcgggaccggggtaacgggtaacccgtaaaggggttacgggtaaacgtaacgtaaccgtaaacggttaaacggttcgggtacgggtccgtaccgaccgtacccgttaacgttacccgttcgttacccgttacgttaacccg

SEQ ID NO: 63941 - DNA, 612 bp, Homo sapiens
  misc_feature: GYAE6OF01EXG0P.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgaggacgggccaccatcaactgacaagtccagccagtagttgttttattggccccacaataacaactactagcttggaaccagcaagaaagtacggacacgacctacctaaactccgtagtacttttaacgtcgggtacctttccgtaacccgggctacggttcccggggtttacctaaaccgtattccagttcggctaggccggggttactggggacccgtatttccaacgtctaccaccatccgagcacgtcctgcgagctagaactagtggtcggacttagtttactacgtgtacagtacaactattaacttacctttcgttctcttaccgttcggcggaagggacctaagggtgaacgataacgaaacgtaagtcggttacggctgacctaactattcgtcgttctgtacccg

SEQ ID NO: 63942 - DNA, 593 bp, Homo sapiens
  misc_feature: GYAE6OF01CTTEP.31.78.H01.1.454.CMB.1.raw
  modified_base (200)..(200): a, c, t, g, unknown or other
  misc_feature (200)..(200): n is a, c, g, or t
  modified_base (305)..(305): a, c, t, g, unknown or other
  misc_feature (305)..(305): n is a, c, g, or t
  modified_base (313)..(313): a, c, t, g, unknown or other
  misc_feature (313)..(313): n is a, c, g, or t
  modified_base (327)..(327): a, c, t, g, unknown or other
  misc_feature (327)..(327): n is a, c, g, or t
  modified_base (427)..(427): a, c, t, g, unknown or other
  misc_feature (427)..(427): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagngggcccaccatcaactgcaagtccagccagagttgttttacttcggccccacaataacaactactagcttggaccagcagaaagtaggacagcctactaaactcntatttacnggtcttcgaccggnacgtccgggttccaaccggtattcagttcggcgaggtcggggtctcgggaccgtatttcgactcctcacctatcagcacgctgcaggctagaacgtatgnggtctagtttactacgtgtacagacaactattactactttcgtttcgtctacgttcggacggtacgggaacctaagggtaggtaacgtacgtaaccgtaaaacggtacgttgggtcggtaccgttaggacctaccttacttaccgttgttcccgtttcgtaacccg

SEQ ID NO: 63943 - DNA, 693 bp, Homo sapiens
  misc_feature: GYAE6OF01CNXY1.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacgggacatcgtgatgacgtcctagtttccagtacctcccgtggctggtcgtctcggtgggcgaggacgggccaccgtacaactgactaagtccacgccaagtagtttacgttttacgtccggacccctaactaaactaacaacttacttagtcgtgtaccagacaaggaagtacggacacgacctactaaactctagtactttacgcggtaccttccgtaccggctacggtcccgggttacctaacggtcttcagttcggacgacggtcgggtcgtcgggtacctactttccaaccttcgactaaccgataccgacgtccaacgtcccgttgaccggtacgtacgtaacgggaagtaggttacggtacggtactttaagtttacttacgtgtaactagtaacttaagttaatttactttacttccgtttaccgtacgttacggttacgggacggaacgggtacgaagggtggaaacgtacctaacgtaaaaccggtcttgggacgttcgtaccgacttaactacgttcttagttccttcgtacctcccg

SEQ ID NO: 63944 - DNA, 135 bp, Homo sapiens
  misc_feature: GYAE6OF01E5BM5.31.78.H01.1.454.CMB.1.raw
  modified_base (123)..(123): a, c, t, g, unknown or other
  misc_feature (123)..(123): n is a, c, g, or t
  modified_base (128)..(135): a, c, t, g, unknown or other
  misc_feature (128)..(135): n is a, c, g, or t
tcagcagtagacgtcacgaccggtgctcgatttagtgtgagtagtttgggtttgggcacagcagccctgggctgcctggtcaaggctacttccacgtctactgctgagcgggctggcaaggcncatgnnnnnnnn

SEQ ID NO: 63945 - DNA, 775 bp, Homo sapiens
  misc_feature: GYAE6OF01BQICD.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacaactacttagcttggtaccagcagaaagtagacagcctactaaactcctagtactttacgtgggtccttccgtacccgggctacgttcccgggggttaccctaaaccggtatttccgagtttcggccacgggtccggggttacgtacgggggtaacccgtaatttttccgaaccgttcctaccctaaccctacgttaccaacggccgtaacggccccttaggaccgtacgggtaccttaggaaaacggtagttacgggttacgggtaccgttaaggtttttaactttaaccggtttacggtacctaacggtaacctaaaccttaattttaaccttaacctttttccgttttaccgttaccgtttaaccggtttttaccggggaccggggtaacggggtaacccgtaaaggggtagggtaaacggtaacttaaccggaaaaaccgggttaacgttgggttacgggaccttacgggaccctaacccggtatttacccggttcgttcctttaccgttaaccccg

SEQ ID NO: 63946 - DNA, 686 bp, Homo sapiens
  misc_feature: GYAE6OF01C62IV.31.78.H01.1.454.CMB.1.raw
  modified_base (331)..(331): a, c, t, g, unknown or other
  misc_feature (331)..(331): n is a, c, g, or t
  modified_base (429)..(429): a, c, t, g, unknown or other
  misc_feature (429)..(429): n is a, c, g, or t
  modified_base (452)..(452): a, c, t, g, unknown or other
  misc_feature (452)..(452): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagtcagttccagactcctggctgtgtctcgtgggacgagaggcccacctatcaactgacaagtccagccagtagttgttttatcgaccccacaataacactactagcttaggtaccagacaagaaaagtaggacacgacccttaaccgtaaacctctacgtattttaccgngggtccttaccgacccgggactaccgttacccggggtaccctaaacggtctctaacgttcggcctaacgggtccgggttaccgtacggggtaaacctntttccacctccgtacaacccgtntaccgacgtcaacgtccgtacgacgtacggacgttacggaagtacgtagggtaccgtacgttaacggttttacttacgtcggttactaacgtactaaacctagttttaacttaaccgttttcctttaccggtacgttaccgttcggaccgggtaggaccggtaagggtaggaacgtataccgaaaagtcgcggtagaccgtgacgtaccgtattcccgttagtccttctaaccg

SEQ ID NO: 63947 - DNA, 650 bp, Homo sapiens
  misc_feature: GYAE6OF01EGLQB.31.78.H01.1.454.CMB.1.raw
  modified_base (471)..(471): a, c, t, g, unknown or other
  misc_feature (471)..(471): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtcgccgtacgggacatcgtgatgacgcctagttccagtacctccgtggctgtcgtctcgtggcgaggacggccacatacaactgacaagtccagcctagtacgtttgttttacgtccgaccccaactaaactaactaacttacgttacgtcttacgtacagacgaaagtaagtacgactacgtacctacctaactctagtacttcgtcggtacttccggaccggctaccggttcccgggtacctaacgtctctagtcggacgtcgggtcggtcgtcgggtactacttccgactccacactatcgacgtcacgtcctgacgacggtcgtagaagngtcggtagtacttagtttacttacgtcgtacaacgtactaacttatttaacgttcctttacgttacgttaccttacggtttaccgggaacgggtacggtaaccggtaagggtacgtaacgtaacgtacgtaaacggtcgtacggtcgtcgtacacgtactcttacgttctctcgtaccg

SEQ ID NO: 63948 - DNA, 601 bp, Homo sapiens
  misc_feature: GYAE6OF01B5MIX.31.78.H01.1.454.CMB.1.raw
  modified_base (310)..(310): a, c, t, g, unknown or other
  misc_feature (310)..(310): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgtttattcggcccacaataacaactactagctggtaccagcagaaagtggacagcctacctaaactcctagactttacngggtcttccgtacccgggctacgtcccggggttacctaacgtacttctattggcaggtcgggtcgtgggaccgtattcgactctcacctatcagcagtcctgcgtaggctagaacgtatggtggtactaaggttttataacgtgttacagacaaactatttactactttctttaccgtcttaccgtttcgggacgggtaacggaaccgtaagggtacggaacgtaacgtaccgaaaacggtaacgtggtacggactacgacctaaccctatcctttgtccgttctaacccg

SEQ ID NO: 63949 - DNA, 629 bp, Homo sapiens
  misc_feature: GYAE6OF01DJMRR.31.78.H01.1.454.CMB.1.raw
  modified_base (423)..(423): a, c, t, g, unknown or other
  misc_feature (423)..(423): n is a, c, g, or t
  modified_base (610)..(610): a, c, t, g, unknown or other
  misc_feature (610)..(610): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctccggtgcctacgggacgatcgtgatgagccagtttccagactccctggctgtgtctctgggcgagagggccaccatcaactgcaagtccagccagagttgttttatttcggccccaaccaataacaaactacttagcttggtaccagacaagaaagtaggacagccctacctaaactctgtatttacgtcgggccttccgtacccggggcacggttcccggggttaccctaaccgattcagttggcgaggtcgggtctgggaccgtactttcactctccaccatccagcngcctgcaggtctagaagtgtacgtggtacctagttttactaacgttgtcagtaccaaatgttttaacttaccttttcgtttaccgttaccgttaccgtttacggggtacgggaagggtaccctaaggggttagaagtactaccgaaaacggtaactgggttcgactcggacaacccgtattccgttnttaccttcgtacttccccg

SEQ ID NO: 63950 - DNA, 653 bp, Homo sapiens
  misc_feature: GYAE6OF01E2X0A.31.78.H01.1.454.CMB.1.raw
  modified_base (278)..(278): a, c, t, g, unknown or other
  misc_feature (278)..(278): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagttgttttattcggccccaactaataacaactacttagcttgtaccancaagaaagtaggacacgcctacctaaactcctagtactttacgtcggcttccgtacccggctacgtccggggttacctaaccgacttacagttcggctaggtccggggtacgtagggaccgtactttcacttcctccacctactcagcacgtccctagcgaggctagaacgtagtgtacggacttagtttacttacgtgtacagactaactacttaacgttaacctttccgtttacgtaccttacgtttacgggaccgggtaacggggtaaccgtaaagggtacgggtaagaaacgttaacgaaaacccggtaagtacggttcgggaccgtacgaacccgtaacctacgttactaccgttccgttccgtaacccg

SEQ ID NO: 63951 - DNA, 688 bp, Homo sapiens
  misc_feature: GYAE6OF01CYD8L.31.78.H01.1.454.CMB.1.raw
  modified_base (352)..(352): a, c, t, g, unknown or other
  misc_feature (352)..(352): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgacgcctagtttccagacctccctggctgtgtctcgtgggcgagacggccacatcaactgcaagtccagccagtagttgttttacgtcgccccaacaaataactaactacttagcttcggtaccagacaagaaagtagacacgcctacctaaactcctagtactttacgtcgggtccttaccgtaccccgggntaccggttacccgggttaccctaaaccgtacttacgtagttcggccgtacgggtcgggtcgtacgggaccgttacttaccgtacctccgtaccaacccgtatccgacgtccaccggtccctggaccgtaaggtctaaggaacgttagtcgggtagttacgttaagttttacgttacgtcgtaacgtacgtaaccttaaattactttaacgtttaccttttaccgtttccggtaccttacgggtttcgggaaccgggtacggtaaccggtaggtaggaactacgtaaccgaacggtacgtggtcggactgacctaaccgtgttctctcttcctaccg

SEQ ID NO: 63952 - DNA, 751 bp, Homo sapiens
  misc_feature: GYAE6OF01AGEDG.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagtgttttattcggccccaacaataacaactacttagcttaggtaccagcagaaagtaggacagcctacctaaactcctagtactttacgtgggtccttccgtacccgggctacgttcccggggttacctaaaccgtattccgagttcggacctagggtccgggtccgtaggggtaccccgtatttcgaccttcctaccgaacctactccgacgccaacggtcccgtacggaccgacgggtctaacggaaagtacgttagggttagggtaccgttaaggtttttaacttaacgttacggttaccgaaggtacctaaaaccgtaacttttaacttaaccttttaccgtttccgttaccgttaacccggttttccggggtaaccgggtaacggggtaaacccgtaaggggttaacgggaaaggtaaaccgttaaaccggtaaaaccggtaacggttagggtaccgggtaccttacggtaaccctaacccgtaactttaccgttcgttaccgttaccgttacccg

SEQ ID NO: 63953 - DNA, 773 bp, Homo sapiens
  misc_feature: GYAE6OF01CK1VX.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagttgttttattcggccccacaataacaactactagcttggtaccagcagaaagtaggacagccctacctaaactcctagactttacgtcgggtctttaccgtacccgggctacgttcccggggttacctaaaccggtactttcgaatttcggccaacgggtccggggttcgtacgggggacccgttagttttccgaaccttccgtacccaaccctacttaccgaacgccgaaccgtcccgttcggaccgaacgggtccgttaacgggaaagtacgttgggtacgggtacttaaggttttttaacttaaccgttcgtaccgaagtaccctaaacttaactttttaacgtttaaccttttccgttttacccggttacctttaaccggttttccggggtaaccggggtaacggggtaaacccgtaaagggggttcgggtaaacgggtaacgttaaacccggaaaaaccggtaacggttacggttacgggtaccttacggaccctaaacccgttattacccgttacggttccctttaccgtaacccg

SEQ ID NO: 63954 - DNA, 656 bp, Homo sapiens
  misc_feature: GYAE6OF01ED9BT.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccacatcaactgcaagtccagccagtagttgttttatttcggcccccaacaataacaactacttagcttggtaccagcaagaaagtaggacacgcctacctaaactcctagtactttacgtgggtccttccgtacccgggctacgttcccggggttacctaaccgtattccagtttcggcaggtcgggtctgggacctatttccactctcacatcagcagcctgcgaggctaggaacgagtaggtcggacttagttttacttactgtaccagtacctaaactatttaacttacctttacgttttccgttaccttaccggtttccgggacgggtaacggggtaacccgtaagggttagggaacgttaaccgtaacggtaaaacggtaaccgttggttacgggccgttacggaccttaacccgtatttaccgttcggtttacccttcgttaacccg

SEQ ID NO: 63955 - DNA, 602 bp, Homo sapiens
  misc_feature: GYAE6OF01DDEBE.31.78.H01.1.454.CMB.1.raw
  modified_base (366)..(366): a, c, t, g, unknown or other
  misc_feature (366)..(366): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgaggacgggccaccatcaactgcaagtccagccaggtagttgttttatcggccccacaaataactaactacttagcttggtaccagcaagaaagtagacacgcctacctaaactctagtatttacgtcggcttccgtacccgggctacgttccggggttacctaaccgtnttcagttggcaggcgggtctcgggacgtattcacgtctcacctatcagcacgcctgcgagcgtagaagtgtggtggctaagtttacttactgtacagtactaactatttactactttctttacgtacttacgttcgggacgggtacggtaaccgtaagggtaggacgtaactacgtaaaacgtaacgttggtcggtacgtagaccctactaacttcgttcgttccgttcttacccg

SEQ ID NO: 63956 - DNA, 780 bp, Homo sapiens
  misc_feature: GYAE6OF01CTUQY.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagacctcctggctgtgtctcgtgggcgaggacgggcccaaccatcaaactgactaaagtccagccaggtagttgtttttattcggaccccaacaaataacaactactagcttaggtaccagacaagaaagtacggacacgcctacctaaactcctagtatttacgtcggtccttaccgtacccgggactacggttcccggggttaccctaaaccgtacttacgtagttcggcgtaacgggccggggttaccgtacgggggaacccttagttttccaaccttcctaccctaaaccctactaccgaacgaccgtaaccggtccgttacggccgaacgggtaccgtaagggtaaaacggtagttcgggttagggtaaccgtttaaagggtttttaacttaaccgttggtaaccaacggtaacctaaaactttaactttaacttttaaccctttttccgtttaccgttaccgttaacccggttttcggggaaccgggtaacggggtaaacccgtaaggggtacggaaacggtaactaaaccggtaaaacggtacgttaggtcggtactacgacccgaaccgttattcccgttcgtttcccttcgttaaccccg

SEQ ID NO: 63957 - DNA, 632 bp, Homo sapiens
  misc_feature: GYAE6OF01DWQIX.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagaggccaccatcaactgacaagtccagccagtagttgttttattcggaccccaacaaataacaactacttagcttggtaccagacaagaaagtaggacagtcctacctaaactcctagtatttacgtgggtccttccgtacccgggctaacgtcccggggttaccctaaccggtattcaacgttcggacagggtccggggttacgtacggggtacccgtatttccacgttctaccgaacctatcgagcacgcctgacgaggctagaagtatggtcgacgtaagtttactactggtcagtactaactattaacttactttctttcgtactacggtttcgggacggacggtacgtaagggtacgagtataccgtaaaacggacttggtcggacttacgaccctacgttacgttccttacggttccttcgtaacccg

SEQ ID NO: 63958 - DNA, 587 bp, Homo sapiens
  misc_feature: GYAE6OF01A25LG.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggccccacaataacaactacttagcttggtaccagcaagaaagtaggacagccctacctaaactcctgtatttacgtgggtcttccgtacccgggctacgttcccggggttacctaaccgattcagttcggcaggcgggtcgtcggggacctatttcacttctacaccatcacgcacgcctgcaggctagaagatgtggctagtttacttactgtcagacaactattattacttctttccgtacttacgtttccgggacgggtacgggtaccgagggttaggaagtactaacgtaaacgtagtaggtggtaccgtgacctacctataccttgttccttacgtaccg

SEQ ID NO: 63959 - DNA, 801 bp, Homo sapiens
  misc_feature: GYAE6OF01CO4ZD.31.78.H01.1.454.CMB.1.raw
  modified_base (193)..(193): a, c, t, g, unknown or other
  misc_feature (193)..(193): n is a, c, g, or t
tcagcagtagacgtcacgaccggtgctcgatttagtgtgagtagtttgggtttgggggagctacaacaggcaggcaggggcagcaagatggtgtgcagacccaggtcttcatttctctgttgctctggatctctggtcgccgtacggggacatcgtgagtgacgcctagtttccagacctcctggctgtgtcncgtgggcgaggaggccacatcaactgacaagtcccagaccgagtacgtttagtttttacgtccggacccctaaactaaattaaaacgaaaccttaacgttacggtactttaacgggtaaccaagaaccgaaaggtaaaacgggtaacggaccgtaaccgtaccccttaaccccgtaaaaaccttcccggtagttaacgtttttaccgacgggttaccttacccggtaacccgggtaccttaaccgggttacccggggtttaccccaaaccggtaactttcgtaacgtttcgggaccgtacggggtcccgggtacgttcgggggtaaacccgtaagtttttcccgaacgtttcctacccgtaaccacttaccgaacgccgaacgtcctcggaccgtagggactaggaacgtagttggcgggttacttagtttaacttacgtgtactacgaacctaaatgttaaacttccgtttacgtttacctacggttaccgtttcggggaacgttacgggaaccgtaaagggttacggactaaggtaaccgaaaacggttacggtacgtacggtaccggttacacgacccttaactccttgttacccttctaacccg

SEQ ID NO: 63960 - DNA, 780 bp, Homo sapiens
  misc_feature: GYAE6OF01BYD88.31.78.H01.1.454.CMB.1.raw
  modified_base (325)..(325): a, c, t, g, unknown or other
  misc_feature (325)..(325): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagactccctggctgtgtctcgtgggcgagagggccaccatcaactgacaagtccagccagtagttgttttatcggccccaacaataacaactacttagcttggtaccagacaagaaagtcgacacgcctacctaaactcctagtactttacgngggtccttcgtacccgggctacggttcccggggttacctaaccgtacttcgtaagttcggaccgtaagggtccggggttcgtacggggacccgttaacttttccgaccttaccgtaccctaacccaagttccacggtaccgacgtacccgttcggccgaaccgggtacgttaaggtaacggtacgttacgggtacggtacgtttaacgtttttaacgttaccggtttcgttacctaaggtaaccctaaacgttaactttaacgtttaccttttaccgttttaccggttacctttacccgggttttacgggaacccgggggtacgggtaaaccccggtaaggggttacggtaaacggtaacgttaaaccggtaaaaccggttacgttacgggtcggtaccgttcggtaaccctaacccgtaacgttaccgttacggtttccgttcccgttaacccg

SEQ ID NO: 63961 - DNA, 559 bp, Homo sapiens
  misc_feature: GYAE6OF01ECJBK.31.78.H01.1.454.CMB.1.raw
  modified_base (319)..(319): a, c, t, g, unknown or other
  misc_feature (319)..(319): n is a, c, g, or t
  modified_base (335)..(335): a, c, t, g, unknown or other
  misc_feature (335)..(335): n is a, c, g, or t
  modified_base (528)..(528): a, c, t, g, unknown or other
  misc_feature (528)..(528): n is a, c, g, or t
tcagcagtagacgtcacgaccggtgctcgatttagtgtgagtagtttgggtttgggggagctacaacaggcaggcaggggcagcaagatggtgttgcagacccaggtcttacatttctctgttgctctggatctctggtgcctacggggacatcgtgatgagccagtttccagactccctggctgtgtctctgggcgagagggccaccgatcaactgcaagtccagccagagtgttttacttggccccacaacttaacaactacttagcttggtaccagcagaaagtggacagcctactaaactccctaggatttacgngggtcttctaccgggnaactccggggttacctaaccgattcattggcagcgggttgtgggacctagtttccacttcgtccacctaatccaagcagcctgcaggctgaagatgtggctaggtttacttactgttcagcaatattaataacgttctttacgtctacctttcgggcggtaggacctaagggtgagataccgaaaacgattgnggctaggcctaccgattcgtgtcttctaacg

SEQ ID NO: 63962 - DNA, 833 bp, Homo sapiens
  misc_feature: GYAE6OF01EG7CX.31.78.H01.1.454.CMB.1.raw
  modified_base (397)..(397): a, c, t, g, unknown or other
  misc_feature (397)..(397): n is a, c, g, or t
  modified_base (423)..(423): a, c, t, g, unknown or other
  misc_feature (423)..(423): n is a, c, g, or t
  modified_base (466)..(466): a, c, t, g, unknown or other
  misc_feature (466)..(466): n is a, c, g, or t
  modified_base (493)..(493): a, c, t, g, unknown or other
  misc_feature (493)..(493): n is a, c, g, or t
tcagcagtagacgtcacgaccggtgctcgatttagtgtgagtagtttgggtttgggggagctacaacaggcaggcaggggcagcaagatggtgttgcacgacccaggtcttcatttctctgttgctctggatctcgtggtcgccgtacggggacagtcgtgatggacgcctagttccagtacctccgtggctgtcgtctcggtgggcgaggacgggcccaacataccaactgactaacgtccagaccaggttagtttcgttttacgtaccggacccctaactaaactaaacctaaccttaacgtacgtccttacggtaaccagacgaaaggtaaagtacgacaccgtaccctaacctaacgtctagtacgttacgtcggtacctaccggtaccggtntaccggttaccgggttacctaacgtnttacgtagtcggacgtacgggtcgggtacgtacgggtaccttnttaccgacgttacctaccgaaaccgtntacccgacgtaccgtaccggtccgtacggaccgtaacgggtacgtaaggtaaacgtacgttagggtaccggttaaccgtttaacggttttacttacggtacgtaaccgtaacggttaaaccttaacgtttaacttttaacccgttttaccgtttcccgttttaccgggttacccggttaaccgggtttacccgggggaacgggttaaccggggtaacccggttaaggggtaccgtaacgtaaaaccggttaaccggtaaaacggttacggttcgggttacgaccgtaacgtaaccctacccgtagtttacccgtttccttaaccgttcccgtttaacccg

SEQ ID NO: 63963 - DNA, 753 bp, Homo sapiens
  misc_feature: GYAE6OF01C2LFR.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagttgttttattcggcccacaataacactacttagcttaggtaccagacagaaagtaggacagcctacctaaactcctagtactttactgggccttcgtacccggctacgtccggggttacctaaccgattcaattggcacggtcgggtcgtacggggtacgtatttcgaactccgtacaccctaatccgaagtcgaacgtcccttcgaccgaagggtacctaaggtaaacgtaagttacggttgggtaccttaacgggttttaactttaaccgtaggttaccgtaacggtacctaaaaccttaacgttttaaacttaacccttttttcccgtttttaccgggtaccttaccgggtttttaacccggggaccgggttaacggggtaaacccgttaaaggggttaaccgggacgttaaaccggttaaccgaaaaacccgggttaaacgttcggggtttacgggacccgtttacggacccttaaacccggtaactttccggttacggttcctttaacccgtacccg

SEQ ID NO: 63964 - DNA, 557 bp, Homo sapiens
  misc_feature: GYAE6OF01B15Y5.31.78.H01.1.454.CMB.1.raw
  modified_base (551)..(551): a, c, t, g, unknown or other
  misc_feature (551)..(551): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctacctaaactcctagtactttacgtgggtccttccgtacccgggctacgtcccggggtttcctaaccgtattcgattggcaggcgggtctgggaccgtatttcactctcaccatcagcacgctgcaggctagaagctgtcggctagtttatactgtcagtcaaactattaacttacttcttcgtactaccgtttcggcggtagggaccgtaaggtggagaatacgaaacgtactggtcgctacgcctaccattctagttntcgtac

SEQ ID NO: 63965 - DNA, 689 bp, Homo sapiens
  misc_feature: GYAE6OF01DI3A6.31.78.H01.1.454.CMB.1.raw
  modified_base (596)..(596): a, c, t, g, unknown or other
  misc_feature (596)..(596): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgaggacgggccaccatcaactgacaagtccagccagagttgttttattcggccccaccaataacaactactagcttgtaccagcaagaagtagacagtcctacctaaactcctagtattacgtggtccttacgtacccgggctacgtcccggggttaccctaaccgtattacagttcggacgaggtccgggtctaggggaacctagttccaacgtctaccactatcgagtcacgtcctgccagggtcctaggaacgtacgtggtacggacttaagttttacgttacgtgttaccaacgtactaaacttagtttaacttaccttttacgtttaccgttacgttaccgttttacgggacgggtaacgggtaacccggtaaacgggtgggtaaaccggttaanaacccgttaaaacggtaaacgtttcgggtaacggtaccgttacgacccgtaaccttaacgttccgtttacgttacccgtttaccgttaacccg

SEQ ID NO: 63966 - DNA, 701 bp, Homo sapiens
  misc_feature: GYAE6OF01C49DL.31.78.H01.1.454.CMB.1.raw
  modified_base (365)..(365): a, c, t, g, unknown or other
  misc_feature (365)..(365): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactcctggctgtgtctcgtgggcgagacgggccacatcaactgacaagtccagccagtagttgttttattcggccccacaataacactactagcttggtaccagacaagaaagtaggacacgcctacctaactcctagtactttacgtggtccttaccgtacccgggctacgtcccggggttacctaaccgtnttccgtagttcggccagggtccgggtcgtacggggaccgttactttcaactctaccacctatccgagccgaacgtcccgtggaccgacggtaccgtaggaaacgtagttgggtacggtacgttaagttttacgtaccgttcgtaccgtaagtacctaaacttagttttaaccgttacctttcgttttaccgttccttaaccggttttccggggaacggggtaccgggtaaccgtaagggttcgggaaacgtacgttaaacccggaaacggtacgttagggtccggaccgttcggacccttaccgtactttacgtcgtttcccgttagttaccccgg

SEQ ID NO: 63967 - DNA, 587 bp, Homo sapiens
  misc_feature: GYAE6OF01DKR23.31.78.H01.1.454.CMB.1.raw
  modified_base (323)..(323): a, c, t, g, unknown or other
  misc_feature (323)..(323): n is a, c, g, or t
  modified_base (398)..(398): a, c, t, g, unknown or other
  misc_feature (398)..(398): n is a, c, g, or t
  modified_base (504)..(504): a, c, t, g, unknown or other
  misc_feature (504)..(504): n is a, c, g, or t
  modified_base (575)..(575): a, c, t, g, unknown or other
  misc_feature (575)..(575): n is a, c, g, or t
  modified_base (580)..(580): a, c, t, g, unknown or other
  misc_feature (580)..(580): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgacgcctagttccagactcctggctgtgtctcgtgggcgagacgggccaccatcaactgcaagtccagccagagttgttttatcggccccacaataacacgtacttagcttggtaccagacaagaaacgtaggaccagcctacctaaactccgtagtatttacgngggtccttcgtaccgggctaacgtcccggggttccctaaaccgattcattggacaggtcggtctaggggtacctntttccactctacacctatcacgcacgccctgccgtaggctaggaagactgtcggacttaggttttactacgtgtccaagacctaactatttaacgtctttcgttcnccgttaagtttcggacgggaggtacctaagggtggatactaacgaaaacgcttggcgctgacctaaccgtntcgtntctcgac

SEQ ID NO: 63968 - DNA, 666 bp, Homo sapiens
  misc_feature: GYAE6OF01CS4DE.31.78.H01.1.454.CMB.1.raw
  modified_base (333)..(333): a, c, t, g, unknown or other
  misc_feature (333)..(333): n is a, c, g, or t
  modified_base (377)..(377): a, c, t, g, unknown or other
  misc_feature (377)..(377): n is a, c, g, or t
  modified_base (435)..(435): a, c, t, g, unknown or other
  misc_feature (435)..(435): n is a, c, g, or t
  modified_base (505)..(505): a, c, t, g, unknown or other
  misc_feature (505)..(505): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctcgtgggcgagacgggccaccatcaactgcaagtccagccagtagttgttttacgttcggaccccacaaataacctaactacttagcttacggtaccagacaagaaagtaggcagtccctacctaaactcctagtactttacgnggtcctttcgacccgggctacggttcccgggttacccaaacgtnttcaagttcggcacggtcggggtctcgggactagttcctacgtctacaccgtatcgancacgtactcgcgtacggatacgaaagtgtacgtggtacttaagtttacttacgtgtactaagctaaagtntttaactacgtttcctttacgtcttaccggtttcggggacggtacggtaaacccggtaaggtacgggtaaacgtacgttaacccgtaaaaacggtagttacggtacgggtccgttaccgtaactacccgttagttccgttaccttcgtttcgttaaccccg

SEQ ID NO: 63969 - DNA, 603 bp, Homo sapiens
  misc_feature: GYAE6OF01CWUT3.31.78.H01.1.454.CMB.1.raw
  modified_base (300)..(300): a, c, t, g, unknown or other
  misc_feature (300)..(300): n is a, c, g, or t
  modified_base (316)..(316): a, c, t, g, unknown or other
  misc_feature (316)..(316): n is a, c, g, or t
  modified_base (328)..(328): a, c, t, g, unknown or other
  misc_feature (328)..(328): n is a, c, g, or t
  modified_base (359)..(359): a, c, t, g, unknown or other
  misc_feature (359)..(359): n is a, c, g, or t
  modified_base (376)..(376): a, c, t, g, unknown or other
  misc_feature (376)..(376): n is a, c, g, or t
  modified_base (408)..(408): a, c, t, g, unknown or other
  misc_feature (408)..(408): n is a, c, g, or t
  modified_base (584)..(584): a, c, t, g, unknown or other
  misc_feature (584)..(584): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctcttgttgctctggatctctggtgccgtacgggacatcgtgatgagcctagtttccagctcctggctgtgtctcgtgggcgaggaggcctacactcaactgacaacgtccagccagagtttgtttacttcggacccacaaataaccaactacttagcttaggaaccagacaagaaagtaggacncgtcctaacaactcgngtaactttacgnggtctctaccggcaagtccgggtactaacgnttcatggacagcggtcncggacgattcgacttcacacagtccaagccanccgtgacgtagacgtgaaagtagttcggttactcgttagtttacgttactcggttacgagtaacaacgtaatttaacttaccttaacgtttttcgaccttaaccgtttcgggaccggacggtaacgtaaggtagagtactaacgaaaccgtacttagcggacttgacctaaccctnttcctacgcttacggtacc

SEQ ID NO: 63970 - DNA, 714 bp, Homo sapiens
  misc_feature: GYAE6OF01B54TC.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagactcccgtggctgtcgtctcgtgggcgaggacgggcccacatcaactgcaagtccagccagtagttgttttattcggaccccaacaataacaactacttagcttggaccagacaagaaagtaggacacgcctacctaaactcctagtaactttacgtgggtcctttcgtaccccgggctacggttcccggggtttaccctaaccggtattcgaagttcggacagggtcgggttcgtacgggacctacgttttcaccgttctacccaacctactacgacgtccaaggtccctaggaccgacggtccgtaggaaacgttacgtggttacgggtactttaagttttaacttacgtcgtacctaacgtactaaaccttagtttaacctttaccgtttccttttaccgttaccgttaaccggtttcccgggaaggggtaccggtaaccggtaagggtcggaagttaaccgtaacgaaaaccggttagtacgggtcggtacgtacgtacccgtaaccttacttcccgttacgttcctaccgttaccg

SEQ ID NO: 63971 - DNA, 731 bp, Homo sapiens
  misc_feature: GYAE6OF01D2MMN.31.78.H01.1.454.CMB.1.raw
  modified_base (130)..(130): a, c, t, g, unknown or other
  misc_feature (130)..(130): n is a, c, g, or t
tcagcagtagacgtcacgaccggtgctcgatttagtgtgagtagtttgggttgggggagctacaacaggcaggcaggggcagcaagatggtgttgcagacccaggtcttcatttctctgttgctctaggntctctggtcgccgtacgggacagtcgtgatgacgcctagtttccagtcctccctggtctgttcgtctcgtggcgaggacggcccacatcaactgacaacgtccagaccagtagttgttttactccggacccctaactaaactaaccaacttaactagtccgttacggtacacgacgtaaagaaacggttggaacctacgtaccccttacctaaaacttcccgtagttactttaccgtcggtcctttacccggtacccgggactacggttccccggggttaaccttaaccgtacttccgtaggttccggactaccgggtcgggttccgtacgggtaaccttcgttaccgtcctaccctaccgtacctacgtcccgaacgccgtaccgtccgtcggcgtaacggaccgttaggaaacgttcgtggttacgtccgtttaagtttcttacggtacgttcgtaacgtacctattaacgtttacgttaacctttcggtttacctacgttaccggtttcgaccgggtacggtaaccggtacggttaggaacctacgtaaccaacggtacgtggtcacgtacgcacgttactacgtctacctgttaccc

SEQ ID NO: 63972 - DNA, 629 bp, Homo sapiens
  misc_feature: GYAE6OF01D8XJM.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagttccagactccctggctgtgtctcgtgggcgagacgggcccaccatcaactgaccaagtccagccagtagttgttttattcggccccaacaataaacaactacttagtcttggtaccagcaaggaaagtaggaacacgtcctacctaaactccgtagtactttacgtcggtaccttcgtaccccgggctacgttcccggggttacctaaccgtacttcgagttcggcgtagggcgggtcgtacgggaccgttatttccgactctacgaccatcacgcacgtcctgcgagctagaagtagtgtcggtactaagtttactacgtgtacacgtactaactattaacttacttcttacgtcgttacgtttcgggacggaacgggtaccgtaagggtacggacgtaacgtacgaaaacggttacgtggtacgcgtacgaccgtactactcgttctcgttctaacccg

SEQ ID NO: 63973 - DNA, 766 bp, Homo sapiens
  misc_feature: GYAE6OF01AHC8P.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctcgtgggcgaggacgggccaccatcaactgcaagtccagccagtagttgttttacttcggaccccaacctaataacaactacttagcttggtaccagacaagaaagtaggacagaccctacctaaactcctagtactttacgtgggtccttaccgtaccccgggctacggttccccggggttacctaaccggtattacctagttcggccgtacgggtccggggttcgtacggggtaccccgtaagttttccaaccgttcctaccctaaccgtacgttaccacggtacccacggtccctagggtaccgaagggtccctaagggtaaacggtacgttcgggttacggtactttaacggttttaacttaaccgtcggtacctaacggtaacctaaacttaacgttttaaccttaccgttttaccggttttaccgttacccgtttaaccgggttttccgggaaccggggttaacggggtaacccgtaaagggggttcgaaccgtaactaaccggaaacgttaccgtagggtccggtacctacggacccttaccgacttccgtagtttcccttgttaacccg

SEQ ID NO: 63974 - DNA, 566 bp, Homo sapiens
  misc_feature: GYAE6OF01BQZY3.31.78.H01.1.454.CMB.1.raw
  modified_base (308)..(308): a, c, t, g, unknown or other
  misc_feature (308)..(308): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctatgtctctgggcgagagggccaccatcaactgcaagtccagccagagtgtttattggccccacaataacaactactagctggtaccagcagaaagtaggacagcctactaaactcctgatttacngggtattcgtaacccgggctagtcccggggttcctaaccgacttcaagttggcctagcgggtactgggaccgtatttcactctcaccatcagcagcctgcaggccaagatgtagcagtttattactgtcagtcaactattactacttctttccgtctacttttcgggacggagggtaccaaaggtggtaacgtataccgaaaacgaaccgttgtaggcctagtccaacccgtaattccgtagttacttcgtactcccg

SEQ ID NO: 63975 - DNA, 785 bp, Homo sapiens
  misc_feature: GYAE6OF01BAOGA.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagtagttgttttattcggaccccacaataacaactacttagcttaggtaccagacagaaagtagacacgcctacctaaactcctagtactttacgtgggtccttccgtacccggggctacgttcccggggttacctaaccggtattccgagttcggacgacgggtcgggtccgtcggggtacccgtatttccgaccttccgtaccctaaccgtaattccgaacgtaccgaccgtacccgttacgggaccgaacgggtaccgttaaggaaaacggtacgttacgggttacgggttacctttaaacgggttttttaactttaaccgtttcggttaccgtaaccgtaaccgttaaaaccttaattttaaccttttaacccgtttttacccgtttttacccggttaccgtttaacccggttttccggggaaccggggtacggggttaacccggtaaaggggttacgggtaaagtaaccggttaaacgtaaaaccggtaacgttacgggtcgggtaccgtacggaccctaaccgtacgttaccttcggttccttaccgtaccg

SEQ ID NO: 63976 - DNA, 752 bp, Homo sapiens
  misc_feature: GYAE6OF01A99YQ.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccacatcaactgcaagtccagccagagttgttttattcggccccacaataacaactacttagcttggtaccagcaagaaagtggacagcctacctaaactcctagtactttacgtgggtaccttccgtaccccgggctacggttccccggggtttaccctaaccggtatttcctattcgggaccagggtcccggggttcgttacggggaccccgttattttccaaccttcctccgaacctactccacgtcgaacgtcccgtgaccgacgggctaggaacgtagttcggttaggtaccgttaaggttttaactttaccgtcgggttccaaggaccttaaacgtaatttttaaccttaacctttttcccgtttacccgttaccgttaacccgttttacgggggacccggggtaacgggtaacccgtaaagggggttacgggtaaagtaaccgttaaaccggaaaaccggttaaccggttacgggtcgggtacccgttacggacccctaaaccgttccgtttaccgttcggtttaccctttacccgtaccccg

SEQ ID NO: 63977 - DNA, 631 bp, Homo sapiens
  misc_feature: GYAE6OF01C5YQL.31.78.H01.1.454.CMB.1.raw
  modified_base (380)..(380): a, c, t, g, unknown or other
  misc_feature (380)..(380): n is a, c, g, or t
  modified_base (476)..(476): a, c, t, g, unknown or other
  misc_feature (476)..(476): n is a, c, g, or t
  modified_base (602)..(602): a, c, t, g, unknown or other
  misc_feature (602)..(602): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctgggtgcctacggggacatcgtgatgagccagtttccagactccctggctgtgtctctgggcgagagggccaccatcaactgcaagtccagccagtagttgttttattcggaccccacaataacaactacttagcttaggtaccagctaagaaagtaggacacgtcctacctaaacctccttagtacttttaccgtcgggtctttccgtaccccgggctacggttcccggggttaccctaaccgtntttaccgagtttcggcgtaacggcggggttcgtcgggggtaacccgtatttccaccgttctacgacctagtcagcacgtcctgcgaggctagaagntggtggctagttttatacgtcgtcacgtacaactattattaccttctttcgtactaccgtttcgggacggtacgggaccgtaaggtacggacgtacgtacgaaaacgtacgttggtacggccgtanccgtacctattacttcgttcttcgtaccg

SEQ ID NO: 63978 - DNA, 598 bp, Homo sapiens
  misc_feature: GYAE6OF01B60GV.31.78.H01.1.454.CMB.1.raw
  modified_base (199)..(199): a, c, t, g, unknown or other
  misc_feature (199)..(199): n is a, c, g, or t
  modified_base (362)..(362): a, c, t, g, unknown or other
  misc_feature (362)..(362): n is a, c, g, or t
  modified_base (581)..(581): a, c, t, g, unknown or other
  misc_feature (581)..(581): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagngggccaccatcaactgcaagtccagccagagttgttttattcggccccacaataacaactacttagcttggtaccagcaagaaagtaggacagcctacctaaactcctagtactttacgtgggtcttcgtacccgggctacgttcccggggttacctaaccgnttacagttggcgaggtcgggtcgtgggaccgtatttcgactctcaccatcagcagcctgcaggactggaagtagtgtggtactagttttatacgtgtacagacctaactactttatacctttctttaccgtcttacggtttcggacgggtaagggaccgtaaagggtggaacgtacgtaaccgtaaacggtaacgtggtcggctacgacctactacgtnttcgttccttcgtaccg

SEQ ID NO: 63979 - DNA, 708 bp, Homo sapiens
  misc_feature: GYAE6OF01CMMCK.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgaggagggccaccatcaactgcaagtccagccagagttgttttattcggccccacaataacaactacttagcttggtaccagcaagaaagtaggacacgccctacctaaactcctgtactttacgtgggtccttcgtacccgggctacgttcccggggttaccctaaaccggtattcagttcggacgtaggtccggggttcgtacggggtaccgtactttccaaccttcctaccaaccctacgttcacggcctacggcccgtgccgacgggaccttaggaaaggtacttagggtcggtacgttaaggttttaacttaccgttacgtaccgtaacgtacctaaacgttaacttttaacttaacccgttttccgttttccgttaccgttaaccgttttccggggacgggtaacgggtaaccgtaaggggttacggaaggtaactaccgaaaacggtacttcgggttcggaccgtcgacctaacccgtaacttcgttcgttcctttacgtacccg

SEQ ID NO: 63980 - DNA, 735 bp, Homo sapiens
  misc_feature: GYAE6OF01BO8UT.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgaggacgggcccaccatcaactgcaagtccagccagagttgttttattcggccccacaataacaactacttagcttaggtaccagcaagaaagtaggacacgcctacctaaactcctagtactttacgtgggtccttccgtacccgggctacggttcccggggttaccctaaaccgtactttcgacgtttcggaccgtacgggtcggggttccgtacggggtaaccccgttattttcccgaccgtttcctaccaacccctagttaccgaacggtcctacgcccgtacggaccgacgggtccgtaggaaacgtacgttcggtacggtacgttaaggttttaacttaccgtgttaccgaacgtacctaaacgttatttaactttaccttttacgtttaccgttaccttaaccggttttccgggacgggtaaccgggtaaccgtaagggtcggtaaacgtaacgttaaccgaaaaccggtaacgttcggtacggtacctaccggaccgtaacccgtattaccgttcgttccgttccgtaccg

SEQ ID NO: 63981 - DNA, 844 bp, Homo sapiens
  misc_feature: GYAE6OF01DQJDL.31.78.H01.1.454.CMB.1.raw
  modified_base (480)..(480): a, c, t, g, unknown or other
  misc_feature (480)..(480): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtcgccgtacggggacatcgtgatgacgcctagtttccagacctccgtggctgtcgtctcgtgggcaggacggccaccataccaactgaccaacgtcacgaccgagtagtttacgttttacgttacccggacccctaaacctaaataaacctaaccttacgttacgtcgttacggtaaccagacgaaaggaagtacggacctacgtacccttaacgtaaacctcgtacgtactttacgtcgggtaccttaccggtacccgggtactaccgggttcccgggttaaccctaaccgttcgttacgacgttcggacgtacggtcggggtaccgtcgggtaacccgttntttacccgactccgtacacccgtatacgacgtaccgacgtcccgtaggcgtaacgggtactaagggtaacgtaggttcgggttacggtacgttttaacgttttaacgttaccgttacggttaaccgtaacgtaaccgtttaaaactactttttaaccgtttaacctttttcccgggtttaccccgtttacggtttaaacccgggtttcgggggaaacccggttaacggggtaacccggttaaagggttccgggaaagttaaacccgttaaaacggtaaaacccggggttccgtaaggggttcccggtaccgtaaccgaaccgtaacctttcggtaccgtttaccgttactttacccgtaccccg

SEQ ID NO: 63982 - DNA, 777 bp, Homo sapiens
  misc_feature: GYAE6OF01C79T0.31.78.H01.1.454.CMB.1.raw
  modified_base (416)..(416): a, c, t, g, unknown or other
  misc_feature (416)..(416): n is a, c, g, or t
  modified_base (481)..(481): a, c, t, g, unknown or other
  misc_feature (481)..(481): n is a, c, g, or t
tcagcagtagacgtcacgaccggtgctcgattagtgtgagtagtttgggttgggggagctacaacaggcaggcaggggcagcaagatggtgtgcagacccaggtcttcatttctctgttgctctggatctctggtgccgtacggggacatcgtgatgacgcctagtttccagtacctccctggctgtcgtctcgtgggcgaggacggccacatcaactgacaacgccagaccaggtagtttcgttttagttccggaccccaacctaaataacctaacttacgttacgacgttacggtaaccagtacctaaggaaaagtacggacacgtacccttacctaactccgtagtaactttacgcgggtcctttaccggacccgggctaaccggttcccgggttacctaaaccgtgttaccngttacggccgtacgggtccggggtcgttacggggaccttactttccgaccttccgtaccaacctntaccgacgtcaaccggtccctaggaccgtagggtacctaaggtaaacggtccggttaggtcgggtactttaaggttttaactaccggtagtaccgaacgtacctaaacgtttaacgtttaactttacccgtttcccgttttaacgtaccgtttaccggtttacggggggacccggttaaggggaacccgttaagggggtaacgtaccgtaaaccgtaaccggtaaaaccgttacgggttggtccgggtactacgaacccgtaccttagtttccgtaacgtttccctccgttaaccc

SEQ ID NO: 63983 - DNA, 786 bp, Homo sapiens
  misc_feature: GYAE6OF01CUH0S.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagacctccctggctgtgtctcgtgggacgaggacgggcccaccatcaactgacaacgtccagcctagtagttagtttttacgtccggtaccccaaccaaataaacctaacttaacttacgcttacggtaccagactaagaaagtacggacagccctacctaaactctagtactttacgtggtccttccgtacccgggcttacggtcccgggttacctaacgtacttcacgttggcgaggtcgggtacgtcgggaccttactttcacttaccgtacaccgtactaccgacgtcctaccggtcccgtaggaccgtacgggtactagggtaaacgtcggttagggttaccggtactttaacgggtttttaacttaccccgtagggtttaacccaacgggttaaccttaaaaccccgttaagtttttaaacccgtttaaccccgttttccgttttaaccccggtaccgtttaacccggttttccgggggaaccgggtaccgggtaaaccggtaaaggggttacggaaacgttaacgtaaaccggtaaaacggtacggttacggtacggaccgttcggtaaccacccgttattaccgtacttccgttacgttaaccccg

SEQ ID NO: 63984 - DNA, 726 bp, Homo sapiens
  misc_feature: GYAE6OF01AJ9WE.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggccccacaataacaactacttagcttggtaccagcaagaaagtaggacacgcctacctaaacctcctagtactttacgcgggtccttaccgtaccccgggctacggttcccggggttacctaaccgtattcagttcggaccaggtcgggtcgtacggggacccgtatttccgaacgttcctaccaaccctataccgacgactacgtcccttaggaccgaacgggtctaaggaaagtacgttcgggtacggtacttaaggttttaacttaccgttcgtacctaacggacctaaacttaacgttttaacttaaccttttcccgtttacgttacccgttaaccggttttccggggaacgggtaacggggtaaacccgtaaggggtcggtaaacgtacttaaacccggtaaaacggtacgttcgggtacggtaccgtaacgaccctaacccgttaagttcccgttaggtttacccttacccgtacccg

SEQ ID NO: 63985 - DNA, 674 bp, Homo sapiens
  misc_feature: GYAE6OF01A68OA.31.78.H01.1.454.CMB.1.raw
  modified_base (405)..(405): a, c, t, g, unknown or other
  misc_feature (405)..(405): n is a, c, g, or t
  modified_base (653)..(653): a, c, t, g, unknown or other
  misc_feature (653)..(653): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagacctcctggctgtgtctcgtgggcgaggacggcccacatacaactgacaagtccagccagtagttgttttacgttccggaccccaactaaataaacctaaccttacgttacgtcgttacggtaccagaccaaaggaaagtacggacacgtaccctacctaaacctcctagtaactttacgtcgggtaccttaccggtacccgggctaccggttcccgggttacctaaccgtnttacagttcggcagggtcggtcgtacgggtacctattccactcctcacgactcgacgcacgcctgcgaacgtcgtagaagtgtcggtgtacgtttagttactacgtgtaccgtaagacctaaacttatttaactttaccttttcctttacggtaccttacgggtttccgggacgggtaacggtaaccgtaaggggtagaacgtaacgtaacgtaaacgtacgttggtacgcgtacgaccttaaccgtntaccgttgtccttacgtaccg

SEQ ID NO: 63986 - DNA, 912 bp, Homo sapiens
  misc_feature: GYAE6OF01DK25U.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctcgtggtcgccgtacggggacatcgtgatgacgcctagtttccagacctcccgtggtctgtcgtctcgtcgggcgaggacgggacccaaccatacaactgaccgaacgtccgacgaccgtaggttacgtttggttttacgtttaccggacccctaaacctaaaataaacctaaaccttaacgtttacgtaccgtttacgggtaacccgtagaccgaaaaggtaaaacggtacggaacctacgtacccttaacccgtaaaaccttcccgttaagttacgttttaacggtccgggttaccgtttacccgtacccgggtaccgtaaccggtttaccccgggggttaacccttaaacggtacttacgtagttacggacgtacgggtccgggtacgtacggggaaccttcttaccgaccttactaccaacctagtaccgagtccgtaaccgtccgtacggtacgaacgggtactaacgggtaagtaacgttcggtacgggttaactttaacgttttaaacgttcgtaacggtaccgtaaacgtaaccttaaacttaacgtttttaaccgtttaaccttttcccggttttacccgttaacggtttaacccgggtttacgggggtaacccgggtaacggggtaaacccgtaaggggttaacggtaaacgtaaaccgttaaaacccggtaaaacggttacggttacgggtaccggtacccgttaacggtaacccctaaaccgttacgtttaacccggtaccggttttaccttaacccggtttaacccc

SEQ ID NO: 63987 - DNA, 764 bp, Homo sapiens
  misc_feature: GYAE6OF01B4D1Q.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacgggcatcgtgatgagccagtttccagacctcctggctgtgtctcgtagggcgagacggccaccgtatcaactgcaagtccagccagagttgttttattcggaccccaacctaataacaacctacttagtcttcggtaccagcaagaaagtagacagtaccctacctaactcctagtacttttacgtcgggtacctttccggtaacccgggctacggttacccgggggttaccctaaaccggtctttaccgagtttacgggacctaacggggtcggggttaccgtacgggggtaaccccgttaagtttttcccaaccgtttccttacccaaccctactacgaacgtccgacgtaccgtcggaccgtagggtcctaggaaacgtacgttacggttacggtactttaggttttaaccttacgtaggttaccgaagtacgtaaacttaactttacgtttaaccttttccgtttacgttaccgttaccggttttaccggggaaccgggtaccggtaaccggtaagggttcgggaaacttaacgttaaaccggtaaacgttaacgttgggtaccggtacgtacgaacccgttaccgtacgttaccgttacgttccttaccggtacc

SEQ ID NO: 63988 - DNA, 685 bp, Homo sapiens
  misc_feature: GYAE6OF01BASNI.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagacggccaccatcaactgcaagtccagccagagttgttttattcggccccacaataacaactacttagcttggtaccagcaagaaagtaggacagaccctacctaaactcctagtactttacgtgggtccttcgtacccgggctacgtcccggggttaccctaaccggtattacgtagtttcggctaggtccgggtctggggacccgtatttccaccgttctacaccgatccgagccacgtccctgcgacggctaggaaagtacgtggtaggtaccttaagttttacgttaaccgtcgttacaacggtacctaaactattttaacttaccttttccgtttaccgttacgttaccggttttaccgggacgggtaccgggtaacccgtaaagggttcggtaacgtaccgttaacgtaaaccggtaacgttacgggtcggtcgttaccgaacccgtaccgtacgttaccgttcgttcctttccgtaacccg

SEQ ID NO: 63989 - DNA, 813 bp, Homo sapiens
  misc_feature: GYAE6OF01DI0A0.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagacctccctggctgtgtctcgtgggcgaggacgggcccaccatcaactcgactaacgtccagccagtagtttgtttttacgttccggccccaacctaaaataaacctaaccttaacttagtcgttacggtaaccaggacaaggtaaagtacggaacacgtccctacctaaacctcctagtactttacgtcgggtccttaccggtacccgggactaccgggttaccccggggttaccctaaaccggtcttacgtacggtttcgggccgtaacggggtcccggggttaccgtacgggggtaacccgttacgtttaccaccttcctaccaacccgtataccgacgtccgacgtcccgtacggaccgagggtaccgtaaggtaacggtagtacggggtcgttaacgtttaacggttttaactttaccgtgttacccgtaaggaaccttaaacgttaacttttaacgtttaacccgttttcccgttttaacgttccgttaacccgggttttacccggggaacggggtaccggggtaaccgtaaggggttacggaacgtaacgttaaacccgtaaacggtaacggttggtcggtaccttacggacccctaacccgttagttcccttacgtttccttccgttacccg

SEQ ID NO: 63990 - DNA, 577 bp, Homo sapiens
  misc_feature: GYAE6OF01D20IH.31.78.H01.1.454.CMB.1.raw
  modified_base (323)..(323): a, c, t, g, unknown or other
  misc_feature (323)..(323): n is a, c, g, or t
  modified_base (571)..(571): a, c, t, g, unknown or other
  misc_feature (571)..(571): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagactccctggctgtgtctcgtgggcgagacgggccaccatcaactgacaagtccagccagtagttgttttattcggaccccacaataacaactacttagcttggtaccagacaagaaagtaggacacgcctacctaaactcctgatttacngggcttccgaccggcacgtccgggttacctaacgattcagttggacaggcgggtctagggacctagtttccactctccacctatcagcagcctgcaggctagagatgtagatagtttatacgtgtacacgactaactagtttacttacctttctttaccgtacttacggtttcgggacggacggtaccgaagggtgaagtaataccgaaaagtacttggcggctaggacctacctattccttgtcctntacccg

SEQ ID NO: 63991 - DNA, 721 bp, Homo sapiens
  misc_feature: GYAE6OF01EHV6Q.31.78.H01.1.454.CMB.1.raw
  modified_base (351)..(351): a, c, t, g, unknown or other
  misc_feature (351)..(351): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagacctccctggctgtgtctcgtgggcgagacgggccaccatcaactgacaagtccagccagtagttgttttattcggacccccaacaaataacaactacttagcttggtaccagcaagaaagtcggacacgtccctactaaactcctagtacttacgcggtccttccggtacccgggntacggttcccggggttaacctccccgtaacgtagtttcgacgttcggcgtacgggtccgggtacgtacgggtacctactttccacctaccgtacaccagtccaacggctacggtccgacggacgtacgggacgtacggtaaggtgtacggtacggttaactttagtttacgtacctagtaccaacgtaacttaaacttacgttttaacctttacccgttttaccgtttaccggttaccgttaaccggtttaccgggggacccgggtaaacgggttaccggtaagggtacggtaaccgtaaacgtaaccgtaaacggttcggtcggtacggtccttacgaccgttaactacgtttccttcgtccttacccg

SEQ ID NO: 63992 - DNA, 761 bp, Homo sapiens
  misc_feature: GYAE6OF01APB08.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctactggatctctggtcgaccgtacggggacatcgtgatgagcctagtttccagacctcctggctgtgtctcgtgggcgaggacggccacagtcaactgacaacgtccagaccaggtagttgttttacgtccggaccccaactaaactaacctaaaccttacgttacggtccgtttacgggtaccacgacgtaaaggtaaaggtacggaaccacgtaccccttaccttaaaaccgtccgttagtacttttacggtcgggtaccttccggtacccgggtactaccggttccccggggttaacctaaccggtactttcgtacggttcggaccgtacgggtccgggtacgtacggggtacccttacgtttaccaaccgtccttaccgaaccgtagttccgaacggacctacgtccgtacggaccgtacggtaccgtaaggaacggtcgttacggtacggtacgtttaagttttacttacggtacgtaccgtaacgtacttaaacgttactttactttaaccgtttcctttacgtaccgttaccggttcgggacggtacggaccggtaggtagaacgtactaaccggaactacgtagggtcgtacgtccgactaccgtattccgttcgtacttcgtaccccg

SEQ ID NO: 63993 - DNA, 827 bp, Homo sapiens
  misc_feature: GYAE6OF01EE4SK.31.78.H01.1.454.CMB.1.raw
tcagcagtagacgtcacgaccggtgctcgattttagtgtgagtagtttgggtttggggtaggctacaacaaggaccaggctacgggtccagacaagacctgggtgttcgcagacccaggtcttcactttctcgtgttgccttcgtggtacttcttcgtggtggaccgtagggaccagtcgtgagttgacgccgtacgtttccgacgtaccgttcccgttaggccttaggttcgttccggtcgttagggacggtaggaacggcccaccgtagtccaacgttgacgtacgtccagccagtagtttgtttagtccgacccctaactaataactacgtacgttacgtacgtttacgtaacgtaggacgtaacggtaacggtcgtacgtaccgtacctaccgttaaccgttcgtagtacgtttacggcgggttaccttaccggtacccggtacgttaccggttcccgggttacctaaccgtacgttacgtacgttcggacgtacggtaccggtacggtaccggtacgttacttaccgacctaccgacctaaccgtacgtacgtaacgaaccgtacgtaccgtacgtacgtacgtacgtaagaacgtacgtacggtacgtacgtttacgtttacgttacgtacgtacgtacgtaacgttaacgttacgtttacctttaccgtttaccgttttacgtacgttaccggttacgggtaacggttaacggtaaccgttaaggtacgtaacgtaacgtttaaccgtaacgtttaccgttaggtcccgttcgttacgtacccgttacgttacgttcgttacgttcccgtaccgttaccg

SEQ ID NO: 63994 - DNA, 709 bp, Homo sapiens
  misc_feature: GYAE6OF01BTB07.31.78.H01.1.454.CMB.1.raw
  modified_base (448)..(448): a, c, t, g, unknown or other
  misc_feature (448)..(448): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagactccctggctgtgtctcgtgggcgaggagggccaccatcaactgcaagtccagccagtagttgttttattcggccccaacaataacaactacttagcttggtaccagcaagaaagtaggacagcctacctaactcctagatttacgtggtcttccgacccgggctacgttcccgggttacctaaccgtacttcgagttcggacgagggtccggggtcgtacggggtacccgtatttccacttcctccacccataccagccgacgccctagccgnggtaaactggaaagtacgtgggttaggacgttagttttaacttacgtgttaccgaacgtactaaaccttatttaacttaacccgtttaccgttttaccgttaccgttaaccgtttccggggaccgggtaacggggtaacccggtaagggttacgggaaacgtaacgttaaccggtaaaaccggtacgtttacgggtccggtaccgttacggaccccgtaacccgttacgttacccgtttacggttcctttaccgtacccgg

SEQ ID NO: 63995 - DNA, 545 bp, Homo sapiens
  misc_feature: GYAE6OF01D4R5U.31.78.H01.1.454.CMB.1.raw
  modified_base (357)..(357): a, c, t, g, unknown or other
  misc_feature (357)..(357): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagtgttttattcggccccacaataacaactacttagcttggtaccagcaagaaagtaggacagcctcctaaactctagtatttacgtgggtccttccgtacccgggcacgtccggggttcctaaccgnttcagttggcaggcgggtctgggacctatttcgactctcaccatcagcagcctgcaggctagaagagtgtgactagtttatacgtgtacagcaactattactactttctttacgtctacgtttcggacggtaggacctaagggtgagtatacgaaacgtatggtgctgactactatcttcgtctctac

SEQ ID NO: 63996 - DNA, 655 bp, Homo sapiens
  misc_feature: GYAE6OF01DIBP2.31.78.H01.1.454.CMB.1.raw
  modified_base (338)..(338): a, c, t, g, unknown or other
  misc_feature (338)..(338): n is a, c, g, or t
  modified_base (375)..(375): a, c, t, g, unknown or other
  misc_feature (375)..(375): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtcgaccgtacggggacatcgtgatgagcctagtttccagacctcccgtggctgtgtctcgtgggacgaggacgggcccaaccatacaactgacaacgtccagccagtagttagttttatcggaccccaacaaactaaacaactactacgcttaggaccagacaagaagtagacacgtcctaactaacctcgtatattacgnggtcctcgacccgggctacgtccgggttaccaaccgnttcgattcggctaggcgggtctacggggtaccttattcaccttctaccacctatccacgtcacggtcctcgacgaggtcgtagaacgagttcggaggtacttaacgttttacgtaaccgtgtacctaagacctaaactattaacctttactttccgttaccgtacgttaccggtttcgggacgggtaacgggaccgtaaagggtcggaacgtaacgtaaccggtaaaagtacgtgggtacgtacgtacgaccctaacgtacttagttcgtcttccgtacc

SEQ ID NO: 63997 - DNA, 690 bp, Homo sapiens
  misc_feature: GYAE6OF01CP2TM.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagactccctggctgtgtctgtgggcgaggagggccaccatcaactgcaagtccagccagagttgttttattcggccccaacaataacaactacttacgcttagtaccagcaagaagtagacacgcctacctaaactcctagtattacgtcggtacttccgtacccggactacgtcccggggttacctaaccgtatctagttcggacgacggtcgggtcgtacggggtacctacgtttccaaccttctcccgaacctataccgacgtccacgtcctcggcgacgggcctaggaaacgtattagggtcggtacgttaacgttttaacgttaccgtcggtaccgaagacctaaacgtacttttaacgttacctttttccgtttaccgttacccttaccggtttcgggacccgggtaacgggaacccggtaaagggtcgggaaacgtaacgtaacccggaaaacgtaaccgttgggtcgaccgtcgaccctaacctattccgttacgtccttccgttaacccg

SEQ ID NO: 63998 - DNA, 830 bp, Homo sapiens
  misc_feature: GYAE6OF01EX008.31.78.H01.1.454.CMB.1.raw
  modified_base (376)..(376): a, c, t, g, unknown or other
  misc_feature (376)..(376): n is a, c, g, or t
tcagcagtagacgtcacgaccggtgctcgatttagtgtgagtagtttgggtttgggggagctacaacaggcaggctaggggccagcaagactggtgttgcagacccaggtcttcatttctctgttgctctaggatctctggtgcctacggggacatcgtgactgagcctagtttccagactccctggctgtgtctcgtggcgagacggccacagtccaacgtgacaagtccagccagtagttgttttattcggacccccaacgtaagtaacctaacttacgttaggtcttacggtacctagacaagaaagtacggacacgtccctacctaaacctccgttagtactttacgtcgggtcctttccggtacccgggtntaccggttcccggggttaccctaaaccggtatttccgtagtttcggaccgtagggtccggggttacgtacgggggacccgttagttttcccgaacccgtttaccctacccgaacccgtaagtcccgaacgccgtacggtaccccgttacggaccggtacgggtaccgtaggtaaacggtacggttacgggttaccggtaccgtttaaggtttttaaccgttacgttacggtaccggtaacggtaaccgtaaacttaagtttaaccgttttaacccgttttaccgtttaccgttaccgttaacccggttttacggggaaccgggtaaccggggtaaccggtaagggttacgggtaacggtaaccgttaaccggtaaaacggtaccgttacggttccggaccgttaccgacccgtaacccgtacccttaccggttcgttacccgttccttaccccg

SEQ ID NO: 63999 - DNA, 874 bp, Homo sapiens
  misc_feature: GYAE6OF01EH9G7.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccaagccagtagttgttttattcggacccccaacaaataaccaaacttacttagccttaggtaaccagacaagaaagtaggacaggtcctacctaaactccctagtactttacgtcgggtccttaccgtaccccggggctaacggttccccgggggttaccttaaaacccgtattaccgaagtttcgggaccgtaacggcgggggttacctacggggggaacccctaagtttttcccaactttcccgtaccaacccgtaatcccgaacggtcccaacggtccccttaggccgtaagggaccttaggaaaacggtacgttagggtacgggtaccgtttaagtttttaacgtttaaccgtacggtttaccgaaacggtacctaaaccgttaaacgtttttaaccttaaccgtttttcccgtttttacccgttaaccgtttaaccgggtttttacccggggggaaccggggtaacggggggttaaacccccgttaaaaggggggtttccggggtaaaacggttaaaccggtttaacccggaaaaaaaccgggggttaaccttacgggggtttcccgggtaccgtttaaccgggaaccccttaaacccgttaatttaccccggttaccggtttttccctacccggtttaaaccccgg

SEQ ID NO: 64000 - DNA, 565 bp, Homo sapiens
  misc_feature: GYAE6OF01A9G44.31.78.H01.1.454.CMB.1.raw
  modified_base (229)..(229): a, c, t, g, unknown or other
  misc_feature (229)..(229): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagngttgttttattcggccccacaataacaactacttagcttggtaccagcagaaagtggacagccctcctaaactcctgtatttacgtgggctttccgtacccgggctacgttcccgggggttaccctaaaccgtattccagttcggctaggcgggtctgggaccgtattcactctcaccatcagcagcctgcaggctagaagatggtcgctagtttattacgtgtacagtctaactattatactttcttcgtctactttcgggacggtacggaccgtaggtcggagataccgaaacgtacgtggtcggctcgacctacctatcgtcttcttctaccg

SEQ ID NO: 64001 - DNA, 750 bp, Homo sapiens
  misc_feature: GYAE6OF01CZDUB.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtcgccgtacggggactatcgtgatgacgcctagtttccagacctccgtggctgtgtctgtgggcgaggcgggccaccagtcaactgacaagtccagccagtagttgttttacttcggacccaacaataacaactactagcttacggtaccagcaagaaagtaggacagaccctacctaaactccgtagtaactttacgtcgggtacctttacccgaccgggtactaccggttaccggggttaacccaaccggtattccgtaagttcgggaccagggtcccgggttacgtacgggggtaccctatttaccacgttacctaccgaactaacgtcacggcaccgtccgtacgaccgacggtactaaggaaggttagtcgggtagtacgttaggtttaactaacgtgtaaccgaatacctaaacttactttaacttacctttaccgtttaccttacggttaaccgtttccgggggacgggtaaacggggtaaccgtaaaggggtacggtaaaacgtaacgtaaaccggtaaaaaccggttacgttacgggtcggtaccgttaaccggacccttaacccgtaagttacccggtttgttacccctttacgttaaccccg

SEQ ID NO: 64002 - DNA, 921 bp, Homo sapiens
  misc_feature: GYAE6OF01BDO5Z.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttacttcggccccacaataaccaactacttagcttggtaccagcagaaagtaggacagcctcctaaactccgtgactttacgtcgggtcctttccgtaccccgggctacgttcccgggggtttaccctaaacccggtatttccgaagtttcgggaccgtaacgggtccgggggttccgttacggggggtaccccgttaattttacccgaaccctttccgttacccgaaaccccgttaacttcccgaacggtcccgtaacggtcccgtttacggcccgtaacggggtacctttaacgggaaaacggttacggtttacggggtttacggggtacccgtttaacgggttttttttaaacgtttaaccccgttttaggggttaccctaaacgggtaccctttaaaaaccgttaaacgtttttttaaaccttttaaaccccgtttttttcccgttttttaaccccgggtttcccgttttaaaccgggttttttacccgggggggtacccgggggttaaaccgggggttaaaccccgggttaaaagggggtttcggggtaaaaccggtaaacgttaaaccccggtaaaaaacccgggttaaaccggttcggggttaaccgggtaccgttacgggtaaccccgtaaccccgttacgtttaccgtttaccggtttccctttacgttaacccccg

SEQ ID NO: 64003 - DNA, 772 bp, Homo sapiens
  misc_feature: GYAE6OF01CGG0M.31.78.H01.1.454.CMB.1.raw
  modified_base (356)..(356): a, c, t, g, unknown or other
  misc_feature (356)..(356): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagtttccagacctccctggctgtgtctcgtgggcgagagggccaccatcaactgacaagtccagccagtagttgttttattcggccccaacaaataacaactacttagcttaggtaccagcaagaaaagtacggaacagaccctacctaaaactcctagtactttacgtgggtacctttcgtaaccccgggntaacgttcccggggttacctaaaccggtattccgaagtttggaccaggtccggggtctacgggggaacctagtttccaccttcctacaacccaactcgaagtccgaacgtccgtgaccgagggtaccttaggaaacgtagttaggtacggtaccgttaaaggtttttaacgttaaccgtaggttacctaaacggtaacctaaaaccttaacttttaaccgtttaaccgttttaccgttttaccggttacccttaacggttttacccggggaccggggtaacggggaaaccccgttaaaggggtacggtaaacggtaaagttaacccgtaaaaaaccggtaaccgttagggttccggacgttaccggacctaaaccccgtacgttacccgtttacgttcccgttaccgttaaccccg

SEQ ID NO: 64004 - DNA, 688 bp, Homo sapiens
  misc_feature: GYAE6OF01BJQ8P.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagacctccctggctgtgtctcgtgggcgagacgggccaccatcaactgacaagtccagccagtagttgttttagttccggaccccaacctaataacaactacttagcttggtaccagcaagaaagtaggacacgccctacctaaacctccgtagtactttacgtgggtccttccgtacccgggctacgttcccggggttacctaaccgtacttcgagtttcggcgtacggtcgggtcgtacgggacctacgtttcaccttcctccgtaacctatccgagcgacgcctcgacgacggtcgtagaagtcgtaggtaggtacttagtttacttacgtacgtacacgtactaacgtaacttacttactttaccgtttaccgttccttaacggtttcgggaccgggtacggtacccgtaagggttcggtaaccgtaacgtaaccgaaacggttaaccgtacgggtcggtaccgtacggtacccgtaaccgtaccgttacctttcgttccttaccgttacccc

SEQ ID NO: 64005 - DNA, 928 bp, Homo sapiens
  misc_feature: GYAE6OF01DQXNT.31.78.H01.1.454.CMB.1.raw
tcagcagtagacgtcacgaccggtgctcgatttagtgtgagtagtttgggtttggggagctacaacaggcaggcaggggcagcaagatggtgttgcagacccaggtcttcatttctctgttgctctggatactctggtgcctacggggacatcgtgatgagccagtttccagactccctggctgtgtctcgtggcgagagggccaccatcaactgcaagtccagccagtagttgttttattcggccccacaataacactacttagcttaggtaccagcaagaaagtagacacgtacctaccgtaaaactccgtagtactttaacgtggggtacctttaccgtaccccggggtactaaccggttaccccgggggtttacccttaaaaccccggtacgttttaccgtaaacggttttcgggaacccgtaacggggttcccgggggttacccggttacggggggtaaaccccggtttaacgttttttacccgaaacccggtttaccctttaacccgtaaacccccggtaaactttacccggaaacgggtacccgtaaaccgggttaacccccgttccgggaacccggtaacggggttaacccgtttaacgggaaaagggttaaacggtttcgggttacggggttaaccctttaaggggtttttttaaaccgttaaccgttaacgggttacccgaaacgggttaaccttaaaaccgtttaaacggttttaaccttttaaacccgttttcccgttttttaccggttaccgttaacccgggttttacggggacccgggttaacggggtaaacctaaacgggggttacgaaacgggttaaccgttaaacccggaaaaccggttacggtttacgggttcggtaccctaacggtcccgtaacctaaggttcctttaaccggtctttaccgtaacccg

SEQ ID NO: 64006 - DNA, 683 bp, Homo sapiens
  misc_feature: GYAE6OF01D74FC.31.78.H01.1.454.CMB.1.raw
  modified_base (361)..(361): a, c, t, g, unknown or other
  misc_feature (361)..(361): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgtttattcggccccacaataacaactacttagcttggtaccagcaagaaagtaggacagcctcctaaactcctgtactttacgtgggtcttccgtacccgggctaacgtcccggggttacctaaaccgnttaccagtttcggctaaggtccggggtctcggggaacccgtattttccaacgttcctaccaacccgtattccgaacggcctaacggccctcggaccgagggtcctaaggaaagtacgtggtggtcttaagttttactacgttggttaccaacgtccaaactagtttaaccttaacgttttcctttacgtaccttaaccgttttcgggggaccggaagggtaaccctaaaggggttaggaacgtaacgttacgaaaaaccggtacgttggtacggtacgtacgtacccaaaccgttactaccgtttcgttcccttcctaaccg

SEQ ID NO: 64007 - DNA, 675 bp, Homo sapiens
  misc_feature: GYAE6OF01B9GUQ.31.78.H01.1.454.CMB.1.raw
  modified_base (371)..(371): a, c, t, g, unknown or other
  misc_feature (371)..(371): n is a, c, g, or t
  modified_base (395)..(395): a, c, t, g, unknown or other
  misc_feature (395)..(395): n is a, c, g, or t
  modified_base (453)..(453): a, c, t, g, unknown or other
  misc_feature (453)..(453): n is a, c, g, or t
  modified_base (655)..(655): a, c, t, g, unknown or other
  misc_feature (655)..(655): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgacgcctagtttccagtacctccctggctgtgtctcgtgggcgaggacggcccacatcaactgacaacgtccagccagtagtttcgttttatccggacccctaacgaataacctaacttacgttagcgtttaggaaccagacaaaggaaagtcggaacctacgcccttaacctaaactcctagtactttaccggcggtccttccgaccgggntacggttcccgggttaccaacgtnttcgagttcggcaggtccgggtcgtacggggaccttatttccgactccgtacaccgtntcgacgcacgtccgtgcgacggtactaggaagtacgtggtacggtacttaacgtttacgtacgtcgtacgaacgacctaaacttacgtttaactttaccgtttccgtttaccgttcgttaacgtttcggggaacgggtacggtaccggtaagggtcgaagtaaccgtaacgtaaacggtagtggtacgacgtacgactactnttacgtcttccgtctacccg

SEQ ID NO: 64008 - DNA, 925 bp, Homo sapiens
  misc_feature: GYAE6OF01AJTXM.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacaactacttagcttggtaccagcagaaagtaggacagccctacctaaactcctagtacttttacgtgggtcctttccgtaaccccgggctaacggttccccgggggtttaccccttaaacccggtattttaccgaagttttcgggaccgtaacggggtcccgggggttaccttacggggggtaaccccgttaagtttttcccgaacccgtttcccgttaaccctaaccccgtaactttacccgtaaacggtcccgtaaacggtcccccgttacgggacccgtaacggggtacccgttaacgggaaaacgggtacgtttacgggttacggggtaccgtttaaacgggttttttaacgttttaacccgttcgggtttaacccgtaaacgggttaaccctaaaaccgttaaacgtttttaaaccgtttaaccccttttttacccgtttttaacccggtttacccgtttaacccgggttttttacccgggggaacccgggggttaaccgggggttaaaccccgttaaaacggggggttcggggtaaaaccggttaaaccgttaaacccggtaaaaaccgggttaaacccgtttcgggttaccggggtacccgtttacggtaacccgtaaacccgttaccgtttaccgtttcgggtttaccctttacccgtaacccg

SEQ ID NO: 64009 - DNA, 542 bp, Homo sapiens
  misc_feature: GYAE6OF01A2PMU.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggccccacaataacaactacttagcttggtaccagcagaaagtaggacagcctcctaaactcctgatttactggcttccgtacccgggcacgttccggggttacctaaccggtattccagttcggcaggtcgggtcgtcgggacctatttcactctcacctatcacgcacgcctgcaggctagaagatgtggctagtttactacgtgtcagcaactattatacttcttcgtctacgttcggcggacggacgaaggtgagtatacgaaacgatgtggcgtagactaccatcgtgtctctacg

SEQ ID NO: 64010 - DNA, 566 bp, Homo sapiens
  misc_feature: GYAE6OF01A3LPZ.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacaactacttagcttggtaccagcagaaagtaggacagcctacctaaactcctgactttactgggtcttccgtacccgggcacgttccggggttacctaaccgtattcattggcaggcgggtctgggaccgtatttcactctctaccatcagcagcctgcagctagaagatgtggctagtttatacgtgtacagacaactattattacctttctttccgtctaccgtttcgggacggtagggaccgtaagggtcggtaagtactacgaaaccgtacgtggtcggctagacctaccattactcgttcttctaccg

SEQ ID NO: 64011 - DNA, 668 bp, Homo sapiens
  misc_feature: GYAE6OF01AEDBE.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctcgtgggcgagacgggccaccatcaactgacaagtccagccagtagttgttttacttcggccccaacaataacaactactagcttggtaccagcaagaaagtacggacagccctaccgtaaacctcctgtaactttacgtcgggtcttccgtaccccgggctacgttccccggggttaccctaaccgtcttactagttcggcctacgggtccggggtccgtacggggtacccgtactttccgaccttcctaccaacctattccgaacgcctacggcctgaccgtacgggtctaggaaagtgttcggtaggtcttagttttacttacgtcgtacagtactaactatttacttactttcgttcgtcttacgttcgggacgggtacggacccgtaagggtgaacgtacgtaacgtaaaccggtacgttggtcgggtacctcggaccctaccgttagtcccgtttcgttcgtttacctccccg

SEQ ID NO: 64012 - DNA, 738 bp, Homo sapiens
  misc_feature: GYAE6OF01CW724.31.78.H01.1.454.CMB.1.raw
  modified_base (721)..(721): a, c, t, g, unknown or other
  misc_feature (721)..(721): n is a, c, g, or t
  modified_base (734)..(734): a, c, t, g, unknown or other
  misc_feature (734)..(734): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtcgccgtacggggacatcgtgatgacgcctacgtttccagtacctcccgtggtctgtcgtctcggtgggacgaggacggaccacatacaactgacaacgtccagaccagtacgtttagttttacgtaccggaccccaacctaaataaacctaaccttaacgttacgtcgttacggtaccagacgaagtaaaacggtacggaccacgtaccctaaccgtaaaccttccgtacgttactttacggtcgggtacctttccggtacccgggtactaccgggttacccgggtacctaaccgtatcgtacgttcggacgacgggtcgggtcgtacgggtaccgttacttccgtacctctacctaacctatccacgtccgtacggtccgtacgaccgaggtactaggaaacgttgtacgggtcggttaacttacggtttactacgtacgtacgtaacgtactaaacgtttaactttaccgttaccttttaccgttacgttacccgttacgggtttaccgggacggggtaacggtaacggtagggtacggactaacgaaacgtaacgtgtggtaccgactacgactaacctnttccgtattcctntccc

SEQ ID NO: 64013 - DNA, 731 bp, Homo sapiens
  misc_feature: GYAE6OF01C7U47.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagttccagactccctggctgtgtctcgtgggcgagcgggccaccatcaactgacaacgtccagccagtagttgttttactcggccccaacaataaccaactacttagcttcggtaaccagacaagaaaggtacggacacgtccctacctaaacctcctagtactttacgcgggtccttacgtacccgggactacgttcccggggttaccctaaccgtattcaagttcggacgtacggtccgggttcgtaccggggtaactacgtttccaaccgttcctaccgaaccctagtacgacggtccgaccgtccgtacggaccgacggtaccgtaggaacgtagttacggtggtacgttaagtttacgttacgtacgtaccgtaacgtacctaacttaagtttaacgtttaccttttaccggttttaccgttaccgttaccggtttacggggtaaccgggtacggggtaacccgtaaggggttacggaacggtaacgtaaccggtaaaacgtaacgtacggttcggaccgtacgacccgtaacctaagttcttacgttcgttccttaacccg

SEQ ID NO: 64014 - DNA, 622 bp, Homo sapiens
  misc_feature: GYAE6OF01C8682.31.78.H01.1.454.CMB.1.raw
  modified_base (468)..(468): a, c, t, g, unknown or other
  misc_feature (468)..(468): n is a, c, g, or t
  modified_base (564)..(564): a, c, t, g, unknown or other
  misc_feature (564)..(564): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctcctggctgtgtctcgtgggcgaggagggccaccatcaactgacaacgtccacgccagtagttgttttattcggccccaaccaaataaacaactacttagcttacggtaccagacaagaaagtagacagcctactaaactctgtattacgtgggtccttcgtacccgggctacggttaccgggttaccctaaacgtacttcctaagttcggctacgggtccgggtcgttacgggaccgtactttcgacctacctacgacctactcgacgcagtccctgccaggacctagaagngtgtggactaggttttatcgtgtacagactaacgttattacttactttcgtttacgtctaccgtttcgggacggaggtaccgtaaggtgaacgtanaaccgtaaacgtagttggtacggcctagacccgtaactagtccttagtcttatacccg

SEQ ID NO: 64015 - DNA, 582 bp, Homo sapiens
  misc_feature: GYAE6OF01EUFN3.31.78.H01.1.454.CMB.1.raw
  modified_base (437)..(437): a, c, t, g, unknown or other
  misc_feature (437)..(437): n is a, c, g, or t
  modified_base (449)..(449): a, c, t, g, unknown or other
  misc_feature (449)..(449): n is a, c, g, or t
  modified_base (565)..(565): a, c, t, g, unknown or other
  misc_feature (565)..(565): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagttgttttattcggaccccacaataaccaactacttagcttaggtaccagacaagaaagtaggacagccctacctaaactcttagatttacgtgggtcttaccgtacccgggctacgttccggggttacctaaccgtattcagttcggctacggcggggtactacggggaccgtacttccactctacactatcagcagccctgacgnggtactagaagntggtggtactagtttattctgtacacacaatattactacttcgttacgtactacgtttcggacggacggacaaggtaggacgatacgaaacgtacgttggtcggctcgactacctnttactcgttctctaccg

SEQ ID NO: 64016 - DNA, 775 bp, Homo sapiens
  misc_feature: GYAE6OF01DLX6P.31.78.H01.1.454.CMB.1.raw
  modified_base (389)..(389): a, c, t, g, unknown or other
  misc_feature (389)..(389): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctcgtggtcgccgtacggggacatcgtgatgacgcctagtttccaagcctcccgtggccttggtcgtcgtcggtgggcgaggacgggccaacatcaactgacaagtccagcagtagtttcgtttacgtcgacccctaacaactaacctaacttactagtcttacggaccagacgaagaagtggacacgtaccctactaactcgtatacgttacgtggtaccttccgaccggctaccggttccgggtacctaaacggtnttactagttcggacgtacggggtccggttacgtacggggtaaccttactttaccgacgttaccctaaccgaaccctacgttaccgacgtaccgtaaccgccttaacgggccgaacggtaccgtaaaggtaacggtaacggttcgggtaacggttacgtttaacggttttaaccttaccggtacgtaaccgtaacgtaaccttaaacgttaactttaacctttaccgttttcgttacccggttaccgttacggtttacccggggacgggttaaacgggtaccgttaaaggggtgaaaccgttaacgtaaaccgtaaacggtaccgtaggttccggtaccgtaccggacctaaccgtagttacccgttacgttcctaaccgttcccgg

SEQ ID NO: 64017 - DNA, 644 bp, Homo sapiens
  misc_feature: GYAE6OF01C5E66.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctcgtggtcgccgtacggggacatcgtgatgagcctagtttccagacctcctggctgtgtctcgtgggcgaggacgggccaccatcaactgacaacgtccacgccgagtagtttgtttttacgttccggacccctaacaaataactaactacttagcttacgtaccagacaagaagtaggacacgcctacctaactctagtattacgtggtcctcgtaccggctacggttccgggttaccctaaccgtctacgtagttcggcagggtcggtcgtcggggtacctacttcaccgtctacaccgtactcgagccgacgtcccgtacgcgtaggtacctaggaaacgtgttaggtcggtacttagtttacttacgtgtacgtaagactaacttattacgttacctttcgtttacgtctacggtttccggacgggtacggaacgtaggtaggacgtagtaaaccgtaacgtacgttaggtcggctacggactacgtacttcgtacttctctaacccg

SEQ ID NO: 64018 - DNA, 659 bp, Homo sapiens
  misc_feature: GYAE6OF01BCNSS.31.78.H01.1.454.CMB.1.raw
  modified_base (321)..(321): a, c, t, g, unknown or other
  misc_feature (321)..(321): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgaggacgggccaccatcaactgcaagtccagccagtagtgtttattcggaccccaacaataacaactacttagcttagtaccagacaagaaagtaggacacgcctactaaactctagactttacnggtcttcgaccggcacgtcccgggttacctaaccgtattccgagttcggcgtacggcgggtcgtacgggtacccgtatttccaccttcctaccgaaccctatccgtaacgccaacggtcctacgaccgacggtactaggaaacgtgttaggtcggtacgttaacggttttaacttacgtgttaccgaagtactaaaccttaatttaactttaacctttccgttttaccgtaccttaacggtttcccgggacgggtaacgggaacccgtaagggtcgaacgtaacgtaacgaaacgtagttggtcgacgtcgaccctacgacttctacgttctcgtacc

SEQ ID NO: 64019 - DNA, 856 bp, Homo sapiens
  misc_feature: GYAE6OF01DY86G.31.78.H01.1.454.CMB.1.raw
  modified_base (344)..(344): a, c, t, g, unknown or other
  misc_feature (344)..(344): n is a, c, g, or t
  modified_base (383)..(383): a, c, t, g, unknown or other
  misc_feature (383)..(383): n is a, c, g, or t
tcagcagtagacgtcacgaccggtgctcgatttagtgtgagtagtttgggtttgggggaggctacaacaggcaggcaggggcagcaagatggtgttgcagacccaggtcttcatttctctgttgctctggactctctggtgccgtacggggacatcgtgatgagccagtttccagacctccctggctgtcgtctcgtgggcgaggacgggccaccatcaacgtcgactaacgtccagccaggtagtttagtttttagttcggaccccaacaaataacaactacttacgtcttcggtaccagacaagaaagtaggacagtaccctactaactcctagtattacgnggtcttccgaccggctacgtcccgggttacctaaccgtnttacgagttcggcgtacggtccggggtacgtcggggtaacctactttccaccgtcctaccgacctaacgtccgaacgtcgaaccgtcccgttaggacccgtaagggtaccgttaacggtaaacgttaacggtttcgggtacgggttacctttaaggttttttaaccgtttaaccgttacggttaacccgtaacggtaacccttaaaccgtttaacttttaaccgttttaacccgttttcccggttttacccggttaaccgttaaacccgggggtttttccggggaaccggggtaaaccgggtaaacccggttaaaaggggttacggggtaaacgttaaccggttaaaccgtaaaaaaccgggttaaccggtttacggggtaaccgggttaccgtttaacccgggtaccccttaaaacccgttaccggtttcccgtttttaacccggttcccttttacggtttaaaccccccgg

SEQ ID NO: 64020 - DNA, 745 bp, Homo sapiens
  misc_feature: GYAE6OF01DYSX5.31.78.H01.1.454.CMB.1.raw
tcagcagtagacgtcacgaccggtgctcgatttagtgtgagtagtttgggtttggggagctacaacaggcaggcaggggcagcaagatggtgttgcagacccaggtcttcatttctctgttgctctggatctcgtggtcgccgtacggggacatcgtgatgacgccgtagtttccagtacctccgtggcttgtgtcgtcgtgggcgaggacggccaaccgtatccgaaacgtgacgtaacgtccagccaagtagttcgttttactccggacccaacaaataacctaactacgttagcgttacggaaccaggacaaaggtaaacgtagacacgtaccttacctaaactcgtagtacgttacgtcggtcttccgtaccgggacttacggttacccgggttacctaacgtacttcgtacgttcggacgtacgggtaccgggtcgtacgggtaacccgttacttccaccgttcctaccgaccacgttacgacgtacgaccgtaccgtggaccggtagtaccgtaaggtaacgtacgttggtaccggttacttaagtttacgttaccgtgtacacgttaactaacgtaacttttaccgttacgttttccgttaccgtacgtttaccgttccgggaacgggtacggttaacggaagggttacgggactaacggtaaaccgaaaacggttaggtacggtccggacgttacgacccgtaacttacgtccgtttaccgtccgttaaccgttccg

SEQ ID NO: 64021 - DNA, 684 bp, Homo sapiens
  misc_feature: GYAE6OF01B1P0N.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagtactccctggctgtgtctcgtgggcgagagggcccacatcaactgacaagtccagccagtagttgttttacttcggccccaacaataacaacttacttagtcttaggtaccagacaagaaagtagacagccctacctaaactcctgtactttacgtggtccttccgtacccgggctacggtcccggggttaccctaaccgcttactagtggcaggcgggttcgtcgggtaccgtatttccactctcaccatccacgcacgtcctgcgacggtactagaacggtagtggtacggtaccgttaagttttacgttacgtcggtacgtaacgaactaacttaagtttaacctttacttttcccgtttccgttaccggttaccgtttttacggggaccggggtaacgggtaaccggtaaggggttaacgggtacgtaaacgttaaccgtaaaacggtacggttgggtaccggcgtaccgtctaaccgtacttcgtacgttccttaccgtaacccg

SEQ ID NO: 64022 - DNA, 641 bp, Homo sapiens
  misc_feature: GYAE6OF01AX8WY.31.78.H01.1.454.CMB.1.raw
  modified_base (373)..(373): a, c, t, g, unknown or other
  misc_feature (373)..(373): n is a, c, g, or t
  modified_base (406)..(406): a, c, t, g, unknown or other
  misc_feature (406)..(406): n is a, c, g, or t
  modified_base (414)..(414): a, c, t, g, unknown or other
  misc_feature (414)..(414): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcccagtttccagactccctggctgtgtctcgtgggcgagagggccaccatcaactgcaagtccagccagagttgttttattcggccccacaataacaactacttagcttggtaccagcagaaagtggacagcctaccgtaactcctgatttactgggcttccgtacccgggctacgtccccggggttacctaaccgtacttccagttcggcncggtcgggtcgtcgggaccgtacttcaccttcnccaacctntcagaccacgtcctggcgaggctaggaaagtgtaggtcgattaacgtttattacgtggtacagacaaacttatttacttaccgtttaccttttcggtaccttaccggtttccgggaacgggtaccgggtaaccgtaagggtagggtaacgaagtaacccgtaaacggtaaccttaggtcgggccttacgaccgtaccctacgtttaccgtcgttccttccgttaccg

SEQ ID NO: 64023 - DNA, 827 bp, Homo sapiens
  misc_feature: GYAE6OF01BS0VQ.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagacctccctggctgtgtctcgtggcgagacggcccaccatacaactgacaagtccacgccagtagtttgttttacttccggaccccaactaaactaaaccaacttacttacgtcttacggtaaccagacaaggaaagtacggaccacgtccctacctaaacctcctagtactttacgcggtccttccggtacccggctacggttcccgggttacctaaccgtattacagttcggacgtacggcggggttaccgtacggggaaccttacgtttccaaccgtttccctaccaaccctactaccgaccgaccacggtcccgttcggacccgtaacgggtcttaaagggaaacggttacggtacgggttacggtaccgttttaaaggtttttaaaccgttaaccgtttacgggtacccgtaaacggtaacctaaaaccgtttaactttttaaccgtttacccttttttaccgtttacccgttacccgtttaaccgggttttaccggggaacccgggtaaccggggtaacccggttaaaggggttacgggtaaacgtaaaccgtaaacccggtaaaccgttaacggtacgggttcggacccttacgggtaaccctaaccctttacgttacccgtttcggtttaccttcccgttaaccccg

SEQ ID NO: 64024 - DNA, 610 bp, Homo sapiens
  misc_feature: GYAE6OF01CDNXX.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagacgggccaccatcaactgacaagtccagccagagttgttttattcggccccacaataacaactactagcttggtaccagacaagaaagtaggacagccctacctaaactcctagtatttacgtggtccttcgtacccgggctacgtccggggtttacctaaccggtattcgagttcggcgaggtcgggtcgtcggggtacctagtttccactcctacacctatcacgcacgtcctagcaggcttagaagtagtggtgtactagtttatacgtgtacacgtactaatatttaactactttctttcgttacttaccgtttcgggacggtacggaaccgtaagggtacggagtaacgtacgaaaacgtacgtaggtcgtcgtagtaccacctacttcttcgttccttctacccg

SEQ ID NO: 64025 - DNA, 771 bp, Homo sapiens
  misc_feature: GYAE6OF01DIVKI.31.78.H01.1.454.CMB.1.raw
tcagcagtagacgtcacgaccggtgctcgatttagtgtgagtagtttgggttgggggagctacaacaggcaggcaggggcagcaagatggtgttgcagacccaggtcttcatttctctgttgctctggatctctggtgccgtacggggacatcgtgatgagccagtttccagacctcccgtggctgtgtctcgtgggcgaggacgggccaccatcaactgacaacgtccagaccaaggtagtttgttttacgttccggaccccaactaaactaacaaacttactagtcttacggaaccaaacagaaagtacggacacgtcctaacctaaactctagtatttacgcggtcttaccgtacccggactacgttacccggggttacctaaacgtacttactaagttcgggacgtagggcggggttccgtaggggaaccttagtttccacttcctaccaccgtatccgaacgtccaacgtccgtaggacgtacggagtaggaaagtgtaggtacggtactttaagtttaacttacgtacggtacaacggtaacctaaattaactttaacgttacccgttttactttacccggtacttttacccgggtttaccggggaacggggaacgggtaacccggtaaagggggtacgaaaaggtaaccgtaaaacctaaaacccgggtaacttagggggttaccggtacccgtacggtaacccctaaccgtaccgtttacttaccgggttttacccttaccgttaacccggttttaccccccg

SEQ ID NO: 64026 - DNA, 761 bp, Homo sapiens
  misc_feature: GYAE6OF01EVM5R.31.78.H01.1.454.CMB.1.raw
  modified_base (356)..(356): a, c, t, g, unknown or other
  misc_feature (356)..(356): n is a, c, g, or t
  modified_base (385)..(385): a, c, t, g, unknown or other
  misc_feature (385)..(385): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctcgtgggcgagacgggccaccatcaacgtgacaagtccagccagtagttgttttacttcggacccccaactaataactaactacttagcttggtaccagcaagaaagtacgacagtccctacctaaactccgtagtaactttacgtcgggtccttccgtacccgggntacggttcccggggttacctaaaccggtnttccagttcggcaggtcggggttcgtcgggtaaccgtattttccgaacttccctacgaaccctattccgaagtccgaacgtcccgttaggcgaacgggtcgttaaggaaagtacgttggttacggtactaagtttttaacgtacgttcggtacgtaaaggtaccaaacgttaactttaacgttaaccctttttccgttttacccggttacttaaccggtttttacccggggaccggggtaaacgggttaaccggtaaacgggggtaggtaaacggtaaacgttaaaccggtaaaaacgggtaccgtttacgggtacggttcccggttaacgacccgttaacctacgttcccgtttaacgttccttaccgttaaccg

SEQ ID NO: 64027 - DNA, 846 bp, Homo sapiens
  misc_feature: GYAE6OF01C4JBL.31.78.H01.1.454.CMB.1.raw
  modified_base (330)..(330): a, c, t, g, unknown or other
  misc_feature (330)..(330): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagttccagactcccgtggctgtgtctcgtgggcgaggacgggccaccatcaactgcaagtccagccagtagttgttttattcggaccccaacaaataacaactacttagcttacggaccagacaagaaagtaggacacgcctactaaacctcgtagtagtttacgngggtccttcggacccgggctacgttcgttcggggttacctaaccggtatttaccgagtttacgggctacgggtccggggttacgtacggggtaacccgtacttttacccaccgttcctacccgtaacccgtaacgttaccacggtaccgaaccggtcccgttagggaccgaacggggtaccctaagggaaacgttacggttacgggttacgggtaacgtttaacggtttttaaccttaccgtttacggttaacccgtaacggttaaccctaaacctttaacgtttttaaccgtttaaccgttttttcccggttttaccggtttaccggtttaacccgggttttacccgggggacggggttaaaccgggggttaacccgtaaagggggttaccgggtaaacggtaaaccggttaaacccggtaaaaacccgggttaacggtttacggggttacccggtaccgttacggtaacccctaacccggttagtttacccgtttcggtttaaccctttacccg

SEQ ID NO: 64028 - DNA, 798 bp, Homo sapiens
  misc_feature: GYAE6OF01BC448.31.78.H01.1.454.CMB.1.raw
  modified_base (191)..(191): a, c, t, g, unknown or other
  misc_feature (191)..(191): n is a, c, g, or t
  modified_base (251)..(251): a, c, t, g, unknown or other
  misc_feature (251)..(251): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctaggatctctggtcgcctacggggacatcgtgatgagccagtttccagactccctggctgtgtcncgtgggcgagagggccacatcaactgacaagtccagccagagttgttttatcggccccanaataacaacttacttagcttggtaccagacagaaagtaggacagcctacctaaacgtcctgtactttacgtcgggctttaccgtacccgggctacgttcccggggttacctaaccgatttaccacgtttacggcgaggtccggggttctcggggtaccgtatttaccgacttaccgtacctaaccgtataccgacgacctaaggcccttaggtaccgaacgggtacccttaggaaacggtacgttacgggtacgggtacgttaacggtttttaacgtttaaccgttacgggttaccaacgggtaaccctaaacgttaagtttaacgtttaaccgtttcccgttttttaacccgtaccggtttaaccggttttttacccggggaacccgggggttaacggggtaacccccgggtttaaaggggtacgggttacggtaaaccggttaacggtaaaaaacccggttaacggtcgggtttacgggaccggttacgtacccgtaaccccgttaattcccggtttacggttacccgtttacccgttaacccgg

SEQ ID NO: 64029 - DNA, 855 bp, Homo sapiens
  misc_feature: GYAE6OF01ESPYN.31.78.H01.1.454.CMB.1.raw
tcagcagtagacgtcacgaccggtgctcgatttagtgtgagtagtttgggtttgggggagctaacaacaggcaggcaggggcagcaagatggtgttgcagacccaggtcttcatttctctgttgctctggatctctggtgccgtacggggacatcgtgatgagcctagtttccagactccctggctgtgtctcgtgggcgaggagggccaccatcaactgacaacgtccaagccagtagttcgtttttacgttcggacccccaacgtaaaactaacctaaaccttacgtttaacgccttttacggggtaaccaggaccggtaaaagtaaacgggtacgaacgaccgttacccctaaaccttaaccgttcgttaacgtttaaccgttacggtccggttaccttaccccggggaccgtacgtccggggtttacccggttaccggtaaccttgtactcggtcggacgtacgggtccggttggacccgggttacttacgttacctctttacccgaaccctaacgtccgttacgaaccgtaccgtaccgacccgtttcggaaccgggtaccggttaacggtaacgggtaacgttaacggttcgggttaaccgtacgtttttaacgggtttttaacctttacggttaccgtaacgtacgggttaaaccttaccgtttaaacgtttacttttaccggttttccgttaaccggtttaccgtttacccgggttcgggggtaacgggtaacccgggtaacgggttacgggtaccgtaaacggtaaactaacccggttaaaagttacgcggttacgggtaccacggtaccgtaaactcgttcttaccggtttcctcgttaccccgg

SEQ ID NO: 64030 - DNA, 754 bp, Homo sapiens
  misc_feature: GYAE6OF01BPUA2.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagacgggccaccatcaactgcaagtccagccagtagttgttttattcggccccacaataacaactacttagcttaggtaccagacagaaagtagacagccctacctaaactcctagactttacgtggtccttccgtacccgggctacgttcccggggttaccctaaaccggtattaccgacgtttacggaccgtaacggccggggttccgtaggggtaacccgtagttttaccgaccttcttaccaacccgtaattaccaaacggtcccgaacggtcccttacggaccgtacgggtaccttagggaaaggtaacgttcgggtaggtacccgttaagttttaacttaccgtgtacgaacgtactaaaccgtatttaaaccttacgttttcctttaccggttacttaacccgtttccgggtaaccgggtaacgggtaacccgtaaaggggtcgggtaacgtaaaccgttaccggtaaaaaccgtaccgttagggtacggttaccgtaccggaccgttaaccctattcccggtttaacgttccgttaccgttaaccccgg

SEQ ID NO: 64031 - DNA, 763 bp, Homo sapiens
  misc_feature: GYAE6OF01CWXU7.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctcgtggtcgccgtacgggacatcgtgatgacgcctagtttccagacctccgtggctgtcgtctcgtgggcgaggacggccacatcaactggacaacgtccacgcaggtgttttgtttacgttccggaccccaactaaataaacctaacttaacgttacgcgtttacggaaccagacgaaaggaagtacggaacacgtaccctaactaaacgtccttagtacttacggtcgtccttaccggaccgggctaccgggtccgggtttaccaacgtacttctacgttggacctgggtcggtacgtacggaccttagttccacttctaccgacagtcgacggcacggtccctaggacgacgtctaaggagtagttacggtacggtacgtttaagttttaccgacgttacgtaacgtacgaacgttaacctttaacggtttacctttaccgtttaccggttttacgtaccccgtttagggttccggggaaccgggaacggttaaccgggtaacggggtacgtaaacggttaacctaaaccgggtaaccggttagggttaccggtaaccggggttccttaaccggtaaccccttaacgtacccgttagtttacccgttccgttaaccgtttaacccccg

SEQ ID NO: 64032 - DNA, 743 bp, Homo sapiens
  misc_feature: GYAE6OF01A8KJN.31.78.H01.1.454.CMB.1.raw
  modified_base (334)..(334): a, c, t, g, unknown or other
  misc_feature (334)..(334): n is a, c, g, or t
  modified_base (377)..(377): a, c, t, g, unknown or other
  misc_feature (377)..(377): n is a, c, g, or t
tcagcagtagacgtcacgaccggtgctcgatttagtgtgagtagtttgggtttgggggagctacaacaggcaggcaggggcagcaagatgggtgttgcagacccaggtcttcatttctctgttgctctggatctctggtgccgtacggggacatcgtgatgagcctagtttccagacctccctggctgtgtctcgtgggcgaggacggccaccatcaactgacaagtccagcagtagttgtttattcgaccccaacaataacaacttacttagtcttacggtaaccagacaagaaagtacggacacgccctactaaacctctagtactttacgnggtccttccgacccgggctacggttcccgggttacctaacgtnttcagttcggacgagggtccgggtacgtacggggtaccttagtttccaccttcgtaccaacccgtataccgacgcctaacggtccctacggaccgtacggtacgtaaggaaaggtacgttgggttacggtactttaacgttttaacgttaccgttcgtaaccgaacgttaacctaaacgtttaactttaacgttttacctttaccgttttaccgttacccgtttaccgggtttaccgggaccggggttaacgggtaaccggtaaggggttacggaaacgtaaccttaacggtaaaaacgtggttagggtccgtaccgtacgtacccgtaacccttgttaccgtttaccgttaccgttccgtaaccg

SEQ ID NO: 64033 - DNA, 763 bp, Homo sapiens
  misc_feature: GYAE6OF01BTFLZ.31.78.H01.1.454.CMB.1.raw
  modified_base (374)..(374): a, c, t, g, unknown or other
  misc_feature (374)..(374): n is a, c, g, or t
tcagcagtagacgtcacgaccggtgctcgatttagtgtgagtagtttgggtttgggggagctacaacaggcaggcagggggcagcaagatggtgttgcagacccaggtcttcatttctctgttgctctggatctctggtcgccgtacggggacatcgtgatgagccagtttccagacctcccgtggctgtgtctcgtgggcgaggacgggcccaaccatacaactgacaacgtccagccaggtagtttgttttacttcggaccccaacaaataacctaactaacgttacgtcttacggtaccagacgaagtaaaagtacggacacgtaccttaacctaaacctctagtacgttacgtggtccttacgacccggntacggttcccgggtactaaccgtatctagttcggctacgggcgggtcgtacgggacccgttattacccgacttccgacctaaccataccgacggtacctaccgtcctacggtaccgaacggggttactaacggaaacgggttacgttcggggttacgggtactttaaacggttttagttaacccgtacgtaccgtaaataaccgtaaactttattttaaccctttacgttttcccttttaaccggtccgtttaaccggttcccggggaacggtacggggaaaccgttaaagggtcgggtaaacgtaacgtaaaaccggaaacggttacgtcgggtaacggccgttaacgcccgtaaacgtcttaccgttacgttcccttcggttacccg

SEQ ID NO: 64034 - DNA, 819 bp, Homo sapiens
  misc_feature: GYAE6OF01BWI1P.31.78.H01.1.454.CMB.1.raw
  modified_base (393)..(393): a, c, t, g, unknown or other
  misc_feature (393)..(393): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagacctcccgtggctggtcgtctcgtgggcgaggacgggccaacataccaacgtgacaacgtccagccgaagtagtttgttttacgttcggaccccaacaaactaaaccaaccttacgttacgtcgttacggtaaccaggaccaaaggaaacggtacggaccacgtccctaacctaaactccgtagtactttacgtcgggtacctttccggtacccgggtntaccggttaccccggggtttaacctaaccgtacttacgtaacgttcggacgtaacggtcggggttaccgtacggggtaacccgttactttaccaaccgttccctactaaccctacgttaccgaacgtaccaccgtacccgtcggaccgtacgggtacgtaaggaaacgtagttcggtacgggtacgtttaagttttaactacgttacgtaacgtaacgtacttaaacgttaacttttaaccgttaccttttccgtttacggttaccgtttaaccgggtttacgggaccggggtaaccggggtaaaccgttaacggggtaggtaaaccggtaacccgtaacggtaaaaccgggttaacgttcgggtacggtaccgttacggccctaaacgttacgtttaccgttcggtttcccttaccggttaaccg

SEQ ID NO: 64035 - DNA, 695 bp, Homo sapiens
  misc_feature: GYAE6OF01CWR22.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagacctcccgtggctgtgtctcgtgggcgaggacggccaccatcaactcgacaagtccagccaggtagttgttttagttcggaccccaacaaataaacaacctaacttagcttacggtaccagacaagaaagtaggaacagccctaccgtaaactcctagtactttacgtcgggtacttcgacccgggtctacgttccgggtccctaacggacttcattcggctagggtccggtacgtcggaccgtatttacctactctaccacatcgagcagtcctgccgaggtacgtacgaagtagtgtgtacgttaagtttattacgtcgtacaacgtacaaatacgtttaacttactttaccgtttcgttaccgtaccggttttacgggaaccgggtacgggtaaccgtaaagggtcggtaaaccgtacgttaacgtaaaaccggtaaggttacgggttcggtaccgtaccgtaccccggtaaccccttaagtttccccgtttacggttacccgtttcgttaacccccg

SEQ ID NO: 64036 - DNA, 810 bp, Homo sapiens
  misc_feature: GYAE6OF01BGBQI.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagacctccctggctgtgtctcgtgggcgagaggccacatcaactgacaagtccagccagtagttgttttacttcggacccccaacgaataacaactacttagtcttaggtaccagacaagaaagtagacagaccctacctaaactcctagtactttacgtggtccttccgtacccgggctacgttcccggggttaccctaaccggtacttcgtagttcggacgtacgggtccggggttacgtcggggtaacccggttacttttaccgaccgttaccgtaccaaccgtacgttaccgtaacggacctaacggtcccgttacggaccgacgggtaccgtaacggtaaacggtacgttacggttcggggtaccgtttaacggttttttaaccgttacgttacggttacccgtaacggtaacctaaaccgttaacttttaaccgttaacctttttaccgttttacccgttaccgtttaaccggttttacccggggaaccggggtaacggggtaacccgttaaaggggtacgggtaaacgttaaacggtaacccgtaaaaccggttacgttacgggttacggtacccgtacggtaaccctaaccgtaccgtttaaccgttcggtttaccgttccgttaaccccg

SEQ ID NO: 64037 - DNA, 728 bp, Homo sapiens
  misc_feature: GYAE6OF01DDFU8.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctcgtggtcgccgtacgggacatcgtagagtgacgtcctacgttccacgtcctccgtggtcttgtcgtcgtcgtgggcgacggacgggccaccactacgaactcgactaaccgtcgacgaccgaggttagttttacgtttacgttcccggacccctaacctaaataacctaaaccttacgttacgcgttacgaaccgagtaacgtaacggtaaagtaacggacacgtacccttaacctaaacctcgtagttacgtttacgtcggtaccttaccggtacccgggtctaccgggttccgggttaacctaacgttacgttcgtacgtcgtcgacgggttcggtcgtacggtacctacttccaacttccgacacgtacgacacgtcgtacgtcgtacggcgtacggtacgtaggtaacgtagtcgggtatcgttaagtttacgtacgtactacgacgtaactaacgttattacgttaccttcgttaccgtaccgttacggttcgggaccggtacgggaacggtagggtacgtaacgtagtaaccgtaaacggttgacggttcgctacggtacctactacttacgtcgttacctcgtacccg

SEQ ID NO: 64038 - DNA, 708 bp, Homo sapiens
  misc_feature: GYAE6OF01CJMLU.31.78.H01.1.454.CMB.1.raw
  modified_base (671)..(671): a, c, t, g, unknown or other
  misc_feature (671)..(671): n is a, c, g, or t
  modified_base (700)..(700): a, c, t, g, unknown or other
  misc_feature (700)..(700): n is a, c, g, or t
tcagcagtagacgtcacgaccggtgctcgatttagtgtgagtagtttgggtttggggggagctacaacaggcaggcaggggcagcaagatggtgttgcgacgacccaggtcttcatttctctgttgctctggatctctggtgccgtacggggactatcgtagatgagcctagttccagactcccgtgctgtgtctcgtggcgaggacggccaccatcaactcgacaagtccagccgtagtagttagttttactcggcccctaacaaattaacctaacttacgttagtactttaggtaaccagacaaagtaaaaggtacggacacgtacccttaacctaaaactccgtagttatttaccgtcggtccttaccgtacccgggctaacggttcccggggttactaaccgtattcgaagttcgacgacggtcgggtcgtacggaccgtattccgactccgtacgaacctaagtccgacgtacgacgtacccgtggaccgtacggtactaagggtaagtacggttcggtacggtacgtttaaagttttacgttaacgtacgttaaccacgttaaccctaaagttaactttaacgttactttccgttttaccgtaccgttacgggtttaccggaacgggtacggtaccgtaagggtgaacgtacgtacgaaacggtntagggtcacgttcgactctacgtccttanttacgtcc

SEQ ID NO: 64039 - DNA, 859 bp, Homo sapiens
  misc_feature: GYAE6OF01DKIOO.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagttccagactccctggctgtgtctcgtgggcgaggacgggccaccatcaactgacaagtccagccagtagttgttttattcggccccacaataacaactactagcttggtaccagcaagaaagtaggacacgcctacctaaactcctgtatttacgtcgggtccttcgtaccccggggactacgttcccgggggtttaccctaaaccggtacttacaacgtttcggaccgacgggtcggggttccgttacgggggtaacccgttaagttttcccaaccgttcctaccgaaccctaacttacccgaacggccgaaccggtcccgtacgggaccgtaacgggaccgttaagggtaaaggtaacgttacggggttacggggttaccgtttaacggttttttaacgttttaaacccgttgggtttaaccctaacggttaaccctaaaacgttaacgttttaaacctttaacccgtttttacccgttttttcccgtttaaccgttacccgggtttttacccgggggaaccggggtaaccgggggttaacccggttaaaagggggttacggggaaacggtaaaaccgttaaaccggtaaaaaaacccgggttaaaccgttcggggttacgggtaccgttacggaaccccttaaacccgtacttttacccgttacccggtttccgtttacccgtaaccccg

SEQ ID NO: 64040 - DNA, 686 bp, Homo sapiens
  misc_feature: GYAE6OF01CVSZT.31.78.H01.1.454.CMB.1.raw
tcagcagtagacgtcacgaccggtgctcgatttagtgtgagtagtttgggttgggggagctacaacaggcaggcaggggcagcaagatggtgtgcagacccaggtcttcatttctctgttgctctggatctctggtgccgtacggggacatcgtgaatgacgcctagtttccagacctcccgtggctgtgtctcgtgggcgagacggccaacctatcaacgtgacaacgtccaggaccaaggtattggtttatacggacccctaacaataacaactacttagcttagacagcaagtaaacgtacggacacgtcctacctaaactccgtagtactttacgcgggtcttacgaccggctacggtccgggttaccaacgtactctagttcgcgacggtcgggtcacgggacctacttcactcgtacaaccgtataccaaggcaacggccctacggcgaacggtactaaggaaggtatacgggtatacctaggtttttacacgttcgaccgtaacaaccgtaacttaatttaactaccgttttccttttacggaccgttaccgtttcgggaacgggtacgggtaaccgtaaagggttcggaactaaacgggtaacctaaaacgggtaactgggtacccggacttacgaaccctaaccgtaattcccggttaattcccgttgttaaacccg

SEQ ID NO: 64041 - DNA, 627 bp, Homo sapiens
  misc_feature: GYAE6OF01AY0JX.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagacctccctggctgtgtctcgtgggcgagacgggccaccatcaactgacaagtccagccagtagttgttttagttcggaccccaactaaataactaactacttacgtcttacggtaccagacaagaaagtaggacacgccctacctaactcctagtactttacgtcggtccttccgtacccgggctacgtcccgggttacctaacgtattctagttcggcgacggtcgggtcgtcgggtacctattccactcctacaccatcacgcacgtccgtcgacgaggtcgtagaagtgtggtggtctagtttattacgtcgtactagactaactatttacttactttccttcgttcgtaccgtttcggacgggacggtaccgtaagggtacgaagtaacgtaacgaaacgtacgtggtcggacgtcgacctacctactcttcgttccgttacgtacccg

SEQ ID NO: 64042 - DNA, 667 bp, Homo sapiens
  misc_feature: GYAE6OF01ENVMI.31.78.H01.1.454.CMB.1.raw
  modified_base (398)..(398): a, c, t, g, unknown or other
  misc_feature (398)..(398): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagttccagtacctcccgtggctgtgtctcgtgggcgaggacgggccacatcaactgacaagtccagccagtagttgttttagttccggacccccaacaaataaccaacttacttacgtcttacggtaccagacaaaggtaaaaggtacggacacgacccttacctaaactccgtagtactttacgtcgggtccttaccggacccgggctacggttcccgggttacctaacgtnttcagttcggacgtagggtccgggttcgtacgggacctatttccacgtccacaccatcacgcacgcctgcgaggctagaagtagtgtacggtacgttagtttacgttacgtgtacaagtaacctaattattacctttacgttccttacgttaccgttacggtttcgggacgggtaacgggtaccgtaaggggtcgtaacgtaacgtaaccgtaaacgtacgtaggtcggtaccgtacgaccttacgacttcgttcgttccttctacccg

SEQ ID NO: 64043 - DNA, 668 bp, Homo sapiens
  misc_feature: GYAE6OF01DLVIP.31.78.H01.1.454.CMB.1.raw
  modified_base (599)..(599): a, c, t, g, unknown or other
  misc_feature (599)..(599): n is a, c, g, or t
  modified_base (628)..(628): a, c, t, g, unknown or other
  misc_feature (628)..(628): n is a, c, g, or t
tcagcagtagacgtcacgaccggtgctcgatttagtgtgagtagtttggggtttgggggatctacaacaggcaggcaggggcagcaagatggtgttgcagacccaggtcttcatttctctgttgctctggatctcgtggtcgaccgtacggggacatcgtgatgacgcctagttccagctcccgtggctgtgtctcgtgggcgagaggccacgatcaatgacaacgcagtccagagtttgtttatcggcccaacaaataactaactctagtcgttagtaaccagtacaaggtaagacgacagtaccctactaaacctccgtagtacttacgcggtcttaccgtacccggatacggtcccgggttacaaccgtagttcagttcgcgaggtcgggtcgtacgggactacttcgaactccgtacaaccgtatcgaacgtcaacggtctacggacgacggtatagggtaaaactcgtaggttacgaatttaagttttaccctaagttcttacgaacgtaccttaaacgttaaattttcgttaacctttcgtttaccgtaccttaacgggtttcgggaaccgggaacggtaacgtaaacggggngtaaacgtaacgtaaacgaacggttacgnggtacgataccgacgttactacttctcttactaccgtacg

SEQ ID NO: 64044 - DNA, 613 bp, Homo sapiens
  misc_feature: GYAE6OF01BSOJB.31.78.H01.1.454.CMB.1.raw
  modified_base (428)..(428): a, c, t, g, unknown or other
  misc_feature (428)..(428): n is a, c, g, or t
  modified_base (431)..(431): a, c, t, g, unknown or other
  misc_feature (431)..(431): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgaggagggccaccatcaactgcaagtccagccagagttgtttattcggccccacaataacaactacttagcttgtaccagcaagaaagtaggacagcctacctaaacctcctagatttacgtgggcttccgtacccgggcacgtccggggttacctaaccgtattcagttcggcaggcgggtcgtgggaccgtattcactctacaccatctagcacgcctgcaggcagaagntgnggtactagtttattacgtgtcagtacaactattaacttactttactttccgttacttacgtttaccgggtacggagggtaacccgaagggttacggacgtaaacgttaccgaaaacggtaacctcgggtacggtaccgtacggaccaaccgttactaccggttccttacgttcctaacccgg

SEQ ID NO: 64045 - DNA, 641 bp, Homo sapiens
  misc_feature: GYAE6OF01B6679.31.78.H01.1.454.CMB.1.raw
  modified_base (448)..(448): a, c, t, g, unknown or other
  misc_feature (448)..(448): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagacctccctggctgtgtctcgtgggcgaggacggccaccatacaatgacaacgtccagccagtagttgttttacgttccggaccccaacaaataaacctaactaccttagtctacggtaccagacaggaaacgtaggaccagccctacctaactcctgtactttacgtcggtcttaccggtacccggctacggttcccgggttacctaaacggtctacgtacgttcggctagggtccggttcgtcggggtacctatttaccgcctactaccaccntacgacgcaccgcgtgacgaggctagacgtagtggtacgtagttactttattacgtctcgaacgtacaacttatacttacttcgtttacgtcttacggttacggacggtacggaacgtagggtaggaacgtacgtagaaacgttgaaacggttggaggtaccgtcgtaccacgttactccgttcgttccgttc

SEQ ID NO: 64046 - DNA, 788 bp, Homo sapiens
  misc_feature: GYAE6OF01CDBTF.31.78.H01.1.454.CMB.1.raw
  modified_base (182)..(182): a, c, t, g, unknown or other
  misc_feature (182)..(182): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagacctcccgnggctgtcgtctcgtgggcgaggacgggccaccatccaaacgtgacaacgtccagacctaaggtagtttgtttttacgttccggaccccctaaacctaaactaaacctaacttaccttaacgtcctttacgggtaaccagtaccgaaaggtaaaacggtaacggaaccaacggtccccttaaccccttaaaaccgttccttacggtaacgtttttaccggtacggggttccttttacccggtaccccggggcttacggttccccgggggtttaacccttaaccgtacgtttcaacggtttggaccgagggtaccggggtcgtacggggtacccgttacgtttcctacgttcctacccacctacgtacacgactacgtccgttagccgtaggtaccgtagaaagtgttacggtggtacgttagttttactacgtcgtcgtaacgctaaactatttaacttcctttacgttacgttacttaccggtttcggggaacgggtacgggtaaccggtagggttacggaacgtaaccgttaaccggaaaacgttacgtagggttcggccgtacggaccctaccgtacgttccgttcgttacttccgttaccccg

SEQ ID NO: 64047 - DNA, 798 bp, Homo sapiens
  misc_feature: GYAE6OF01ADSZ8.31.78.H01.1.454.CMB.1.raw
  modified_base (550)..(550): a, c, t, g, unknown or other
  misc_feature (550)..(550): n is a, c, g, or t
  modified_base (782)..(782): a, c, t, g, unknown or other
  misc_feature (782)..(782): n is a, c, g, or t
tcagcagtagacgtcacgaccggtgctcgatttagtgtgagtagtttgggtttgggggtaggcgtacgaacaggcgaggcgaggggcgagcaagatggtgttgcagacccaggtcttctatttcctctgttgctctggatctcgtggtcgaccgtacggggacatcgtgatgagcctagtttccagtacctcccgtggctggtcgtcgtcgtagggccgaggacggcccaccgatccaactggcaacggtccacgaccaggtagtttgttttactccggacccccaactaataaacctaacctacttaagtcgttacggtaacccagaccaaaggtaaacgtaggacacgtcccgttaaaccccttaactacccgtgttaacgtttaccggtcggggtacccttccgttaaccccggggcttaaccggttcccccgggggttaaccctaaacgtacgttccgttaggttaacggccaacggggttccgggtacgtaccgggtaacccttagttttacccaccgttacccgtccctaaaccgtagtaccgngtacccgaactccgtacgaccgtacggtccgtaagtaacgacgttcggtacggttaaccgtagttttaacttacggtcttacgaacgtacgttaaccttaattcccgtttaaccgttacgtttccgttaccgtttaacggttccgggacgggtaaacgggtactagggtagtacgtaacgtaaccgaagttacccggtggtccgtacgtccaaacggtcctagttaaccgtntttccgtagtaccccg

SEQ ID NO: 64048 - DNA, 538 bp, Homo sapiens
  misc_feature: GYAE6OF01BB3NH.31.78.H01.1.454.CMB.1.raw
  modified_base (419)..(419): a, c, t, g, unknown or other
  misc_feature (419)..(419): n is a, c, g, or t
  modified_base (443)..(443): a, c, t, g, unknown or other
  misc_feature (443)..(443): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggccccacaataacaactacttagcttggtaccagcagaagtagacagcctactaaactcctgtatttactgggcttctacccgggcacgtccggggttcctaaccgtattcattggcaggcgggtctgggaccgtatttcactctcaccatcacgcacgcctgcaggctgaagatgnggctagtttatactgtcagcaatntttatactttctttcgtctaacgtttcggcggtacgggaccgtaaggtggagactacgaaacgtatggtgctgcctactatccgtgtctctaccg

SEQ ID NO: 64049 - DNA, 802 bp, Homo sapiens
  misc_feature: GYAE6OF01D9VFZ.31.78.H01.1.454.CMB.1.raw
  modified_base (446)..(446): a, c, t, g, unknown or other
  misc_feature (446)..(446): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagactccctggctgtgtctcgtgggcgagacgggccaccatcaactgacaacgtccagccaaggtagttgtttttacttccggacccccaacctaaactaaacctaaaccttaacttaacgtcgtttacgggtaaccctaggaccaaaggaaaaggtacggaacctacgtacccttaaccctaaaaccttccttaggtaacttttaccggtcgggtcctttacccggtaccccgggtactaacggttccccgggggtttaaccctaaaccggtntttaccgagtttcggacgacgggtcgggtcgtcggggaccttagtttccactcctacgacctagtaccacgccgtacgtcccgtggacctagggtacctagggaaacgtggttcggttcgggtaacctttaggtttttaacgttaaccgtggtaacctaacggtaacctaaacttactttacgtttaacctttttcgtttaccgttaccgttacccggttttacggggaaccggggtaacgggttaaccgtaagggttacggaaacgtaacgtaacccggtaaaaacggtacgttcggtacggtcgttaacggcccttaaaccggtctttaccggttctttaccgttcctacccgg

SEQ ID NO: 64050 - DNA, 804 bp, Homo sapiens
  misc_feature: GYAE6OF01CCAWN.31.78.H01.1.454.CMB.1.raw
  modified_base (430)..(430): a, c, t, g, unknown or other
  misc_feature (430)..(430): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagacctcccgtggctgtcgtctcgtgggcgaggacgggccaaccatcaacgtgctaaagtccagccagtagtttgttttacgtccggaccccaactaaactaacctaacttacgttagtccgttacggtaaccaggaccaaggtaaaggtaccggacacggtcccttaacctaaacctccgtaagtacgtttaccggtacgggtcctttaccggtacccgggactaccgggttaccccggggttaccctaaaccggtnttaccgtaggttcggacgtacggggtccggggtacgtacgggggtaacccttaagtttccaccgttaccctaccaaccgtacgtcgacggaccacgtaccgtggaaccgacggggtacctaaggtaaacgtggttacggtacggactttaagttttacgttacgtcgtacgaacgtaacgtaaactactttaacgttacccttttccgtttacggtaccttacccgggtttacggggaaccgggtaacgggtaaccggtaaagggttaccgggaaagtaaccggttaaaccgaaaaccgggtgttaccggtcggtaccgtaccggtaacctacccgtaagtttcccgtaacgtttcccgtttaccgtaaccccg

SEQ ID NO: 64051 - DNA, 694 bp, Homo sapiens
  misc_feature: GYAE6OF01EATBG.31.78.H01.1.454.CMB.1.raw
tcagcagtagacgtcacgaccggtgctcgatttagtgtgagtagtttggggtttgggggagctacaacaggcaggcaggggcagcaagatggtgttgcagacccaggtcttcatttctctgttgctctggatctctggtgccgtacggggacatcgtgatgagcctagtttccagacctccctggctgtgtctcgtgggcgaggacgggcccaaccatcaactgacaagtccagccaagtagttgttttattcggaccccaacaaataacaactacttagcgttcggaaccagacaaaggtaaagtaggacacgtccctacctaaaactcctagtactttacgtggtccttccgtacccgggctacgttcccggggttacctaaacgtatcaagttcggacaggtccgggtcgtacgggtacctagtttccaacttctaccaacctatacgacgaccacgtcctcgcgtaggtaccgtagaaacgtagttggtacggtacgttaacgttttaattacgtacgtacaacgtactaaacttaactttaacttactttccgtttccgttaccgttaacggtttccggggacgggtaacgggtaacccgtaaagggtacggtaaacgaaagtaaccgaaaacgtaagttcggtacggaccgtagaaccctacgtacttacttcgttccttcgtaaccc

SEQ ID NO: 64052 - DNA, 688 bp, Homo sapiens
  misc_feature: GYAE6OF01EDQMO.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgacaagtccagccagtagttgttttattcggaccccaaccaataacaactacttagcttaggtaccagcaagaaagtaggacacgtcctacctaaactcctagtatttacgtcgggtcttccgtacccgggctacgttcccggggttacctaaccgtcttcagttcggcacgggtcgggtcgtagggtacccgtatttcgacttctaccaacctattaccgacgacgacgcccttggacctagggacttacggaaagtagttggtacggtacgttaaggttttaacttaccgtgtaccaaggtaacctaagttaactttaacttaccttttcctttccggttaccttaccgggttttcgggacggtaacgggtaaccgtaaagggtcggtaaaggtaacctaacgaaaacggtactagggttcgacctacgggacctaaccgtattaccgttcggttacttcccgttaacccg

SEQ ID NO: 64053 - DNA, 694 bp, Homo sapiens
  misc_feature: GYAE6OF01AETID.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcagacgggccaccatcaactgcaagtccagccagagtgttttatcggccccacaataacaactacttagcttggtaccagcagaaagtaggacagcctacctaaactctgatttactgggcttcgtaccggcacgtccgggttctaaccgatcattggcagcggtctgggactattcactctacaccatcgacgacgacgtcccgtgtccgacggtcttaggaaaggtacgttgggtacgggtaccgttaaggtttttaacgtttaaccgttggttaccaaggtaccctaaacgttaacgttttaacgtttaacccgttttccgtttttaccgttaccgttaaccggttttacccggggtaccggggtaacggggtaaccccgtaaagggggttcggtaaacggtaaccgttaaccgaaaacccggttaaacggttcggttacgggtaccctacggtaccctaacccgtactttaccggtcgtttcccttcgttaacccg

SEQ ID NO: 64054 - DNA, 736 bp, Homo sapiens
  misc_feature: GYAE6OF01BYYP2.31.78.H01.1.454.CMB.1.raw
  modified_base (366)..(366): a, c, t, g, unknown or other
  misc_feature (366)..(366): n is a, c, g, or t
  modified_base (391)..(391): a, c, t, g, unknown or other
  misc_feature (391)..(391): n is a, c, g, or t
  modified_base (674)..(674): a, c, t, g, unknown or other
  misc_feature (674)..(674): n is a, c, g, or t
tcagcagtagacgtcacgaccggtgctcgatttagtgtgagtagtttgggttgggggagctacaacaggcaggcaggggcagcaagatggtgttgcagacccaggtcttcatttctctgttgctctggatctcgtggtcgccgtacggggacatcggtgatgacgcctagttccagacctcccgtggctgtcgtctcgtgggcgaggacggccacatcaactgacaacgtccagccagtagttgttttacgtccggaccccaactaaactaacctaacttactagcgttacggtaccaggtacaagaaaggtacggacacgtacctacctaactcctagtacttacgtcggtccttccgacccggntaccgtccgggttacctaaaccgtntacgtaggttcggacgtacgggtcgggttaccgtacgggtaccttacgttaccacctcctaccgaacctagtacccgacgaccgtaccgtcccgtaggaccgtacggtaacgttaacggaaacgtagttcggtaggtacccgtttaagtttaacgttaccgtacgtaccgaacgtacttaaacgttactttacttacctttacgttacccgtaccggttaccggttcgggaacgggtacggaaccggtaagggtaggaaccgtaagtaaccggaaacgttacncgggtacgtacccgttacgggaccctacttacttaccgttcgtttaccccgttagttccccg

SEQ ID NO: 64055 - DNA, 722 bp, Homo sapiens
  misc_feature: GYAE6OF01EJAF2.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagtttccagactccctggctgtgtctcgtgggcgagacggccaccatcaactgcaagtccagccagtagttgttttatttcggccccaacaataacaactacttagcttggtaccagcaagaaagtaggacagtccctacctaaactcctagtatttaccgtgggtcctttaccgtacccgggtactacggttccccgggggttaccctaaaccggtattccgaagtttcggacgtacgggtccggggttcgtacgggggacccttagtttccgaacttcctaccaacctaatccgaacgtccgaacgtcccgtgaccgacggtacgtagaaacggtattcggtacggtaccgttaagttttaacttacgtgtaccaagacctaaataactttacttaccgttttcctttaccggttacttaccggtttaccgggacgggtaacggggtaacccgtaaagggtacgggtaacgtaacgttaaccgaaaaccggtaacgttggtaccggtacgtacggaacctaacccgtagttacctttcggttaccttcgtaacccg

SEQ ID NO: 64056 - DNA, 703 bp, Homo sapiens
  misc_feature: GYAE6OF01BX2G0.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgaggagggccaccatcaactgcaagtccagccagtagttgttttattcggcccccaacaaactaacaacttacttagcttggtaccagacaagaaagtaggacagcctcctaaactcctagatttacgtgggtccttccgtacccgggctacgtcccgggggttaccctaaaccgtattaccagtttcggaccgaggccggggttctcggggtacccgtactttccacttccgtacctaccacttacacgctacgcccgtacgaccgtaggaccgtaggaaaggtacgtaggtacgggtacttagttttaacttaccgttgtacgtaacgaccgtaaacttaatttaactttaccgtttacttttaccgttaccgttacgttttaccgggacgggtaacgggtacccgtaaggggtacgggaacgtacgtaaccgtaaaacggttaacgtcggttcgggacgtacggaacccgtaccctaacgttcgttccgttccttcgttacccg

SEQ ID NO: 64057 - DNA, 720 bp, Homo sapiens
  misc_feature: GYAE6OF01A0RTL.31.78.H01.1.454.CMB.1.raw
  modified_base (374)..(374): a, c, t, g, unknown or other
  misc_feature (374)..(374): n is a, c, g, or t
tcagcagtagacgtccacgaccggtgctcgatttagtgtgagtagtttgggtttgggggatctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggcccaccatcaactgcaagtccagccagagttgttttattcggacccccacaaataacaacgtacttaaggcttggtaacccagtccaaggaaaagtacgggaccacggtaccctaccgtaaaacctccctgtaacgttttaccgtgggtcctttaccgtaaccccggggntacggttccccgggggtttacctaaaccggtatttccgagtttcggactagggccgggttcgtaggggaccgtatttccacgtcctcacctatcagtccacgtccctgccgaggtctaggaagtgttagtcggtactaaggttttactacgtgtacctacgactaacgttatttacgtttaacttccgttttaccgttaccgtaccgttttccggggaccggtaacgggtacccgtaagggtcggtaacgtaacgtaaccggtaaaccgtaaccggttgggtccggtaccttacggaccctaacccgttacgttaccgttacggtttacccgttccgttaaccccg

SEQ ID NO: 64058 - DNA, 802 bp, Homo sapiens
  misc_feature: GYAE6OF01DZNWT.31.78.H01.1.454.CMB.1.raw
tcagcagtagacgtcacgaccggtgctcgatttagtgtgagtagtttgggtttgggggagctacaacaggcaggcaggggcagcaagatggtgttgcacgacccaggtcttcatttctcttgttgctctggatcttcgtggtcgaccgtacgggactagtcgtagagtgacgcctagttccacgtacctcccgtggtcttgtcgtcgtcggtgggaccgaggaccggccaaccataccaacgtcgaccgaacgtccgacgaccgtaggtacgttttcgtttttacgttacccggaaccccctaaacctaaaataaacctaacttaacgttacgtccgttacggtaaccagaacgtaaaggaaaacgtacggacctacgtacccttaaccgtaaacttccgtagttaactttacgtcgggtacctttacccggaccggtactaccggttcccgggttaacctaacgtcgttacgtaggttcgcgtacggtccgggtcgtacgggtacctactttacgaccgttacacctaacctagtaccgcgaccgtacgtcccgtacgacggtacgtacgtagtaagtgtcggtagtacttaagtttactacgtacgtacgtacgtaacttaacttacgtttaacctttaccgtttacgtttccgttaaccgtttaccgggttacggggaaccgggtaacggtaaccggaagggttaagtaaacggtaaaacgtaaacggtacggttacggtacggtcgtacgtaaacctcgtaattacccgttcgttaccttccgtacccttacccccgg

SEQ ID NO: 64059 - DNA, 618 bp, Homo sapiens
  misc_feature: GYAE6OF01DRPSL.31.78.H01.1.454.CMB.1.raw
  modified_base (328)..(328): a, c, t, g, unknown or other
  misc_feature (328)..(328): n is a, c, g, or t
  modified_base (369)..(369): a, c, t, g, unknown or other
  misc_feature (369)..(369): n is a, c, g, or t
  modified_base (562)..(562): a, c, t, g, unknown or other
  misc_feature (562)..(562): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagacctcccgtggctgtgtctcgtgggcgaggacgggcccaccatacaactgacaagtccagccagtagttgttttatcggccccacaataacactacttagcttacggtaccagcaagaagtaggacacgcctactaaactcctagtatttacgnggtccttcgtacccggactacgtcccgggttacctaaccgnttcagttggactagggtacgggtcgtacggggtactatttccacgtctacgaacccatccaagcctacgtcccgtacgacgacggtctaacggaagtacgttggtcggtacttagtttactacgtagtccagtactaattattacttactttcttcgtctacgtttcggacggtacggacgtaaggtgagtanaacgaacgtagttcggtcggactcggtacctactacgttctacgtcttcgtacccg

SEQ ID NO: 64060 - DNA, 850 bp, Homo sapiens
  misc_feature: GYAE6OF01EHAL9.31.78.H01.1.454.CMB.1.raw
  modified_base (601)..(601): a, c, t, g, unknown or other
  misc_feature (601)..(601): n is a, c, g, or t
  modified_base (608)..(608): a, c, t, g, unknown or other
  misc_feature (608)..(608): n is a, c, g, or t
  modified_base (707)..(707): a, c, t, g, unknown or other
  misc_feature (707)..(707): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctcgtgatctgtggtcgccgtacgggacagtcgtgagtgacgcctagttccagtccctcccgtggctggtcgtcgtcgtgggacagggaccggaccaacctataccgaacgtcgacgtaaacgtccgaacggtcccgtaaggttaggttttagtttttaccgttacccggacccccctaaaacgtaaaaattaaaacctaaccgtttaacgtttaacggtaccggtttaccgggtaaacccaaggtaaccgtaaaaggtaaaaacgggttaccggaaccgtaaccggttaccccccttaaacccttaaaaaccgttccctttaagggttaaaccgttttacggtttcccgggacccgttttacccccggtaacccgggtaccgtacccgggtttaccccggggttaacccgttaaaccgtacgtttacgtacgttacggccggtaacgggtcggggttaccggtgggtaaacccgttnttacccncgttacctacctaccagttaccacggtcaccgtccgttaggaccgtaggtaccgagtaaacggtgtcggtacggtactttaagttactttcggataacncgtaaactacgttaatttacttacctttcgtttaccgtaccgttaccggtcgggtaacggtaacggtaccggtaaggtccgataacgtaacgaacggttggcgtagccgtacgactaaccttgtcctacttacctcgtacccg

SEQ ID NO: 64061 - DNA, 787 bp, Homo sapiens
  misc_feature: GYAE6OF01B9PX3.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagactccctggctgtgtctcgtgggcgaggagggcccaccatcaactgacaagtccagccagagttgttttattcggccccacaataacaactacttagcttggtacagacaagaaagtagacagcctacctaaactctagtactttacgtcgggtccttcgtacccgggctacggttcccggggttaccctaaccggtattacgagttcggactacgggtcggggtccgtacggggtacctacgtttccaacgttccgtaccaccctagtccgaacggtccgaacggtcccgtggaccgtacgggtcgtaaggaaacgtacgttagggtcggtaaccttaagggtttttaacttccggttacggtccgtaacggtacctaaaccgtttagtttaacctttaaccgtttttccggttttaccgttaccgttaaccggggtttttaccgggaccggggttaaccggggtaaacccgttaaagggggtacgggtaaacgttaaaccggttaaacgaaaaacccgggttaacgttacggggtacgggttacccgttaaccgggacccgttaacccggttagtttacccctacgggtttaccctttacggtaaccccgg

SEQ ID NO: 64062 - DNA, 656 bp, Homo sapiens
  misc_feature: GYAE6OF01AQBTH.31.78.H01.1.454.CMB.1.raw
  modified_base (179)..(179): a, c, t, g, unknown or other
  misc_feature (179)..(179): n is a, c, g, or t
  modified_base (369)..(369): a, c, t, g, unknown or other
  misc_feature (369)..(369): n is a, c, g, or t
  modified_base (428)..(428): a, c, t, g, unknown or other
  misc_feature (428)..(428): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactcccnggctgtgtctcgtgggcgagagggccaaccatcgaactgcaagtccagccagtagttgttttattcggccccaactaataaccaactacttagcttggtacagacaagaaagtaggacacgcctactaaacctcctagtatttacgtgggtcttccgtacccgggctagttcccggggttacctaaccgnttactattcggactagggcgggttccgagggtacccgtattccaactctcaaccatcancacgccgtgcgagctagaagagtgtggacttagtttatactggtacacgactaactaatttaacttaccttttccgtttacgttaccgttaccgtttacggggaccgggtaacgggaaccggtaaagggttacggaaggttaactaaaccgtaaaaccggtaaggttcggtacgggtactaaccggccgtaaccctagttaccgttccggttaccctttacgtacccg

SEQ ID NO: 64063 - DNA, 768 bp, Homo sapiens
  misc_feature: GYAE6OF01EY2PZ.31.78.H01.1.454.CMB.1.raw
  modified_base (350)..(350): a, c, t, g, unknown or other
  misc_feature (350)..(350): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagacgggccaaccatcaactgcaagtccagccagagttgttttattcggccccaacaataacaactacttagcttggtaccagacaagaaagtaggacacgtccctacctaaactcctagtactttacgtgggtcctttccgtaccccggggntacggttccccggggtttaccctaaaccggtctttaccgaagtttcggaccgtagggtcccggggttaccgtacgggggtaacccgttaagtttttcccgaacctttcccgttaccgaaacccctaagttccgaacggtaccgtaacggtccccgttacgaccgacgggtacgtaacggaaacgtagttcggtacggtaccgttaaggttttaactttacgttacgtacgtaacggtacctaaaccgttaatttaactttaccttttccgttttaccgttaccgttaaccggttttcgggaccgggtaaccgggtaacccgtaaaggggttacggtaagtaacgttaacgaaaacggttacgttacggtcgggacctgtaccgtacccttacttacgttcgttccgttacgttacccg

SEQ ID NO: 64064 - DNA, 850 bp, Homo sapiens
  misc_feature: GYAE6OF01C814Z.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctcgtggtcgccgtacggggacatcgtgatgacgcctagtttccagtacctcccgtggctgtcgtcgtcgtgggcgacggacggccaacactacaacgtcgactacgtcacgactaggtagtttgttttacgtccggacccaactaaataacctaacttacttacggtacgtttacggaacccagacgtaaaggaaacggtacggaccacgtaccctaactaacctccgtagttacctttacggtcggtccgttacccgtacccgggtagttaaccccggttacccggggtttaaccctaaccggttacttacgtacggtttacgggaccgtaccggggttacgggtaccggtacgggtaccgttaccttacctacccgtaccttaccgaaacctcgttacgacgtaccgaccgtccgtacgaccggtacggtactaacggtaattacggtacgggttaacgtacggttttaacgttttacggttaccgttacgtaaccgtaagtaaccctttaaacgtttaacttttacctttaccggttttacccgttaaccgggtttccggtttaacccgggtttacggggaacccgggtttaaaggggaaccgtacggggtacgggtaaaactaaccggtaaaccggtaaacgttacgggtggttccggaaccggttaccgtaacctacccgttaagttccgtcctttaccgtccgtttaccccg

SEQ ID NO: 64065 - DNA, 645 bp, Homo sapiens
  misc_feature: GYAE6OF01EO0T3.31.78.H01.1.454.CMB.1.raw
  modified_base (375)..(375): a, c, t, g, unknown or other
  misc_feature (375)..(375): n is a, c, g, or t
  modified_base (400)..(400): a, c, t, g, unknown or other
  misc_feature (400)..(400): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacgggacatcgtgatgagcctagtttccagtacctccctggctgtcgtctcgtgggcgaggacggcccaccatccaactgaccaagtccagccaagtagttgttttacgttcggaccccctaactaaataaaccaacttacgttaagccgttacggtaacccagaccaaggaaagtaggacacgtccctacctaaactcctagtacttacgtcgggaccttaccgtacccggntacgttcccgggttacctaaccgtnttcagttcggcaggtcgggtctagggaccctattcgacttccgtacaccatacgagactacgcctgcacggtctaggaagtgtggtagtactagtttacttacgtgtacacgtacaacttattacttacttcgttccgtactacgtttcggacggtacggaccgtaagggtggacacgtaaccgaaacgtaaggtggtacggtaccgtacgaccgtacctagttaccgtcgttcctacgtacccg

SEQ ID NO: 64066 - DNA, 775 bp, Homo sapiens
  misc_feature: GYAE6OF01B9E2M.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacgggacatcgtgatgagccagttccagactccctggctgtgtctcgtgggcgagagggccaccatcaactgacaacgtccagaccagtagttgtttttacgttcggacccctaaccaaataaccaaccttacttagtccttacggtaaccagtacgaagaaaggtacggacagaccctacctaaacctccttagtacttttaaccgtggtccttccgtacccgggtctacggttaccccggggtttaccctaaccggtacttctaacgttcggcgtacggtcggggtctcggggtaccgtaactttccgactccgtaccaaccgtactccgacgtacctaacgtccctggtaccgagggtaccgtaagaacgtaagtggttacggtacgttaacggttttaactttacgttagtaccgtaacgtaacctaaaccgttaacttttacgtttaaccttttaccgtttaccgtttaccgttaaccgttttaccggggaaccgggtacgggaaccggttaaacgggtagggtaacgtaacgtaaaccggaaaccggttaacggttaggttaccggaccgttcggaacccgttacccttaacgttcccgtttacggttaccctttcgttaaccccg

SEQ ID NO: 64067 - DNA, 722 bp, Homo sapiens
  misc_feature: GYAE6OF01BRUOK.31.78.H01.1.454.CMB.1.raw
  modified_base (379)..(379): a, c, t, g, unknown or other
  misc_feature (379)..(379): n is a, c, g, or t
  modified_base (405)..(405): a, c, t, g, unknown or other
  misc_feature (405)..(405): n is a, c, g, or t
tcagcagtagacgtcacgaccggtgctcgatttagtgtgagtagtttggggtttgggggagctacaacaggcaggcagggggcagcaagatggtgttgcagacccaggtcttcatttctctgttgctctggatctctggtgccgtacggggacagtcgtgatgacgcctagtttccagtacctcccgtggctgtgtcgtcgtgggcgaggacggccaccatacaactcgacaacgtccgagcctaaggtagtttgttttactccggaccccaactaactaacaacttacttacgcttacggtaacaggacaagtaaacgaggacacgtaccttaacctaaactcctagtacttacggtcggtaccttaccggaccggtntacgtcggttacggttacctaacgtnttacgaggttcggacgtacgggtcggtacgtacgggtaccttactttaccgcctacctaccgaaccctatcgtaaccgctaccggtcgtacgacggtacgtacgtaaggaattcggtggttacgtacgtttagtttaactcgtaccggataacgtaccttaatttaacgttaccttttccggtttactccgtttaccgttagggttacccgggaagggtaaccggtacgaaagggttcgaaacgtacgttaaaaccgacgggtagttcgggtctaccgtactacccgtacgttactcggtttacttcccggtaaccc

SEQ ID NO: 64068 - DNA, 663 bp, Homo sapiens
  misc_feature: GYAE6OF01ELDU2.31.78.H01.1.454.CMB.1.raw
  modified_base (331)..(331): a, c, t, g, unknown or other
  misc_feature (331)..(331): n is a, c, g, or t
  modified_base (375)..(375): a, c, t, g, unknown or other
  misc_feature (375)..(375): n is a, c, g, or t
tcagcagtagacgtcacgaccggtgctcgatttagtgtgagtagtttgggtttgggggagctacaacaggcaggcaggggcagcaagatggtgttgcagacccaggtcttcattttctctgttgctctggatctctggtgcctacggggacatcgtgatgagcctagttccagacctccctggctgtgtctcgtgggcgaggacgggccaccatcaatgacaagtccagccagtgttgttttattcggacccccaacaataacaactacttagcttggtaccagacaagaaagtacggacacgtccctactaaactcctagtactttacgnggtcttccggtaccggctacggttcccgggttacctaaaccgtnttcagttcggcgtacggcgggtcgtagggaccgtatttacgctcgtcacctatccgagccacgtctgactagctagaagtatggtggtacttaggtttactacgtgtacagtactaaactatttacttacctttcgtttaccgttaccgttacggttttccggggacgggtaacgggtacccgtaaagggttagggtaacgtaagttaaacccgaaacggtaacgttacgggttcggaccgtccggtaacctaaccttacttaccttcgtttacccgttgttaacccg

SEQ ID NO: 64069 - DNA, 817 bp, Homo sapiens
  misc_feature: GYAE6OF01DWX7D.31.78.H01.1.454.CMB.1.raw
  modified_base (339)..(339): a, c, t, g, unknown or other
  misc_feature (339)..(339): n is a, c, g, or t
  modified_base (388)..(388): a, c, t, g, unknown or other
  misc_feature (388)..(388): n is a, c, g, or t
tcagcagtagacgtcacgaccggtgctcgatttagtgtgagtagtttgggtttgggggagctacaacaggcaggaaggggcagcaagatggtgttgcagacccaggtcttcatttctctgttgctctggatctctggtgcctacggggacatcgtgatgagccagtttccagacctccctggctgtgtctcgtgggcgaggacgggccaccatcaactgacaagtccagccagtagttgttttacttcggacccctaactaaataaccaacttacttagcgttacggtaccagcaagaaagtaggacacgaccctacctaaactcctagtactttacgngggtcctttccgtacccgggctacgttccccggggttacctaaaccgtntttccgtagttcggggaccagggtccggggttctacggggtaccgttaatttcccgaacttccgtaccaaaccctagttccgaacggcctaacggtcccgtagaccgtaacggggccttaagggaaaggttagttacgggtacgggttaccgtttaagttttttaaccgttaacgttacggttaccgaacggtacctaaaactttacgtttaactttaacccgtttttaccgttttaccggtaccgtttaacccggttttaccgggggaaccggggttaaccgggtaaccgggttaaacggggttacgggtaaacgtaacgtttaaaccgaaaaccgggtttaccgttgggttaaccgggtcccgtacgtaccccgttaacccgtactttacccgttaggtttccccttaaccgttcgtttaccccccg

SEQ ID NO: 64070 - DNA, 859 bp, Homo sapiens
  misc_feature: GYAE6OF01DBDUG.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagttcagactcctggctgtgtctcgtgggcgaggacgggccaccatacaactcgctaacgtccagccagtagttgtttttacttcggacccctacaaataaaccgaacttaacttacgtcgtttacggtacccaagtacgaaggtaaaaggtaggaccacgaccttaaccctaaaaccttccgtagtaacgttttaccgtcggggtccttttaccgtaccccggggtacgtacggtttaccccgggggtttacctaaaacccggttacgttctaaggtttcgggtaccgtaacggggtcccgggggttaccgttacgggggtaaccccgtttacgtttacctaacccgttccttacccgaacccgtattaccgacggccgaacggttcccgtggaccgtaaggggtaccctaagggtaaacgtaggtttacgggtacgggttaacctttaagggttttttaaacgttaaccggttcgttaaccgtaacggtactaaaacccgtttattttaaaccgtttacccttttttacggtttttacccggtactttaccgggtttttccgggggaaccgggggtaccgggttaaaccgttaacgggggtacgaacgtaacgttaacgaaaaccgggtaaggtttcggcgttaccgtacgaccctaaccgttacttccgttaagttcccttacgtaacccg

SEQ ID NO: 64071 - DNA, 604 bp, Homo sapiens
  misc_feature: GYAE6OF01D48SI.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagttgttttattcggccccacaataacaactacttagcttggtaccagacaagaaagtaggacagtcctactaaactcctagtatttacgtgggtcttccgtacccgggctacgttccggggttacctaaaccgtattcgattggcaggcgggtcgtgggacctatttcactctcacatcagcacgcctgacaggctagaagatggtggtacttagttttacttacgtgtacacgtacaactatttaattacctttcgtttcgtacttaccgtttcgggaccgggtacgggaaccgaagggtaggacgtaataaccgaaaacgtaacgtggtacgggtacctcggacctacctagttctacgttccttctacccg

SEQ ID NO: 64072 - DNA, 742 bp, Homo sapiens
  misc_feature: GYAE6OF01A3YO0.31.78.H01.1.454.CMB.1.raw
  modified_base (198)..(198): a, c, t, g, unknown or other
  misc_feature (198)..(198): n is a, c, g, or t
  modified_base (581)..(581): a, c, t, g, unknown or other
  misc_feature (581)..(581): n is a, c, g, or t
tcagcagtagacgtcacgaccggtgctcgatttagtgtgagtagtttgggtttgggggagctacaacaggcaggcgaggggcagcaagatggtgttgcagacccaggtcttcatttctctgttgctctggatctctggtgccgtacggggacagtcgtgatgagcctacgtttccagaccttcccgtgggcctggttntctcgtggggcgacggacgggaccctaccagttaccaactggaccaagtccaacgacccgtagtacgtttgttttacttccggaccccctaacaaataactaacttaacctagcgttcggtaaccacgtacaaaggtaaacggaggtacaccgtacccttaacctaaacctccgttagtaacctttagccgggtacttaccccgtaccgggtacctacgggttcccgggttaacccttaaccgtcgttacacggtttacggaccacggggtacggttccgaacgggtacccggtactttaccgacttccgtcctaaccgtagtctaccgacgtacgccctaggactaggctagaagtgtacgtcggacttaagtttacttacncgtacgaacgtactaactatttactaccttcggttccttacgtaccgttacgggacggtacggtaacgtaggtacggactaaccggtaacaacccggttaagtacggttccgaaccgtcgaccgtaaccgtactttaacgtcgttaccccttgtaaccccg

SEQ ID NO: 64073 - DNA, 688 bp, Homo sapiens
  misc_feature: GYAE6OF01AZF60.31.78.H01.1.454.CMB.1.raw
  modified_base (339)..(339): a, c, t, g, unknown or other
  misc_feature (339)..(339): n is a, c, g, or t
tcagcagtagacgtcacgaccggtgctcgatttagtgtgagtagtttgggttgggggagctacaacaggcaggcaggggcagcaagatggtgttgcagacccaggtcttcatttctctgttgctctggatctctggtgcctacggggacatcgtgatgagcctagttccagacctcccgtggctgtgtctcgtgggcgagacgggccaaccatcaactgacaacgtccagccagtagttgtttacgttcggacccccaacaaactaaccaacttacttagtcttcggtaccagacaagaaagtaggacacgtacctacctaaactcctgtactttacgngggtccttaccgtacccgggctacggtcccggggttaccctaaccggtacttcgtagttggctacgggtccgggtccggtacgggtaccctacgtttaccaccgttcctaccaaccacgtccgaacgtccacggtccctaggccgaacgggtcctaaggaacgtgtacggtcggactttagtttacgttacgtcgtacacgtactaaacctagtttaacttccgtttaccttaccgtacgttaccggttccgggaacgggaccgggtaacctaggggtacgaagtactaaaccggaaacgtacgtgggcgtccgtagaccctacctacgtaccttcgttcctacgtccc

SEQ ID NO: 64074 - DNA, 655 bp, Homo sapiens
  misc_feature: GYAE6OF01A1RAP.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccaacaataacaactacttagcttggtaccagcagaaagtggacagcctacctaaactcctgacttttacgtgggtcctttaccgtacccggggctaacgttcccgggggtttaccctaaaccggtatttccagtttcggacacgggtcgggttcttggggacccgtagtttccacgtcctacaaccatcacgtcacgcctgcaagggtctaggtaagagttggtacggacttagtttacttacgtgtacctagactaactagtttaacttactttctttacgtccgttaaccgttttcgggaccgggtaacgggtaacccgtaagggttcggtagaacgttaaccgaaaacggtaacggttggtacggtccttgggacctaccctagttaccgttgttcccttcgtaccg

SEQ ID NO: 64075 - DNA, 761 bp, Homo sapiens
  misc_feature: GYAE6OF01AGX4J.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctcgtgggcgaggacggccaccatcaactgcaagtccagccagtagttgttttagttcggaccccaacaataacaactacttagcttggtaccagacaagaaagtaggacacgccctacctaaacctcctagtactttacgtgggtccttccgtacccgggtcacggttcccggggtttaccctaaccggtattccgtagttcgggccacgggtccggggttcgtacggggtacccgtactttccaccgtcctccaacctactaccacgaccacgtcccgtgacgacgggtcttaggaaagtgttcgggtacggtaccgttaagttttaacttacgtacgtaccgtaacgtaacctaaacgttaattttaacgttaacctttttccgtttacccgggttaccttaacccgggttttccggggaaccggggtaacgggtaaacccggtaaggggttacggtaaacgtaaccgttaaaccggaaaaccggttaacgttacgggttcgggtacccgttaccggacccgtaacccgttaacttaccggtttccggtttaccctttccgttaaccccg

SEQ ID NO: 64076 - DNA, 625 bp, Homo sapiens
  misc_feature: GYAE6OF01BW9LF.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctcgtgggcgaggagggcccaccatcaactgccaagtccagccagtagttgttttattcggccccacaataacaactacttagcttagtaccagacaagaaagtaggacacgccctacctaaactcctagtactttacgtgggtcctttccgacccgggtctacggttcccggggttaccctaaaccgtatttccagtttcggcgagggtccggggtcgtcggggaccctatttccacttcctaccacctatcagcacgcctgcgaggctagaagtagtggtcggtacttagttttacttacgtcgtacagtactaactatttacttacctttctttcgtaccttacgtttcgggacgggtacggaccgtagggtgagacgtaacgaaaccggtagtcggtcggtctagcctaccgtattcgtcgttctacgtaccg

SEQ ID NO: 64077 - DNA, 599 bp, Homo sapiens
  misc_feature: GYAE6OF01B29TV.31.78.H01.1.454.CMB.1.raw
  modified_base (457)..(457): a, c, t, g, unknown or other
  misc_feature (457)..(457): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgaggacgggccaccatcaactgcaagtccagccagtagttgttttattcggccccacaataacaactacttagcttggtaccagacaagaaagtaggacagcctacctaaactcctgtatttacgtcgggtccttcgtacccgggctacgttcccggggttacctaaaccggtatttcagttcggacacggtcgggtcgtacggggacccgtactttcgaccttcgtaccacctatcagcacgcctagcgaggctagaagngtgtgactagtttactacgtgtacagactaacgtatttacttacttcgttcgtacttacgtttcgggacgggtaggtaccgaagggtcgacgtatacgaaacgtagtggtcggctacgctaccattacttcgttctctaccg

SEQ ID NO: 64078 - DNA, 614 bp, Homo sapiens
  misc_feature: GYAE6OF01BV0ZE.31.78.H01.1.454.CMB.1.raw
  modified_base (201)..(201): a, c, t, g, unknown or other
  misc_feature (201)..(201): n is a, c, g, or t
  modified_base (439)..(439): a, c, t, g, unknown or other
  misc_feature (439)..(439): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctcgtgggcgagngggccaccatcaactgcaagtccagccagagttgttttattcggccccacaataacaactacttagcttggtaccagcaagaaagtaggacacgcctacctaaactcctgtactttacgtgggtccttccgtacccgggctacgtcccggggtttacctaaccgtattcattcggcaggtcgggtcgtcgggaccgtactttcactctcgacctatcagcagcctgcgagctagaagntgtgcttagtttatacgtgtacacgtacaactattacttacctttcgtttaccgtaccttaccggtttccgggacgggtacgggaaccgtaagggtaggacgtaagtaaccgaaaaccgtagttcggtacggtcctaggaccctaacctagttcccgtcggttccttccgtaccg

SEQ ID NO: 64079 - DNA, 634 bp, Homo sapiens
  misc_feature: GYAE6OF01EG0D3.31.78.H01.1.454.CMB.1.raw
  modified_base (378)..(378): a, c, t, g, unknown or other
  misc_feature (378)..(378): n is a, c, g, or t
  modified_base (606)..(606): a, c, t, g, unknown or other
  misc_feature (606)..(606): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagacgggccaccatcaactgacaagtccagccagtagttgttttattcggccccacaataacaactacttagtcttaggtaccagacaagaaagtacggacacgtaccctacctaaactcctagtactttacgtcggtccttccgacccgggtcacggttcccgggttaccctaaccggtnttccgagttggctagggccgggtcgtcggggacccgtacgtttcaacttcctccaacctataccgaacgtccgaacggtccctaggaccgtacggtacgtaggaacgtagtcggtacgtacgttagttttactacgtgtactagtaccaagttattattcctttactttcgtcttacgttccgggacgacggtacaaggtcgagactacgaaacggtatggtcgcgtnacccgtactacttgtcgttcctctaccg

SEQ ID NO: 64080 - DNA, 785 bp, Homo sapiens
  misc_feature: GYAE6OF01ACK4V.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagacgggccaccatcaactgacaagtccagccagtagttgttttattcggccccaacaataacaactacttagcttggtaccagcaagaaagtaggacacgccctacctaaactcctagtacttttacgcgggtacctttccgtacccgggctacggttcccggggtttaccctaaaccggtatttccgagtttcgggaccgtaacgggtccggggttccgtacgggggaacccttattttacccgaaccgtttcctacccaaccctatccgaacgtccgaacgtcccgtaggaccgtagggtcctaggaaacgtacgttacgggttacggtaccgtttaaggtttttaacgttaccgttacggttaccgaacggttacctaaaaccgttaacgttttaactttaacccgttttaccgttttacccggtttacccgttaaccggttttaccggggaaccggggtaacgggtaacccggtaaaggggttcgggtaaacgtaacgtaaaccgtaaaaccggttaacgttgggtacgggtaccgtacgaacccttaccgtacgttaccgttacgttaccttccgtaacccg

SEQ ID NO: 64081 - DNA, 724 bp, Homo sapiens
  misc_feature: GYAE6OF01A9IIV.31.78.H01.1.454.CMB.1.raw
  modified_base (406)..(406): a, c, t, g, unknown or other
  misc_feature (406)..(406): n is a, c, g, or t
  modified_base (704)..(704): a, c, t, g, unknown or other
  misc_feature (704)..(704): n is a, c, g, or t
tcagcagtagacgtcacgaccggtgctcgatttagtgtgagtagtttgggtttgggggagctacaacagggcaggcaggggcagcaagatggtgttgcagacccaggtcttcatttctctgttgctctggatctctggtgccgtacggggacatcgtgatgagcctagtttccagactccctggctgtgtctcgtgggcgaggacgggcccaccatccaactgaccaacgtccagccaggtagtttgtttttagttccggaccccaactaaataaccaacttacttagtccttaggtaccagacaagaaagtacggacacgtcccctaactaacctccttagtactttacggtcggtccttaccggtacccgggataccgggttcccgggttaaccctaacggttnttaccgagttcggacgtacgggtccgggtcgtagggtaacccttgttaccacgttaccctaccgtaccgttactacggacgtaccgtacgtccgtacggacgtacggtacgtaaggaacgttggttcggtaacggttacgtttaggttttaacctgttacgtaccaacggttacctaatttaacggtttactttccgtttaccgtttaccggtcgttacggttcgggaacgggtacggtaacgtagggtacaagtacgtaaacgtaacggtatcgggtacgcctacggacctaacgtntcttacggttcctctacccg

SEQ ID NO: 64082 - DNA, 836 bp, Homo sapiens
  misc_feature: GYAE6OF01CTG6S.31.78.H01.1.454.CMB.1.raw
  modified_base (392)..(392): a, c, t, g, unknown or other
  misc_feature (392)..(392): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgacgcctagtttccagactccctggctgtgtctcgtgggcgagacggccaccatcaactgcaagtccagccagtagttgttttacgttcggcccctaacaattaaccaactagttacgacttcggtaaccagtacaagtaaagtaggacacgaccctacctaaacctcctagtaactttacgtgggtccttacgtacccgggactacggttacccggggtttaccaaaccggtnttacgtaacgttcggacgtacgggtcggggttccgtacggggtaaccttactttacctaacttccgtacccaacgtaactccgaaggtcccaacgtcccgtaggaccacggggtaccttaagggaaaacggtacggtttcgggtacggtacgtaaacgttttttaacgttaaccgtcgttaaccgaaacgtaaccgtaaaccctttaagtttaacctttaaccgttttacccgttttaccggttacccgtttaaccgggtttttaccgggaaccggggggttaccgggaaaccggttaacgggggttaaccgggaaacggttaaccgttaaaaccggaaaacccggtaacggttttacggggtaaccgggttcccgttaaacggacccgttaaacccgttacgtttaccgtttaacccggtttcctttaacccggttaaccccg

SEQ ID NO: 64083 - DNA, 676 bp, Homo sapiens
  misc_feature: GYAE6OF01BDID7.31.78.H01.1.454.CMB.1.raw
  modified_base (358)..(358): a, c, t, g, unknown or other
  misc_feature (358)..(358): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctcgtgggcgagacgggccaccatcaactgacaagtccagccagtagttgttttacttcggaccccaacaataactaacctacttagcttacggtaccagacaagaaagtacggacacgtaccctacctaaactccgtagtactttacgtcggtccttccgtacccgggntacggtcccggggttacctaaccgtattacgagttcggccgtacgggtcggggttccgtacggggacccttacgtttccaccttcctacctaacctacgtaccgacgccacggtcctcgacgtacggacgtaggaacgtacgtcggtacggtacgttaagttttactacgtgtacgacgtactaactattacttacttcgttcgttaccgttacgtttacgggacggtacgggaaccgtagggtagtacgaactaaccggtaaacgtacgtaggtcggtaccgtcgaccgtaacgtcgttacgtcgttctcgtacccg

SEQ ID NO: 64084 - DNA, 678 bp, Homo sapiens
  misc_feature: GYAE6OF01EBI7K.31.78.H01.1.454.CMB.1.raw
  modified_base (379)..(379): a, c, t, g, unknown or other
  misc_feature (379)..(379): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctcgtgggcgaggacgggccaccatcaactgacaagtccagccagtagttgttttactttcggacccccaacaataaccaactacttagcttggtaccagcaagaaagtaggacacgccctacctaaactcctagtactttacgtgggtaccttccgtacccgggctacgtcccggggttacctaaccgtnttcagttcggcaggtcgggtcgtcggggaccgtatttccgactctccaaccatccgaagtccgacgccgtcgacgacggacgtagaagtagtggtacggtacgttagtttacttacgtcgtacgacgtactaactatttaacttactttcgtttcgttaccgttaccgtttccgggtacgggtacgggtaaccggtaacgggtagggtaacgtaacggggggtaaacctaaacggtaaacgttacggtcgggtacgttacggacctaacctacgttaccttcgttccttccgttacccg

SEQ ID NO: 64085 - DNA, 754 bp, Homo sapiens
  misc_feature: GYAE6OF01D6MMZ.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagttccagacctccctggctgtgtctcgtgggcgagagggcccaccatcaactgacaagtccagccagtagttgttttacttccggaccccaacaataacaacttacttagtcttacggaccagacaagaaagtaggacacgtccctactaacctcgtagtactttacgtcgggccttccggtacccgggctaccgttcccggggttaccctaaccgtatttcgagtttcggaccgtaggtcgggttccgtagggtacccttatttaccgaccttcctaccgaacctagttaccgacgtacccgacggccttacggccgtaagggtccgttaaaggaacggtagttgggttacggtaccgtttaaggtttttaactaccgttacggttacgaaccgttactaaacgttactttttaactttaccgttttcccgtttaccgttaaccgtttacccgggtttccggggaaccggggtaacgggtaacccggaaagggttacggtaaagtaacccgttaaaacggtaaaccggttaacgttggtaccggtctcccggaactaccgtattacccgttgtttcccttataccccg

SEQ ID NO: 64086 - DNA, 763 bp, Homo sapiens
  misc_feature: GYAE6OF01CBERI.31.78.H01.1.454.CMB.1.raw
  modified_base (326)..(326): a, c, t, g, unknown or other
  misc_feature (326)..(326): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacgggggacatcgtgatgagccagtttccagactccctggctgtgtctcgtgggcgaggagggccaccatcaactgacaagtccagccagtagttgttttattcggccccaactaataacaactacttagcttggtaccagcaagaaagtagacagccctactaaactcctagtactttaccgngggtaccttccggacccgggctacggttcccggggttacctaaccgtagttaccagtttcggacgtacgggtcggggttaccgtcggggtaaccgtaatttccgaaccttcctaccgaaccctagtaccgaacggccgtaacggtccccgttaggccgtacggggtacctaagggtaaacggtgttacggggttacgggtacgtttaacggtttttaaccgttaacgttacgtacgaacgtacctaaacttatttaaccgtttaccttttaccgttttaccgttacccgtttaccggttttacgggggaccggggtaaccggggtaacccggtaaaggggtcggtaaaggtaacgttaaccggaaaccggttacgtcgggttacggaccgttcggacccgtaccgttacgttcgttacggttcccttacgtaacccg

SEQ ID NO: 64087 - DNA, 713 bp, Homo sapiens
  misc_feature: GYAE6OF01ESBNO.31.78.H01.1.454.CMB.1.raw
  modified_base (352)..(352): a, c, t, g, unknown or other
  misc_feature (352)..(352): n is a, c, g, or t
  modified_base (370)..(370): a, c, t, g, unknown or other
  misc_feature (370)..(370): n is a, c, g, or t
  modified_base (395)..(395): a, c, t, g, unknown or other
  misc_feature (395)..(395): n is a, c, g, or t
  modified_base (628)..(628): a, c, t, g, unknown or other
  misc_feature (628)..(628): n is a, c, g, or t
  modified_base (670)..(670): a, c, t, g, unknown or other
  misc_feature (670)..(670): n is a, c, g, or t
tcagcagtagacgtcacgaccggtgctcgattttagtgtgagtagtttgggtttgggggagctacaacaggcaggcaggggcagcaagatggtgttgcagacccaggtcttcatttctctgttgctcgtgactctctggtgcctacgggacatcgtgatgacgcctagtttccagacctcccgtggctgtgtctcgtgggcgagacggccacatcaactgacaagtccaagcctagtagttcgttttacgttcggacccccaataaataacctaaacttacttaacggcttaggtaaccaggacaaaggtaaagtcggacacgtcctacctaaactcctaagtactttacgngggccttacgacccgggntaaggttcccgggttacctaaccgntttaccagttcggactacgggtcggtctacgggacccttagtttccaccttcgtccaaccgtactccgaagtcctaacgtcccttaggacgaacggtccgttaaggaaagtacgtggtacggactttaagttttaactacgtagtacaacgtaacctaattagtttactaccgtttacgttccgtaccttacgggtttcggaaccgggtaacggaacgtaagggtacgtaaanaacgttaaaccgaaaacggttacgttcggtacggtacccgtnaaccgtttaacccgatttaccctacggtttccttacctacccg

SEQ ID NO: 64088 - DNA, 747 bp, Homo sapiens
  misc_feature: GYAE6OF01DSOHZ.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagactccctggctgtgtctcgtgggcgagacgggcccaccatacaactcgacaacgtccagccagtagttgttttatcggcccacaataacaactacttagtcttacggtaccagacaagaaacgtaggacacgtacctacctaaacctctagtatttacgtcgggtccttccgtacccgggactacggttaccccggggttacccttaaaccggtcttacgtacgtttcgggaccgacggggtccggggttaccgtacggggtaccgttaacgtttcctaacctccgttacccaacctacgtaccgaacgtaccgtacggtccctaggaccgaagggtacctaagggtaagtacgttcgggtacggttacgttaaggttttaactttaccgtacgtaccgtaacgtacctaaacttactttaactttaaccttttccgttttaccgttacgttaccggttttccgggaacgggtacgggtaaccgtaaggtacgggacgtaactacggtaaaaccgtacgttaggtccggacttcgaaccgtaccttacgttcgttacgtccgtttcctaacccg

SEQ ID NO: 64089 - DNA, 763 bp, Homo sapiens
  misc_feature: GYAE6OF01DIMYH.31.78.H01.1.454.CMB.1.raw
  modified_base (382)..(382): a, c, t, g, unknown or other
  misc_feature (382)..(382): n is a, c, g, or t
tcagcagtagacgtcacgaccggtgctcgatttagtgtgagtagtttgggttgggggagctacaacaggcaggcaggggcagcaagatggtgttgcagacccaggtcttcatttctctgttgctctggatctctggtgccgtacggggacagtcgtgagtggagccgtagtttccagtacctcccgtggtctgtcgtctcgtgggcgaggcgggacccaactataccaacgtgacaacgtccacggaccagtagtttcgttttaacgttccggaccccaactaaactaaccaaacttacgttacgtcgttacggtaccagacgaagaaagtagacacgacctacctaaactcctagtacttacgtgaccttccgtacccggntaccggttcccgggttaccctaacgtcttacacgttcggctacgggtccgggtcgtaccgggtaccgtactttcgaaccgttcctaccctaacctacgtacgaaccgtccgtacgtccgtacggaccgacggtacgtaggaagtacgtggtacggtacgttagtttacgttaacgtacgtaccgacgtaaccgttaaattaaccttttatttaccgttttccctttccggttaaccgttaccgggttttacgggacggggttaccggtaaaccggtaacggggtacgggaacgttaaacggtaacgtaaaaccggtaggttacgggtcggtaccgtacgaaccgtaacctacgttaccgttacgtttcctaccgttacccg

SEQ ID NO: 64090 - DNA, 816 bp, Homo sapiens
  misc_feature: GYAE6OF01CVMG7.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtcgccgtacggggacagtcgtgatgacgcctagtttccagacctcccgtggctgtcgtctcggtggcgaggcggacccacatcaacgtgactaacgccagaccgtaggtagtttcgttttacgtccggaccccaactaaactaacctaacttacttcgacgtttacgaaccagacaaaggtaaaggtacggaacctacgtaccccttaaccgtaaactccttacgttaacgtttaccggtacgggtacccttttaccggaacccccgggtacttaacccggggtttcccccggggttttaaccctaaaaccggttactttaccgtaacggttcgggtaccgtaaccggggttccggggttaccggtaaccggggttacccttacgtttaccgtacccttctacccaacgttacgtaccgacgtacccgacgtacccggtagacccgaggtaccgtaaggaacgtacggttcggtacggtacgtttaagtttactcgtacggtacaacgtaacttaaacgttactttaacgttccttttaccggtttaccgttaccgttaccgggttacggaccgggtacggaaccggttaaggtccggaataaccgtaaccggaaagttcggtggtaccggtaccgtaccgtaaccgtacttacgttctcgttaccgttcttaacccgg

SEQ ID NO: 64091 - DNA, 700 bp, Homo sapiens
  misc_feature: GYAE6OF01DCD61.31.78.H01.1.454.CMB.1.raw
  modified_base (368)..(368): a, c, t, g, unknown or other
  misc_feature (368)..(368): n is a, c, g, or t
  modified_base (391)..(391): a, c, t, g, unknown or other
  misc_feature (391)..(391): n is a, c, g, or t
  modified_base (397)..(397): a, c, t, g, unknown or other
  misc_feature (397)..(397): n is a, c, g, or t
  modified_base (525)..(525): a, c, t, g, unknown or other
  misc_feature (525)..(525): n is a, c, g, or t
  modified_base (609)..(609): a, c, t, g, unknown or other
  misc_feature (609)..(609): n is a, c, g, or t
tcagcagtagacgtcacgaccggtgctcgatttagtgtgagtagtttgggttggggagctacaacaggcaggcaggggcagcaagatggtgttgcagacccaggtcttcatttctctgttgctctggatctgtggtcgaccgtacgggacatcgtgatgagctagtttccagcctcccgtggctgtcgtctcgtgggaccgaggacgggccacctatcaactgactaacgtccaggccagagtttcttttagtccggacccctaactaataaacctacgttaactacgtcttacggaccagctaaggaaagtacgacataccctacgtaaacctcgtagtactttacgcggtccttacggaccccggntacggtcccgggttaccaacgtntaccgngttcgcgaggtccggtacgtacgggtacctattccaacttccacggaccctatccgaggtcacggtccctgaccggtacgtacgttagaaaggtacgtgggtacgaccgttggtttaacttaccggtnttaccgtagactaactttacttaggttacctttcgtttccgtaacttccggtttacggacggttaacgggacgttaaaccgggngtaaacgtaaccgtaacgtaaccggttaggttacggtcgtcctaccgtaacccgttaccttacgttaccgttaccttccgttcccgtcccg

SEQ ID NO: 64092 - DNA, 914 bp, Homo sapiens
  misc_feature: GYAE6OF01CU5IA.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagacgggccacatcaactgcaagtccagccagtagttgttttattcggccccaacaataacaactacttagcttaggtaccagcaagaaagtaggacacgacctacctaaactcctagtactttacgtcgggtcctttaccgtaccccgggctacgttccccgggggtttaccctaaaccgtatttccgaagtttcgggaccgtaacggggtccgggggttccgttacggggggaacccgttacgttttacccgtaaccgttccccgttaaccgtaaaccccttaagttcccgaaacggtcccgtaaaccggttcccccgttacgggacccgtaacggggtacccgttaagggtaaaacggttaacggtttcggggttacgggttaccgttttaaacgggtttttttaaaccgtttaacccggttacgggtttaacccgtaaacggtaacccttaaaaaccggtttaaacttttttaaaccctttaacccggtttttttacccgttttttaccggtttacccgtttaacccggtttttacccggggggaaccgggggttaaccgggggttaaaccccggttaaaagggggttacggggaaaacggttaacgttaaacccggtaaaaaccgggtaaccggtttagggtaaccgggtacccgttacggaccctaaaccgtacgtttcgtttaaccggttccgtttacccgttaaccccg

SEQ ID NO: 64093 - DNA, 764 bp, Homo sapiens
  misc_feature: GYAE6OF01C495X.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctcgtggtcgccgtacgggacacgtcgtgagtggacgtcctagtttaccacgtacctcccgtggtctgtcgtctcgtgggcgaggacggccacatacaacgtgactaacgtccagccgtaggtagtttacgttttacgtccgacccctaacctaaataacctaactacttagcctttacggaaccagaaccaaaggtaaaggtacggaactacgtacccttaaccgtaacctccgttagttactttaccggtcggtaccgtttccggtacccgggacttacccgggttacccgggttaaccttaaacggtcttacgtcggtacggccgtaggggtccgggttcggtacgggtaacctttacgttaccgaccttaccctacccaaccgtctacgtacgccgtacgtccgtaggacgtacggtactaaggtaaacggtggttacggtcgtaacgttttaacgtttacgtacgttcgtaacgacctaataaccgtttagtttaaccctcttttccgtaggttaccttacgggttcgggaaccggtacgggtactaaggggtcgaaacttacgaaacgtaaacgtgtacgggcgtaccgtacactaccgttagtccgtttctcccgttagttacccg

SEQ ID NO: 64094 - DNA, 672 bp, Homo sapiens
  misc_feature: GYAE6OF01CIIJX.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagacgggccaccatcaactgacaagtccagccagtagttgttttattcggccccaacaaataacaactacttagcttggtaccagcaagaagtagacagcctacctaaactcctgtactttacgtggtccttccgtacccgggctacggttcccggggttacctaaccgtattccgtaagtttcggctacgggtcggggtcctacggggacccttatttccactctaccaccatccagcacgcctgccgaggctagaagtgtggtagcttagtttactactgtacacgactaatatttacgttactttcgtttaccgtacttaccggtttcgggaccgggtaacgggtaaccggtaagggttacggaacgtaaaccgtaaccggtaaaaccgggtaaccgttcgggtacggtaccgtaccggtaacccgtaaccgttacgtttccggtttaccgttactttcccgttaaaccccg

SEQ ID NO: 64095 - DNA, 773 bp, Homo sapiens
  misc_feature: GYAE6OF01AIK66.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctcgtggtcgccgtacggggacatcgtgagtgacgcctagtttccagtacctcccgtggctgtcgtctcgtgggcgaggacggccaccatacaactgacaacgtccacgccagtagtttgttttacgttccggaccccaactaaactaaacctaaccttacgttacgtccgttacggtaacccagacgaaaggtaaaaggtacggaaccgaacgtacccttaacccttaaaccttccttagtaacttttacgtcgggttaccttaccggtaccccgggtactaaccggttacccggggttaaccctaaccgtacttacgtagttacggaccgtacgggtccgggttaccggtacgggtaaccgttactttaccgtaccgttacctaccgaacctactacgacgacacgcgtcgacgagacgtagtaagtagttcggtacgtacgttagtttactacgtcgtacgtacgtactaacttatttaccttactttccgtttaccgtacgttaccggtttcgggaaccgggtaacgggtaaccggtaagggtacggtaaactaacgtaaaccggtaaaccgtaggttacggtacgtaccgttaccgaccctaaccgttacttaccgttacgttccgttacgtacccg

SEQ ID NO: 64096 - DNA, 701 bp, Homo sapiens
  misc_feature: GYAE6OF01DOPDV.31.78.H01.1.454.CMB.1.raw
  modified_base (156)..(156): a, c, t, g, unknown or other
  misc_feature (156)..(156): n is a, c, g, or t
tcagcagtagacgtcacgaccggtgctcgatttagtgtgagtagtttggggtttgggggagctacaacaggcaggcaggggcagcaagatggtgttgcagacccaggtcttcatttctctgttgctctggatcctcgtgggtcgccgtacgggganatcgtagatgagcctagttccacgacctcccgtggtctggtcgttcgtcggtcggggacgacggacgggacccaactactaccaacctcggacaacggtccgagtaccgagttacgtttagttttacgttcccggacccctaactaactaaacctaacttacttacgtcttacggtaaccagacgaagaaacggtacgacacgtacctaacctaaactccgtagttacgtttacgtcggtaccgttaccgtaccgggtacgtaccggtcccgggttaaccaaccgtattctacgtcggacagggtcggtacgtacggtacgtacttcgacctctaccacgatcgacgcacgtcctgacgaggtacgtaggaacgtgtacggtagttacgttaagtttactacgtctacgaactactaattactttacttacgttcctttacgtcctacgggttacggacgggtacggacgtagggtagtcgaaacgttaacgaaacggttagtcgggtctcgtacgactcgtaccttagttccttctcgtacccg

SEQ ID NO: 64097 - DNA, 536 bp, Homo sapiens
  misc_feature: GYAE6OF01EG2KB.31.78.H01.1.454.CMB.1.raw
  modified_base (436)..(436): a, c, t, g, unknown or other
  misc_feature (436)..(436): n is a, c, g, or t
tcagcagtagacgtcacgaccggtgctcgatttagtgtgagtagtttgggtttgggggatctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacaactacttagcttggtaccagcagaaagtaggacagccctacctaaactcctagatttactgggcttcgtacccgggcagtccggggttacctaaccgattcattggcaggcgggtctggggaccgtatttcactctcaccatcagcagcctgcaggctagaagatgtgctagtttatactntacagacaactattatacttctttcgtctacgtttcggacggaggaccgaagggtcgagatacgaaacgtataggtgactgcaaccatactgttctctac

SEQ ID NO: 64098 - DNA, 726 bp, Homo sapiens
  misc_feature: GYAE6OF01CFAGN.31.78.H01.1.454.CMB.1.raw
  modified_base (138)..(138): a, c, t, g, unknown or other
  misc_feature (138)..(138): n is a, c, g, or t
tcagcagtagacgtcacgaccggtgctcgatttagtgtgagtagtttgggtttggggagctacaacaggcaggcaggggcagcaagatggtgttgcagacccaggtcttcatttctctgttgctctggatctctggtnccgtacggggacatcgtgatgagcctagtttccagacctccctggcctgtcgtctcgtgggcgagacgggccacatcaactgcaagtccagcctagcgttgtttacttcggacccctaacaattaacgaactacttagcttacggacctagcgaagaaagtacgacgacgacccttacaaaccgttcctagtatttacgcgggtccttccgtacccgggtctaacggttcccggggttacctaaccgtacgttcctaagtttcggaccgtaggcggggttctacggggtaaccgttgtttaccgacgttacctacccgtacgtagttaccgacgtaccgtacgtcccgtaggccgtaaggtcccgttagaaacgtgttcgtacggtactaacggtttactaccgttcgtactacggtactaaacgttactttacgtaacgttttccgttacgttacctaccggttttacgggacggtaaccgggtaccgtaagggttacgtaacgtaacctaaccggtaaagtaccggtacggttcggccgttaaccggactaaccgtacgttccgttacggttcttacccgtacccg

SEQ ID NO: 64099 - DNA, 589 bp, Homo sapiens
  misc_feature: GYAE6OF01BRU90.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagtttccagacctcccgtggctgtgtctcgtgggcgaggacgggccaaccatcaactgacaagtccagccagtagttgttttatcggaccccaacaaataacaactacttagcttacggtaccagacaagaaagtaggacacgacctacctaaactcctagtactttacgcggtccttccggacccggatacggttcccgggttacctaaacgtcttcagttggacaggtcgggtctcgggaccgtattcactcacacatcagccagcctgcaggtctagaacgatggtgtacttagttatacgtgtacagactaatattactactttcttcgtacttacggttcggacggtacgggactaagggtagagtaactaacgaaacgtacgtggtcggactagacctaactactcgtcgtactcgtac

SEQ ID NO: 64100 - DNA, 608 bp, Homo sapiens
  misc_feature: GYAE6OF01EEDSO.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagtagttgttttatttcggccccacaaataacaactacttagcttggtaccagcaagaaagtaggacagtcctacctaaactcctagtactttacgtcgggcttccgtaccgggcacgttcccggggtacctccccgaattcagttcggtcaggcgggtcgtagggaccgtattacactctcgacctactcagacagcctcgcgacgactagaaacgagtgtacgtcgtagtttagtactacgtcacgtaactaataactttagtactttcgtttctactacgtttcggcggtaacggaaccgtaaggtacggagtaacgtacgtaaacggaacttggtcggtctacggacccgaactactacgttcgttccttcgtaaccg

SEQ ID NO: 64101 - DNA, 711 bp, Homo sapiens
  misc_feature: GYAE6OF01B6MWO.31.78.H01.1.454.CMB.1.raw
  modified_base (352)..(352): a, c, t, g, unknown or other
  misc_feature (352)..(352): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagtttccagactccctggctgtgtctcgtgggcgagacgggccaccatcaactgacaacgtccagccagtagttgtttattcggaccccaaccaaataactaactacttagtcttacggaccagacaagaaagtaggacacgccctacctaactcctgtactttacgcgggtcttccggtaccccggntacggttcccgggttaccctaaccgtacttctagttcggctagggtccgggtcgtacggggtaccctatttccgacttcctaccgaacctacgtacgtacggactacgtcccgtacgacgacggtacgtaggaacgtagtcggtacgtcttaacgtttacttacgtacgtacgacgtaactaacttaactttactttaccttttaccgttccgttaccgttaccggtttccgggaacgggtacgggtaacccggtagggtacggtaacggtaacgtaaaccgaaaccggttagttacgggttcggaccgtaccggaccttacccgtacgtttaccggttcgtttacctccgttaacccg

SEQ ID NO: 64102 - DNA, 633 bp, Homo sapiens
  misc_feature: GYAE6OF01EKN6O.31.78.H01.1.454.CMB.1.raw
tcagcagtagacgtcacgaccggtgctcgatttagtgtgagtagtttgggtttgggggagctacaacagggcaggcaggggcagcaagatggtgttgcagacccaggtcttcatttctctgttgctctggatctctggtgcctacggggacatcgtgatgagccagtttccagactccctggctgtgtctcgtgggcgaggacgggccaccatcaactgcaagtccagccagtagttgttttattcggccccacaataacaactacttagcttggtaccagcaagaaagtaggacagccctactaaactcctagtactttacgtgggtcttccgtacccgggctacgttcccggggttacctaaccgtattcagttcggcagggtccgggtcgtacgggaccgtagtttccacttcctcacccatcagcacgcctgcgaggctagaacgtgtgtggtactagttttacttacgtgtacacgtacaactatttactactttccgtttcgtcttacgtttcgggacggtacgggaccgtaagggtggacgtaacgttaacgaaaaccggtaattgggtacggtacctacggaccccgtaacctacgttcccgttacggtttccttccgttacccg

SEQ ID NO: 64103 - DNA, 787 bp, Homo sapiens
  misc_feature: GYAE6OF01CAM5S.31.78.H01.1.454.CMB.1.raw
  modified_base (194)..(194): a, c, t, g, unknown or other
  misc_feature (194)..(194): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctcgtggtgcccgtacggggacagtcgtgatcgagtcctagtttccagtcctccgtggctgtntctgtgggcgaggacggccaccatccaacgtgacgaacgtccgacgaccgtaagtagtttacgttttacgttaccggacccctaaaccaaacttaaacctaaccttacgttacggtacttacggaacccaggacgaagtaaacggtaggaaccacgtaccctaacctaacctccgtagtacttaccggtcggtaccttaccgtacccgggactaccggttaccgggttaccctaaacggtcttcgtacgttcggacgtagggtccgggtcgtacgggtacccgttacttaaccgtcctacctaccgtaacctacgtaccgaacgacctcggacccgtacgggaccggtaccggtaacggtaggtaaacgtagtacgggttcgggttaactttaacggtttaacgtttacgaacgtttacgaaccgtaacgtaaccttaacttttaaccgttccgttttacctttaccggttaccgtaccggttaccggggaacggtacgggtaaaccgtggtaacgggaacgtactaaacccggtagtacgtaggttccgacgtactaacccaccgttacgtcgttccgttctcccttacccg

SEQ ID NO: 64104 - DNA, 894 bp, Homo sapiens
  misc_feature: GYAE6OF01CC4CC.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctcgtgggtgccgtaacggggactagtcggtagatggacgcctagtttcccagtacctccctggctgtcgtctcgtgggcgaggcggccacatccaactgactacgtccagccaggtagttgttttacgtccgaccccaactaaataaccgtaacttacgttagtaccgttacggtaacccagtacgaaggtaaaacggtacggacctacggtacccttaacctaaaaccttccgtagtaacgtttaccggtcgggtaccctttaccgtaccccggggtcttaaccggttaccccggggtttaccctaaacggttacttcgtaacggtttcggaccgtacggggtaccgggtcggtaacggggtacccgttaacgtttaccaccgttacctacccgaaccgtattaccgaacggtccgtaaccgtcccgttaacgggtaccggtaaggtaccggtaaagggtaaacggtaggtttaccgggttacggttaaccggtttaacggttttaaaccgtttaacgttaccggtaaccgtaaacggttaccgtaaactttacgttttaacgttttaacccgtttccggtttaccggttccgtttaaaccgggttttcccgggaaccgggggtaaccgggttaaaccggtaagggttacgggaaaccgttaacggttaaccgtaaaaccgggttagttaccgggttacggacgttaaccgaccgttaacccgtacgtttacccgttcgtttccgtttaaccgttaccccg

SEQ ID NO: 64105 - DNA, 718 bp, Homo sapiens
  misc_feature: GYAE6OF01CADHW.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctgtggtgaccgtacggggacatcgtgatgagcctagttccagactccctggctgtcgtctcgtgggcgaggacggccacatcaatgcaacgtcagcagtagttgttttagtcggaccctaactaaataacctaacttacgttacgtacgttacggtaaccaagactaaaggaaaacggttacggacacgtccctaaccgtaaacctctagtactttacgacggtcttaccgaccgggtactaccggttcccgggttaacctaacgtacttcgtagttcggagtacgggtcgggtacgtacgggaccgttattccaacgtcctacaacctatacgaaaggtaccgtccctaaggcgacggtacgtaacggaagttacgtcgggtaacggtactttaaagttttcgtaacgtaggactaacggtaacctaactttaacttaactttaccgttttacttaccggtaccgtttaccggttacgggacggtaacggaccgtaaggtgaaactactaacgaaacgtacggttgaccgggtctaacggacccttaacgtacgttacgttactacccttagaaccgtttccccg

SEQ ID NO: 64106 - DNA, 849 bp, Homo sapiens
  misc_feature: GYAE6OF01AQKES.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtcgccgtacgggacagtcgtgatgacgcctagttccagtacctccgtggctgtcgtctcgtgggcgaggacggccacctatcaacgtgactaacgtccgaagccgtaggtagtttcgtttttacgttccggaccccctaaacgtaaataaacctaaccttacgtttaacgtccttacgggtaacccaaggtacgtaaaggtaaacggttcggaaccctacggtaccccttaaccgtaaaccgtcccgttagttaccgttttacggccgggttacccttacccgggaacccgggtctaccgggtttaccccggggttacccctaacggtatttacgtacggttacggaccacggggttccgggttacggtaccggggtaacccttagtttccaccgttaccgtaccacctagtccgacgtaccaccgtccgtacgcgtaggtacgtaagtaacggttcgtacgggttacggtaccgtttaaggttttaactacccgggttcgtaacgtaaccgttaagtaaacctttacgttttaaccgtttcccgttttaccggttttaccgtaccgtttaaccgggggttacggtaaccggggacgggttaaacggtagggttacgaaccgtaaccgttaacggaaaccggtttcggtacggtaccggtacgttaccggaccttaacgtccggttaccgttaccgttcttccggtaccccg

SEQ ID NO: 64107 - DNA, 618 bp, Homo sapiens
  misc_feature: GYAE6OF01EEVK8.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagacgggccaccatcaactgcaagtccagccagtagttgttttattcggaccccaacaataacaactacttagcttaggaccagcaagaaagtaggacacgtccctacctaaactcctagtactttacgcggtccttccgtacccgggctacgttcccggggttacctaacgattcgagttcggacgaggcgggtctgggacctatttcactctccaccatcagcacgccgtgcgaggctagaagagtggtggacttagtttacttacgtgtcagtactaactattacttacttcgttcgtcttacgtttcgggacggtacgggaaccgtaaggtcggaacgtacgtaacgtaaaccggtaagttcggtcggtaccgtacggacccgtaaccgtacttaccgttacgttccttccgtaccg

SEQ ID NO: 64108 - DNA, 757 bp, Homo sapiens
  misc_feature: GYAE6OF01AOK4P.31.78.H01.1.454.CMB.1.raw
  modified_base (320)..(320): a, c, t, g, unknown or other
  misc_feature (320)..(320): n is a, c, g, or t
tcagcagtagacgtcacgaccggtgctcgatttagtgtgagtagtttgggtttgggggagcgtacaacaggcaggcaggggcagcaaagatggtgttcgcagacccaggtcttcatttctctgttgctctggatctctggtgcctacggggacatcgtgatgagccagtttccagactccctggctgtgtctcgtgggcgagagggccaccagtcaacgtgcaagtccaggccagagtgttttattcggcccacaataacaactacttagcttggtaccagcagaagtgacagcctacctaaactcctgactttaaccgngggtaccttacgtaccccggggctacgtccccgggggttacctaaccgactttcgaagtttcgggactacgggtccggggttacgtacgggggtaaccccgtagttttaccgacccttccgttacccgaaacccgtactacgacggaccctaacggtcccttacggacccgaagggtacccttaagggtaaacgtacgttacggtacgggtacctttaaacgggttttaacttaccgttaggtacctaacggaacctaaaccgtactttaacgtaccttttcgtttacccgtaccttaacgttttccggggacccgggttacggggaaccgtaacgggtcgggtaaagtaacgttaccgtaaaaccggtaacgttaggtcgggaccgttacggccgtaaccgtacgttaccgttcgtttccctttccgttaacccgg

SEQ ID NO: 64109 - DNA, 764 bp, Homo sapiens
  misc_feature: GYAE6OF01EODGW.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagacctcccgtggctgtgtctcgtggcgagacggccaccatcaactgacaagtccacgcctaggtacgtttgttttacttccggaccccctaaacaaactaaactaaccttacttacgtacttacggtaaccagacgaaaggtaaaggtaggaccacgtaccctaaccgtaaaactcctagtaacgtttacgtcgggtaccttacccggtacccgggtctacggtttccccgggttaccctaaccggtattccgagttcggctacgggtcgggttacgtcgggtaccgttatttccgactcctaccaccactcgaacgtcgacgtccgtacgcgacggtcgtagaagtgttggtacggtactttaacgttttacttacgtcgtaccgagtaacctaacttaacgtttactttacctttaccgtttaccgttaccgttaccgggttttaccgggacggggtaaccgggtaacggtaacggggttaaggtacgtaaacgttaacccgtaaaaccggttacggttacgggttaccggtacggtaccgaacccgtaacccgttacttaccgttacggtttcccttaccgttacccg

SEQ ID NO: 64110 - DNA, 731 bp, Homo sapiens
  misc_feature: GYAE6OF01DFUZC.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagttgttttattcggccccacaataacactacttagcttggtaccagcaagaaagtaggacacgcctacctaaactcctgtatttacgtggcctttcgtacccgggctacgtcccggggttacctaaaccgtattcgaagtttcggaccagggtccggggttcgtcggggtaacccgtatttccgaaccgttccttaccgaaccctaattccgaacggtccaacggtcccttcggaccgtaaggggtaccttagggaaacggtaagttcgggttacgggtacttaaggtttttaaccttaacgtcggttaccaaggtaccctaaacgttaatttaacttaccttttaccgttttccgttaccttacgttttccggggaccgggtaacggggtaacccgtaagggtacggaaacgtaacgttaaccgaaaaccggtaacgtttcgggtacggtaccgttacgacccgtaaccctacgttaccttcggttcctttacgtacccg

SEQ ID NO: 64111 - DNA, 834 bp, Homo sapiens
  misc_feature: GYAE6OF01DAW9X.31.78.H01.1.454.CMB.1.raw
  modified_base (111)..(111): a, c, t, g, unknown or other
  misc_feature (111)..(111): n is a, c, g, or t
  modified_base (534)..(534): a, c, t, g, unknown or other
  misc_feature (534)..(534): n is a, c, g, or t
  modified_base (552)..(552): a, c, t, g, unknown or other
  misc_feature (552)..(552): n is a, c, g, or t
tcagcagtagacgtcacgaccggtgctcgatttagtgtgagtagttgggtttgggggaggggctacaacgagggcaggcagggcaggcagactggtgttggccaggacccnggtcttcactttcctctcgttgctctggagtctctgggtgtccgttacgggggactagtcggtgagtccgaggcctacgttccacgtccctcccgtggtccgtgtcgtcgtacgtgggcgaggaccggccctacctactcgaacgtggacgaaaccgccgacgaccgtaggtacgtttaggtttttacgttaccggtaccccctaaaccgtaaattaaccctaacgttaaccgtttacgacgtttacggaacccgaccgacgaagaaacgtaaccggaacccaacggtccctaaccttaaacgtccttaggtaacttttaccggtagggtaccctttcccggaacccggcgtaccgggttccccgggttaccctaaacggtcctttcgtacgttcggaccgtacggtcgggtcgtgggacctntctaccgtcctcaacgtntcgagtcgacgtccctgaccgtaggcgtacgggaagtaggtgtacggtaattaggtttacctacgcggttacaagtaccttaaagtttattaaacgttaacccggtttctttaacccggttagtacgggttttaccggggtaaccgggtaacgggtaacccggttaaaggggttacggaaacttaaccggtaacccgtaaaaggggtaacccttggggtacccgtacccggaagtaccccccaaagttccggttccgttaaccttcccgttcttacccccgg

SEQ ID NO: 64112 - DNA, 866 bp, Homo sapiens
  misc_feature: GYAE6OF01B0Q5U.31.78.H01.1.454.CMB.1.raw
  modified_base (381)..(381): a, c, t, g, unknown or other
  misc_feature (381)..(381): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctcgtggtgccgtacggggacatcgtgatgacgcctagttccagacctccgtggctgtgtctcgtgggcgaggacggccacatacaactgacaacgtccagccaagtagtttgttttacgttccggacccctaaacaaataacctaaccttacttaacgtccttacggtaaccagacgaagaaaggtacggaacacgtccctaacctaacctcctagtactttaccggtggtccttaccggtacccgggntaccgggttaccccgggttacctaaccgtacttcgtacgttcggacgtacgggtccggggttacgtacggggtacccttactttaccgacttccgtacccaaccgtacttaccgacgtccctaacggtcccgtacggaaccggtacggtaccgttaaggaaacgttacggtacgggttacggttaccgttttaaaggtttttaacctttaccggttacggtaaccgtaacgttaacccgttaaaacttttaacggttttaacctttaacccgtttttccggttttaaccggttaacccgttttaaccgggtttacccggggtaacggggtaaccgggttaaacccgggttaaagggggttccggtaaacggtaaaccggttaaacccggtaaaaccgggttaggttaccggggttcggtaccgttaacccgggaccttaaccgttcgttacccggtttccgtttacccgttaaccgttacccccg

SEQ ID NO: 64113 - DNA, 805 bp, Homo sapiens
  misc_feature: GYAE6OF01ENV4B.31.78.H01.1.454.CMB.1.raw
  modified_base (765)..(765): a, c, t, g, unknown or other
  misc_feature (765)..(765): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctgggtcgccgtacggggacatcgtgatgagcctagtttccagactccctggctgtgtctcgtgggcgaggacgggccaccatcaactgcatcgaccagaccagtagttgttttaagttccggaccccaaactaaactaaacctaaaccttaacttacgtcgttacggtaacctagacgaaaggaaaacggtaggaacgaacgtacccttaaccttaaaactccgttacggtaatttaccggtacgggtactttacccggtaacccgggacttaacggtttacccgggggtttaaccctaaaccgtacgttaccgtagttacgggccgaacgggtccggggttaccgtacggggtaacccgttaagttttcccgaaacctttcccgttaacccaaacccgttaacgttaccggaaacggtacccgaaccgggtaccccgttcggaaccgggtaacggggtaccgtaagggtaaaaggtaacggtttcgggtacgggtaccgttaaagtttttaactttaccgtcgtacacggtaactaaacgttatttaccgtacttttccgttacgtccttacggttccgggaggacggtaacgaaggggacgtaagtacgtaaacgtaaaccgttacggngggtaccgtcgacgtaactaccgtagttctagtccgtacc

SEQ ID NO: 64114 - DNA, 717 bp, Homo sapiens
  misc_feature: GYAE6OF01B3REI.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagacctcccgtggctgtcgtctcgtgggcgaggacgggccaccatccaactgacaagtccagccagtagttgttttacttcggccccaactaataacaactacttagcttaggtaccagcaagaaagtacggacacgcctacctaaactcctagtactttacgtgggtccttaccgtacccgggtctacggttcccgggttacctaaccgtacttcagttcggactagggtccgggttcgtcggggtaaccgtactttaccacttaccgtaccaacctattccgagtcctacgccctaggaccgaggtaccgtaggaacgtgttcgggtacggtacgttaacgttttacgttacgtggttaccaacggtacctaaacgttactttaacttaccgttttccgtttaccgttacgttaccggtttacggggaccggtaacggggtaacccgtaaggggttacggaagtaaccggttaaccgtaaaacggtacgttggtcggtaccttacggacctaccgttattccgttcgttccgttaccgtacccg

SEQ ID NO: 64115 - DNA, 542 bp, Homo sapiens
  misc_feature: GYAE6OF01AZ5EB.31.78.H01.1.454.CMB.1.raw
  modified_base (335)..(335): a, c, t, g, unknown or other
  misc_feature (335)..(335): n is a, c, g, or t
  modified_base (529)..(529): a, c, t, g, unknown or other
  misc_feature (529)..(529): n is a, c, g, or t
  modified_base (534)..(534): a, c, t, g, unknown or other
  misc_feature (534)..(534): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgtttattcggccccacaataacaactacttagcttggtaccagcagaaagtaggacagcctacctaaactcctgactttacgtgggtccttccgtacccgggntacgtcccggggttacctaaccgtattcagttggctaggcgggttctggggaccgtatttcactctcacctatcagcagcctgcagctagaagatgtgactagtttatactgtcagcaactattatacttcttcgtctacgtttcggcggaggaccgaggtgacgtatacgaaacgtatggtcgctgactactntactntctctacg

SEQ ID NO: 64116 - DNA, 620 bp, Homo sapiens
  misc_feature: GYAE6OF01BX0Y6.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagacgggccaccatcaactgcaagtccagccagagttgttttattcggccccaacaataacaactactagcttggtaccagcaagaaagtaggacagcctacctaaactcctagtactttacgtgggtccttccgtacccgggctacggtcccggggttacctaaccgtattcgagttcggacgtacggtcgggtcgtcggggtaaccctagtttccacgtcctaccaaccgtactacacgacctacgtccctggaccgaggtctaaggaaagtagttaggtcggtacttaagtttattacgtgtacagtacaactattacttactttcttcgtactacgtttcgggaggacggtacgtaggtgaagtagtaaccgaaacggtagtggtcgctacgactaccgtatccgttgttcctagtacc

SEQ ID NO: 64117 - DNA, 629 bp, Homo sapiens
  misc_feature: GYAE6OF01C01AE.31.78.H01.1.454.CMB.1.raw
  modified_base (322)..(322): a, c, t, g, unknown or other
  misc_feature (322)..(322): n is a, c, g, or t
  modified_base (363)..(363): a, c, t, g, unknown or other
  misc_feature (363)..(363): n is a, c, g, or t
  modified_base (440)..(440): a, c, t, g, unknown or other
  misc_feature (440)..(440): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggcccaccatcaactgcaagtccagccagtagttgttttattcggccccaaccaaataacaactacttagcttaggaccagcaagaaagtaggacagtcctacctaaactctagatttacngggccttcgtaacccgggcacgtccggggttacctaaccgnttacattggccaggtcggtctggggacctatttcgactctcacctagtcagcacgtccctgccaaggctagaacgtntaggtggtactaggtttaactacgtcgttacgaagaccaaacgtatttaacgttaactttcgtttacgtcgtacgtttccgggacgggtaacggaccgtaaagggtcggaagtaacgtacgaaaaccgtacgttacggtcgggtccgtaaggacccaaacgttacttacgtgttacccgtagttacccg

SEQ ID NO: 64118 - DNA, 828 bp, Homo sapiens
  misc_feature: GYAE6OF01C74RO.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacagtcgtgatgacgcctagtttccagacctcccgtggctgtcgtctcgtgggcgaggacggcccaccatccaacgtgacaagtccagccagtagtttgttttactcggaccccctaactaaataacctaacttacgttacgtaccgtttacggtaaccagacaaaggtaaaacggtacggaacctacgtcccttaaaccttaaaaccgttccgtaggttaacgtttaccgcgggttccctttaccggtaccccgggacttaccggttccccgggttaccctaaaccgtacgttctaagttcggaccgtagggtacccggggttaccgttacggggtaacccgttcgtttacctaccgtaccttaccgaaccctaacttaccgacgtccgtaacgtacccgtgaccggtaacggaccgtaaagggtaaacggttagttacgggtacggtaaccgtttaaggttttacctttacgtacggttacctaacggtaacctaactttaacgtttaacctttacctttttaacccggtttcgttaccgttaaccgggtttacccgggaacggggtaccgggttaaaccgtaaggggtaggaacgtaccgaaaccgtaaaaccggtacgttggtacggaccgtcgaccttaacccgtacttccggtttactccgtttacctacccg

SEQ ID NO: 64119 - DNA, 795 bp, Homo sapiens
  misc_feature: GYAE6OF01BW87A.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagtttccagactccctggctgtgtctcgtgggcgagacggccaccatcaactgacaagtccagccagtagttgttttattcggaccccacaataacaactacttagtcttaggaccagacaagaaagtaggacacgcctacctaaactcctagtactttacgtgggtcctttccgtacccgggctaacggttcccgggggtttaccctaaaccggtatttccgtaagtttcggaccgtacgggtccggggttccgttacgggggtaacccgttacgtttttcccaaccgtttacccttaccgaaccccgtaacgttacccgaacggccgtaaccggtccccgttacggaccgtaacgggtaccgttaagggaaacggtacgttagggttacggtaccgtttaaggtttttacgttaccgttcgtaccgtaacgtacctaaacttaacttttaacgttaccttttccgttttaccgttaccttaaccggtttttaccgggaccggggtaaccgggtaacccgtaaggggttacggtaacgtaacgttaaccgtaaaaccggtaaccgttgggtacgggtaccgttacggaaccctaaccgtacttaccgtttacgttccgttccttaacccg

SEQ ID NO: 64120 - DNA, 779 bp, Homo sapiens
  misc_feature: GYAE6OF01DLK2K.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttctatttcctctgttgctctggatctcgtggtgccgtacgggactatcgtgatgacgcctacgttccagtacctccctggtctgttgtctcggtcgggcgaggacgggacccaccatacaacgtgaccgaaacgtccacgccgtaaggtacgtttagtttttaacgttccggacccctaacaaaacttaaaacctaaccgttaaccttacggtaccgtttacggaacccgaagaccaaaaggtaaaaggtaacggaaccacgttacccttaaccttaaacttccgtagttaacgttttacggcggttccttacccggtacccggggtacttaaccgggtttacccggggtaacccttaaacggttacgttcgtaggtttcggacgagggttaccgggtgttacgggtaccgttactttccaacgtccctacgtaaccctagtccgaacgtcccgtaacggtacccgtacgacggttaacggagtaacggaagtaacgtggttacgtacgtttactttagttacgtcgtactacacgtaattattacttactttcgtttacgtacgttacgggttcggaacggtacggtaacgtagtacggataacgtaaccgtaaacggtagttacggtcggactacacgtacgttacgtaccttgtccgttccgtaccg

SEQ ID NO: 64121 - DNA, 556 bp, Homo sapiens
  misc_feature: GYAE6OF01BF4DQ.31.78.H01.1.454.CMB.1.raw
  modified_base (336)..(336): a, c, t, g, unknown or other
  misc_feature (336)..(336): n is a, c, g, or t
  modified_base (405)..(405): a, c, t, g, unknown or other
  misc_feature (405)..(405): n is a, c, g, or t
  modified_base (544)..(544): a, c, t, g, unknown or other
  misc_feature (544)..(544): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagtagtgttttattcggccccaacaataacaactacttagcttggtaccagcaagaaagtaggacagcctactaaactctagtattacgtgggtcttccgtacccgggntacgttccggggttacctaaccgattcagttggcaggcggtcgtgggaccgtatttcactcgtcaacgntacagcacgcctgcgaggctagaagagtggtggactagtttactactgtcacgtcaactatctactttcttgttcctacgtttcgggacggacggacgaaggtgagagtaacgaaacgagtggtcgctcgactacattntcttcgttctac

SEQ ID NO: 64122 - DNA, 619 bp, Homo sapiens
  misc_feature: GYAE6OF01DLJSB.31.78.H01.1.454.CMB.1.raw
  modified_base (448)..(448): a, c, t, g, unknown or other
  misc_feature (448)..(448): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagttgttttattcggccccaccaataacaactacttagcttggtaccagcaagaaagtaggacagccctacctaaactcctgtatttacgtgggtccttcctacccgggctacgtcccggggtttacccaaccggtattcagtttcggcagggtcgggtccgtggggacccgtatttcactctcacctatcagcagcctgccaggctaggaacgatggnggtctagtttacttacgtgtcagactaactaattacttactttccgtttacgtcttacggtttcggacgggtacgggaacccggtaagggtacggtagtaacgtaccggtaaaacgtagtcggtgggtcccgtgaccctaacgttacttacgtcgttccttacgttacccg

SEQ ID NO: 64123 - DNA, 918 bp, Homo sapiens
  misc_feature: GYAE6OF01DWUW8.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctcgtggtcgccgtacgggacagttcgtgagtgacgtcctagtttccagtcctcccgtggcttgtcgtctcggtgggcgaggcggcccacatacaacgtgacaacgccacgaccgtagttacgtttagttttacgttccggaccccaaactaaactaactaaccttacgttacgtccgtttacggaaccagaccgaaaaggtaaacggttacggaacctaaccgtacccttaaaccgttaaccttccgttaggtttaaccttttacggtcgggttacccttacccggtacccgggtacttaacccgggtttaccccgggtttaaccctaaacgttcgttacgtacggtttacggccgttaacggggtccgggttaccggtacgggtaaccgtttacgtttaccacccgttacccgtacctaacccgtcttacgaacgtacccgtacgtcccgttacggaccgggttaacggtacgttaacggtaaaggtacgtttacgggttcggttaactttacggtttttaacgtaccgttacgtaacggtaaccgttaacgttaaacgtttacttttaaccgtttaccgttttacccgtttacggtttacccgtttaaccgggtttaccggggaaccgggttaaaccgggtaacggtttaacgggtcggtaaaaccggttaaccttaaaacccgggtaaacggttaccggttaacggtccgggtaccgtaaccgtaccccgttaaccgttaccgtttaacgggtttccccttttaagtcccccgtttaaccccg

SEQ ID NO: 64124 - DNA, 745 bp, Homo sapiens
  misc_feature: GYAE6OF01AM36Y.31.78.H01.1.454.CMB.1.raw
  modified_base (483)..(483): a, c, t, g, unknown or other
  misc_feature (483)..(483): n is a, c, g, or t
  modified_base (563)..(563): a, c, t, g, unknown or other
  misc_feature (563)..(563): n is a, c, g, or t
  modified_base (580)..(580): a, c, t, g, unknown or other
  misc_feature (580)..(580): n is a, c, g, or t
  modified_base (596)..(596): a, c, t, g, unknown or other
  misc_feature (596)..(596): n is a, c, g, or t
  modified_base (670)..(670): a, c, t, g, unknown or other
  misc_feature (670)..(670): n is a, c, g, or t
  modified_base (723)..(723): a, c, t, g, unknown or other
  misc_feature (723)..(723): n is a, c, g, or t
tcagcagtagacgtcacgaccggtgctcgatttagtgtgagtagtttgggtttgggggtaggtcgtacgaacaggcgaggcgagggcgaggcgaagagtaggtgttggcgacgacccgaggtcttcgatttctctgttgctctaggtatcctctggtcgccttaacggggactagtcgtgatggacgtcctaggtttccaggacctccctggtctgtgtctcgtgggacgaggcgggacctacccattccaaacgtgccgaaagttcccaacgccaaggtagttgtttttagttccggcccccaaaccgaaattaactaacctaacgttagttaccgttcggtacctaacgacaacggtaaaagttaaggaccgaaacggtccctacctaaactaccgtgtaactttacgtcggtacgttcccgtaaccggcctacgttaccggggtttaccctaccggtaatcccgtaattcggtacacggngggtccgtcgggtaaccgttcgtaccttaacgtctcctaccgtagtccagtacccgagtccctgccgtagcgtagtaacngtgacgtctaaggtttntccgtagtcaccgtanaacctattacgttactttcgttacgtttactacccggttaggttccggaacggtaccggtaagtcgggttaaanaacccgttacggtaaacgtaacgtcggggttacaacggtttcggaacctaacncgttagtactcgacgtttaccc

SEQ ID NO: 64125 - DNA, 669 bp, Homo sapiens
  misc_feature: GYAE6OF01D3VOX.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagacctccctggctgtgtctcgtgggcgagacggcccacatacaactgacaacgtccagccgaagtagtttgttttacttccggaccccaaactaaactaaacctaacttaacgttagtaccgttacggtaacccaagtaccaaaggtaaaagtacggaacacgtaccctaacctaaactcctagtactttacgcggtccttaccgacccggtctacgttcccgggttacctaaaccgtattcagttcggacgtaggcgggtcgtagggtaccctatttaccactacctaccaactatacgacgctaacgtcctgacgacggtactaggaaagtacgtggtagtacttagtttaactactgtaccagtaacctaactaattaacttactttcttaccgtacttacggttcgggacggtaacggaccgtaagggtcgataacgaacgtaaacgtagtcggtggcctacgactacctacgttctacgttcctccgtacc

SEQ ID NO: 64126 - DNA, 619 bp, Homo sapiens
  misc_feature: GYAE6OF01CIL5R.31.78.H01.1.454.CMB.1.raw
  modified_base (325)..(325): a, c, t, g, unknown or other
  misc_feature (325)..(325): n is a, c, g, or t
  modified_base (448)..(448): a, c, t, g, unknown or other
  misc_feature (448)..(448): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagactccctggctgtgtctcgtgggcgaggacgggccaaccatcaactgcaagtccagccagagttgttttattcggaccccaacaataacaactacttagcttggtaccagcaagaaagtaggacagcctacctaaactcctagtactttacngggcttccgtacccgggctacggttcccggggttacctaaacggtacttcagttggcaggtcggggtctagggaccgtatttcacgtctacaacctatcacgcacgcctgccaggctagaagntggtagacgttagtttactactgtacaagtcaaactatttatacctttacgtttccgtacttaacgtttcgggacgggtacgggaaccaagggttggaacgtaacgtaaccgaaaacgtacgtggtccggtacgtcacctaaccctattccgttcggttccttcgtacccg

SEQ ID NO: 64127 - DNA, 764 bp, Homo sapiens
  misc_feature: GYAE6OF01CZR0A.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagacctccctggctgtgtctcgtgggcgaggacgggccaccatcaactgacaacgtccacgccagtagttgttttacttcggccccaacaataacaacttacttagcttacggtaccagacaagaaagtaggacacgccctacctaaactcctagtactttacgcgggtccttacgtacccgggactacggttcccggggttaccctaaccggttattcgtaacgttcggaccgacgggtccggggttcgtacggggtaacccgttactttaccgaacttccgtccaaccctactacgacgtccaacggtcccgtgaccgacggtacgtaggtaaacgtagtcgggtacggtaccgttaagttttaacgtttacgtacgttaccgtaacggtacctaaacgtttaattttaacgtttaccttttacgttttacccgtaccgtttaccggtttaccggggtaaccgggacggggtaacccgtaaaggggttacggaaagtaaccgtaaccgtaaaaccggttaacgtacggttcgggtacctacggtacctaacccgtacgtttaccgttacgttcccgtttacgttaccccg

SEQ ID NO: 64128 - DNA, 820 bp, Homo sapiens
  misc_feature: GYAE6OF01ARTK8.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagttgttttatttcggccccacaataacaactacttagcttggtaccagcaagaaagtaggacagcctacctaaactcctagtactttacgtggtcttaccgtacccgggtcacgttccccgggggtttaccctaaaccggtactttccgtaacgtttcggaccgtaacgggtcccgggggttcgttacgggggtaacccgttacttttaccgaccctttacccgttcccaaacccgtacttccgaacggtaccctaacggtccccgttacggaccgtaacggggtcccgttaaggaaaacggtaagttacgggttacgggtaccctttaaggtttttaactttaccgttcgttacccgaaggttaccctaaacgttaacttttaactttaacctttttaccgtttttacccgttaccgtttacccggtttttacccggggaccggggtaaccggggtaacccgttaaagggggtaggtaaaccggtaagttaaacccggtaaaaaccggtaacggtttacgggtccgggttaccgttaccggaccctaacccgtagtttcccgttacggtttccttaacccgttaacccg

SEQ ID NO: 64129 - DNA, 741 bp, Homo sapiens
  misc_feature: GYAE6OF01CH8NZ.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctcctggctgtgtctcgtgggcgaggacgggccaccatcaactgcaagtccagccagtagttgttttattcggccccaacaataacaactactagcttacggtaccagacaagaaagtaggacacgacctacctaaactcctagtacttttacgtgggtcctttaccgtaccccggggtctaccggttccccggggtttaccctaaaccggtactttacgaagtttcgggacctacgggtccggggttcgtacgggggtaccctagtttccacgtcctaccaacctataccgacggcctacgtccgtacggacgaacgggtacctaggaaacgtagtcgggtggtacgttaagttttacttacgttacggtactaacggtactaaaccgttaattaacgtttaccttttacgtttaccgttactttaaccggtttccggggaacgggtacgggtaacccgtaaaggggtcggtaaacgtaacgtaaccgtaaaaccgggtaacgttcgggtacggtcgttacgacctaaccgtaacgttccgtttcggtttacccgttcgttacccg

SEQ ID NO: 64130 - DNA, 945 bp, Homo sapiens
  misc_feature: GYAE6OF01EZ5DZ.31.78.H01.1.454.CMB.1.raw
tcagcagtagacgtcacgaccggtgctcgatttagtgtgagtagtttggggtttggggggagctacaacaggcaggcaggggcagcaagatggtgttgcagacccaggtcttcatttctctgttgctctggatctctggtgcctacggggacatcgtgatgagccagtttccagactccctggctgtgtctctgggcgagcgggccaccatcaactgcaagtccagccagagttgttttattcggccccacgaataacaactactagcttggtacagcaagaaacgtaggacacgtcctaccgtaaacctcctagaactttacgtcgggtcctttccggtaaccccggggtctaaccggttccccggggggtttacccctaaaaccccgggtactttccgaacgtttccggggtaccccgtaacggggttccccgggggggttacccgttacggggggtaacccccgttaacgtttttaccccgaaccgtttaccccgtttacccgaaacccctaagttacccgaaccggacccgtaaaccgggtcccccgttacgggtaccccggtaaggggtacccgttaaacggggtaaaaccgggtaacgttacggggtttaaccgggtacccgtttaaacgggtttttaaacgtttaaccgtttacggtttacccgaaacggtaaccccgtaaaccgttaaccttttaaaccgtttaacccgtttttacccgtttttacccgggttaacccctttaaccgggtttttacccgggggaccggggttaaccggggggtaaccccgttaaaacgggggttaccgggtaaaggtaaacccggtaacccgtaaaaaacccggttaaaaccggttccgggttaacggggtaaccgttaccggaccctaaaccccgtacggtttacccgttaccgggtttacccttccgttaacccg

SEQ ID NO: 64131 - DNA, 957 bp, Homo sapiens
  misc_feature: GYAE6OF01DDT9N.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgacgcctagtttccagacctccctggctgtgtctcgtgggcgaggacgggcccaccatacaactcgacaacgtccgacgccgaaggtacgttttcgtttttacgttccggaccccctaacctaaattaaaacctaaccgttaaacctttacggtaccgttttacggtaacccgaaggaccgtaaaggaaacggttaacggacaccggtacccttaacccgtaaaacctcctaacggttacgttttacggtcgggttcccgtttaccgtacccggggtacgttaccggttcccggggtttaccctaaaccgtacttacgtacgttcggacgtacgggtaccggggttcgtaccgggtaaccgttacgtttaccgaccctttccgtaccaacccgtacgttaccgaacgtccgtaacggtcccgtacgggtaccgtacgggtaccgttaagggaaacggttacgtttagggtaccggttacgtttaaacggtttttaaccgtttaccgttcggttaacccgtacggttaacccttaaacgtttaacgtttttaaccgtttacccgtttttaccgttttaacccggtttaccgtttaacccgggttttaccggggtaaccgggggtaaacgggttaacccggttaaaaggggttaaccggggtaaaccgttaccggttaaaaccccggtaaaaacggttaccccgggtttagggtcccgggtttaacccgtaccgggtaacccttaaacccgtttacgttacccttttaacccgggttccctttaacccgtttaaccccgg

SEQ ID NO: 64132 - DNA, 661 bp, Homo sapiens
  misc_feature: GYAE6OF01CJ6L7.31.78.H01.1.454.CMB.1.raw
  modified_base (406)..(406): a, c, t, g, unknown or other
  misc_feature (406)..(406): n is a, c, g, or t
  modified_base (500)..(500): a, c, t, g, unknown or other
  misc_feature (500)..(500): n is a, c, g, or t
  modified_base (646)..(646): a, c, t, g, unknown or other
  misc_feature (646)..(646): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagtacctcccgtggctggtgtctcgtgggcgaggacgggccaccataccaactgacaacgtccagccagtagtttgttttactccggaccccaactaaataacgtaactacgttaacgccttaggtaaccagtacgaaaggaaacgtacggactacgtcctaacctaaactctagtaactttacgtcgggtccttaccggtacccgggctaccggttccgggttacctaacgtnttcgtacgttcggacgtagggtcgggtctacgggaccttatttccgactctacactaactcaacgcgcgccgtagacgaggtcgtaaggaacgngtaggtgtacttagtttactacgtacgtacaacgtactaagtactttacttactttcttccgttacgtacggttcgggaacggtacggacgtaaggtacgacgtaactaacgaacgtagtcggtcgacgtcggacctacgttactnttacgttcttactcc

SEQ ID NO: 64133 - DNA, 767 bp, Homo sapiens
  misc_feature: GYAE6OF01D7O4I.31.78.H01.1.454.CMB.1.raw
  modified_base (409)..(409): a, c, t, g, unknown or other
  misc_feature (409)..(409): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagttccagactccctggctgtgtctcgtgggcgaggacgggccaccatcaaacctgacaagtccagccgaagtagttgtttttagttccggacccccaactaaacttaacctaaaccttaacttacgtcgttacggtaccaagacgaaagaaaggtaacggacacgtccctacctaaactccgtagtacgtttacgtcggtccttccgtaccgggtctacgttccggggttaccctaaccggtnttaccgtagttcggcgtaggtccgggtcgtacggggtaccgttactttccaacgttcctccgtaaccgtactaccgaacgccgtaacggccgttacgaccgtaggtaccgtaaggtaaacgtagttcggtaggttacctttaaggttttaactttacgtacggtaccgtaacgtacctaaacgttacttttacgtttaacccttttccgttttaccgttccgtttaaccggtttccggggaaccgggtacggggtaacctaagggtacggaacgtaacgtaacgtaaaacggtacggttggtaccggaccgtacgtaccgtaaccgttacgttccgtttacgttcgttaccgttaccg

SEQ ID NO: 64134 - DNA, 776 bp, Homo sapiens
  misc_feature: GYAE6OF01ADIGC.31.78.H01.1.454.CMB.1.raw
tcagcagtagacgtcacgaccggtgctcgatttagtgtgagtagtttgggtttgggggagctacaacaggcaggccaggggcagcaagatcggtgttgcagacccaggtcttcatttctctgttgctctggatctctggtgacctacgggactatcgtgatgacgccacgtttcccagtacctcccgtggctggtgtctcgtgggccaggacggccaccatcgaactgacaaggtccagccgagtagttgtttttaacttccggacccctaacaaactaaaccaacgtacttacgcgttacggtaccacgcaaggtaaagtacggacagcctacctaaactcctgtactttcgcgggtccttaccgtacccgggctacggtcccggggttacctaaccggtattaccgtaggtttcggcgtacgggtcggggttaccgtaccggggtaaccccttacgtttaccgacccttacccgtaccaaacccctagtacccggacgtacccgtaccggtcccgtacggtaccgtacgggtaccgtaacggtaacggtacgttacgggttacggtacgttaacgtttacgttacgtacgtactacgtaactaacttaactttaacgtttacctttaccgtttaccgttccgttaccggtttacgggttacgggtacgggtaaccgtaacgggtaggtaccccccgtaagtaaccgtaaacgtacggttacggtcggtaccgtacgacccgtacctacttaccgttcgttcgttccgttacccg

SEQ ID NO: 64135 - DNA, 717 bp, Homo sapiens
  misc_feature: GYAE6OF01BI5KX.31.78.H01.1.454.CMB.1.raw
  modified_base (314)..(314): a, c, t, g, unknown or other
  misc_feature (314)..(314): n is a, c, g, or t
  modified_base (334)..(334): a, c, t, g, unknown or other
  misc_feature (334)..(334): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgtttattcggccccacaataacaactacttagcttggtaccagcagaaagtaggacagcctacctaaactcctagatttacgngggtctttccgaacccgggnaacgttcccggggttacctaaaccgtattccagttggcaggtcggggtctcggggacccgtatttccgaccttcctaccaaccctattccgacgcaacgccctgccgtacggccttaggaaacgtagtacggtacgggaccttaaggttttaactttaaccgttagttaccgaacggtactaaaccgttaatttaacttaaccttttccgttttacccgttaccttaaccgtttttaccggggaccgggttaacggggaaccgtaaacggggttacggtaaacggtaacctaaccggtaaaaaccggtaacgttacgggttacgggtccttacggacccgtaaacccgtagttaacccgtttggtttaccctttcgttaaccc

SEQ ID NO: 64136 - DNA, 925 bp, Homo sapiens
  misc_feature: GYAE6OF01AEJ0S.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcagagggccaccatcaactgcaagtccagccagagttgttttattcggccccaacaataacaactacttagcttggtaccagcagaagtagacagcctacctaaactcctgtacttttacgtcggggtacctttccgtaccccggggctaacggttccccgggggtttaccctaaaccccggtactttccgtaacgtttcgggaccgtaagggtcccgggggttacccgttagggggtaacccccggtaagtttttcccgaacctttcccgttacccgtaaaccccgtacgttacccgaacggtacctaaccggtccccgttagggacccgtaacggggtccgtttacgggaaaacggttacggttacgggttacgggtaccgtttaaacggtttttaactttaacccggtttacggttaacccgtaacggttaaccctaaaaccgttaacgttttttaaacccgtttaacccgtttttcccggttttttacccgggtttaacccgtttaaacccggtttttacccggggggtaacccggggttaaccgggggttaaacccccggttaaaggggggttacgggtaaaccgggttaaaccggttaacccggtaaaaaacccgggttaacccggtttacggggttaaccgggggttaccccgttaacgggtaccccgtaaacccgttacgtttacccgtttaccggtttacccctttaccggtttaaaccccg

SEQ ID NO: 64137 - DNA, 784 bp, Homo sapiens
  misc_feature: GYAE6OF01EQAZ2.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacgggacatcgtgatgagcctagtttccagacctccctggctgtgtctcgtgggcgagacgggcccacatcaactgacaacgtccagaccagtagttgttttacgttccggaccccctaacaaataactaactacttacgtcgttacggtaccagacaagaaagtacggacacgtccctacctaacctcctagtacttacgtcggtaccttaccggtacccgggtctaccggttacccggggttaccctaaaccggttacttaccgtagtttacgggacccgtaggggtccggggttaccggtacggggtaaccctttacgtttaccaccttccctaccctacctactaccacggtaccgacgtacccgtaggaccgtacggtaccgtaggtaaacgtacggttcgggtacggtaacgtttaacgttttacgttaaccgttacggtacctacgtaaccgtaaacctttaatttacctttaccgttttccgtttaccggttccttaaccgggtttccgggacgggtaaccgggtaaccgtaaggggtacggtacgtaacgttaaccgtaaaccggtagttacgggtaccggtacgtaccggacccttacgtacttaccggtttcgttccttacccgtacccg

SEQ ID NO: 64138 - DNA, 787 bp, Homo sapiens
  misc_feature: GYAE6OF01AZEX1.31.78.H01.1.454.CMB.1.raw
  modified_base (463)..(463): a, c, t, g, unknown or other
  misc_feature (463)..(463): n is a, c, g, or t
tcagcagtagacgtcacgaccggtgctcgatttagtgtgagtagtttgggtttgggggagctacaacaggcaggcagaggcagcaagatggtgttgcagacccaggtcttcattttctctgtgctctggatctctggtcgccgtacggggacagtcgtgatggacgcctagtttaccacgtaccctcccgtggtcttcggtcgtccgtcggtgggacgaggacggcccacctatacgaactcgacaacgtccgacgaccgtagtagtttgttttacgttaccgaaccccaactaactaaacctaaccttacgttagtaccgttacggtaaccacgaacgaaagtaacgtacgaccgaccgtaccctaacttaaaccctcgtaacgttaacgtttaccggtcggttacccgttacccggtacccggtacgtaaccgggtttaccccgggttaacctaaaccgtntttacccgtaggttcggaaccggtacggtccgggtacgtaccgggtaccttacgttaccaccgttcctacccgaactacgtacgacgtaccgtacgccctagaccggtaggtactaaggtacgtacgtggttacgtgtttaacgttagtacgtacgttacaacggtactaacgttaagtttaccttccgttttccgtacgttaccgttaccggtcgggtaacggtacgggtaacgtacgggtagtaacgaacgttaaccgaacgtaccggttggaccggtacctacggtacctaccgtagtttacccgttacgttcccgtaacg

SEQ ID NO: 64139 - DNA, 782 bp, Homo sapiens
  misc_feature: GYAE6OF01AFBIZ.31.78.H01.1.454.CMB.1.raw
  modified_base (191)..(191): a, c, t, g, unknown or other
  misc_feature (191)..(191): n is a, c, g, or t
  modified_base (527)..(527): a, c, t, g, unknown or other
  misc_feature (527)..(527): n is a, c, g, or t
tcagcagtagacgtcacgaccggtgctcgatttagtgtgagtagtttggggtttgggggagctacaacaggcaggcaggggcagcaagatggtgttgcagacccaggtcttcatttctctgttgctctggatctctggtgccgtacggggacatcgtgatgacgcctagtttccagactccctggctggtntctcgtgggcgaggacgggccaccatacaactgactaacgtccagccaggtagtttgttttacgttccggacccctacctaaataacctaacttacttacggtcgttacggtaccaggactaaaggaaacggtacggaaccacgtacccttaaacccctttaaacgtcccttaggttaacttttaccgggtccgggtttacccgtttaccccggtaccccgggtacgttaaccgggtttaccccggggtttaaccctaaccgttacgtctacggttcggacgtacgggtccgggttcgtacgggtaacccgttatttccgacgttcctcaaccgtntaccgagtaccgtacggtcctgaccgtacggcttaaggaacgttagtcggtacgtacgttaagttttaactacgtcgttacgtaacgtactaaccttaagtttacctttaaccgtttcgtttaccgttacccggtacgtttccgggaacgggtacggtaccggtaagggtacggtacgtaacgtaacgtaaacggtacgttaggtccgtaccgtacgtaccgtaaccttcgttcgtttactcccttcgttcccgg

SEQ ID NO: 64140 - DNA, 703 bp, Homo sapiens
  misc_feature: GYAE6OF01D8MJ7.31.78.H01.1.454.CMB.1.raw
  modified_base (520)..(520): a, c, t, g, unknown or other
  misc_feature (520)..(520): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcggtgatgacgcctagtttccagtacctcccgtggctgtgtctcgtcgggcgacggacggcccacctataccaactgaccaacgtccacgccagtagtttcgttttacgttccggaccccaactaaactaacctaaccttacttacgtcgttacggtaaccagacaagtaaagtacggaacctacgaccttacctaaactccgtagtacgtttacgtcggtcttaccgtaccggtcgtaccgttccgggttacctaaccgtcttacgtacgttcggacgagggtccgggtacgtacggggtaccttacgtttccaacttccaccactacgtacgacgctacgtcctgaccgtaggcgttaagaacgngtagtcgtactttaagtttacttacgtcgtacaacgtacctaatacttaactttacctttacgttctacgttaccggtttacgggaccgggtaacggaaccggtaagggtacgttagaaacgtaccgtaaacggttacgtggtacggtactcggacctaccgtactgttcttcgtccttaccg

SEQ ID NO: 64141 - DNA, 576 bp, Homo sapiens
  misc_feature: GYAE6OF01A5PLD.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctggtgtctctgggcgagacgggccaccatcaactgcaagtccagccagtagttgtttttactttcggacccccaacaataaaccaactacttagcttggtaccagcagaaagtaggacagccctacctaaactcctgatttacgtgggcttcgtacccgggcacgtcccggggttcctaaccggtattcagttcggcaggtcgggtcgtgggaccgtatttcactctacaccatcagcagcctgcgaggctagaagtatggtcggctagtttatacgtgtcagtactaactattaacttacttctttcgtactacgtttcgggacggtacgggaccgtaagggtcggagacgtacgaaacgtacgtggtcggctgcctacatctgtccttctcc

SEQ ID NO: 64142 - DNA, 775 bp, Homo sapiens
  misc_feature: GYAE6OF01BUOZQ.31.78.H01.1.454.CMB.1.raw
  modified_base (394)..(394): a, c, t, g, unknown or other
  misc_feature (394)..(394): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagacctccctggctgtgtctcgtgggcgaggacgggcccaccatcaactgacaacgtccagccagtagttgttttacgttccggaccccaacgaaataaccaaacttacttacgtcttaggaccagacaaggaaagtagaccacgaccctacctaaactcctagtactttacgtcgggtccttaccgtacccgggctacgttcccggggttacctaaccgtnttacgtagttcggacgtacggtccgggttcgtacggggtacccgtatttaccaaccgttcccgtaccaacccgtactaccgacgacctacggtcccttacggaccgaacgggtcctaagggaaacgtgttacgggtacggtacgtttaaggtttttaacttaaccgttcggtactaacggtaactaaactttaacgtttaactttaaccgtttttcccgtttaccgtttacccgtttaaccgggtttaccgggtaccggggtaacgggtaacccgtaaggggtacggtaaacggtaacgtaaccgaaaaccggttacgttgggtaccggttacgtaccgaccgtaaccctacgttaccgttcgttccgttaccgttacccg

SEQ ID NO: 64143 - DNA, 902 bp, Homo sapiens
  misc_feature: GYAE6OF01CLZVZ.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtcgccgtacggggacatcgtgatgagcctagtttccagacctcccgtggctgtcgtctcgtgggcgaggacggccaccatacaaccgtgacaaacgtccgacgccagtacgtttcgtttttacgtccggaccccctaactaaattaaacctaaccttaacgtttacggtaccgtttacgggtaacccaagtaaccgaaaggtaaaaacggtacggaaccaccggtacccctttaaacccttaaaaccgttccgttacgttaaacgttttaacccggtcgggttaccccgttttacccggtaacccccgggggttactaaacccggggttttcccccgggggtttaacccctaaaaacccgggtttcgttttacccgtaaacggttttcgggaccccgttaaacggggttcccgggggttaccgttaaccgggggtacccttaaacgttttccggaacccctttacgtaccctaaaccggttacttacccgaacggccgttaccgtacccgtacggaccggtaacgggtaccgttaaggtaaccgtaagttcgggtaccggtactttaacggttttacttacggtggtaacctaacggtaactaaacgtttatttcctttaacgtttccgtttaacgttccgtacggtttaccggggacggaacggtaaccgttaggggtacgaaccttaacggtaacgtaaaaccggtgtcggtaacggtctaaccgaccgttaacttacgttccttaccgttctcgtaaccccg

SEQ ID NO: 64144 - DNA, 639 bp, Homo sapiens
  misc_feature: GYAE6OF01A2BUL.31.78.H01.1.454.CMB.1.raw
  modified_base (425)..(425): a, c, t, g, unknown or other
  misc_feature (425)..(425): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagtttccagactcccgtggctgtgtctcgtgggcgagacgggccaccatacaactgacaagtccagccaagtagttgttttagttcgaccccaacaaactaacaactacttagcttaggtaaccagacaagaaagtagaacagaccctactaaacctcctagtactttacgtggacctttccgacccggtcacgttacccggggttacctaaaccgtattacgagttggacaggcgggtcgtgggaccgtatttcacttcncaaccatcagcacgcctcgcgagcgtagaagtagtaggtgtcctaagttttataacgttcgtacagactaaatacgtttaattacccgtttctttaccgttactaccgttttacgggacggtaacgggaaccgtaagggtcggtaaagtaacgtaacgaaaacgtaacgtggtacgcgtacgacctaaccagttactacttccgttactacccg

SEQ ID NO: 64145 - DNA, 759 bp, Homo sapiens
  misc_feature: GYAE6OF01B3NWO.31.78.H01.1.454.CMB.1.raw
  modified_base (350)..(350): a, c, t, g, unknown or other
  misc_feature (350)..(350): n is a, c, g, or t
  modified_base (420)..(420): a, c, t, g, unknown or other
  misc_feature (420)..(420): n is a, c, g, or t
tcagcagtagacgtcacgaccggtgctcgatttagtgtgagtagtttgggtttgggggagctacaacaggcaggcagggggcagcaagatggtgttgcagacccaggtcttcatttctctgttgctctggatctctggtgcctacggggacatcgtgatgagcctagtttccagactccctggctgtgtctcgtgggcgaggagggcccaccatcaaactgcaacgtccagccagagttgttttattcggccccaacaataacaactacttagcttggtaccagcaagaaagtacggacagcctacctaaactcctagtactttacgtcgggtccttccgtaccccgggntacggtcccggggtttacctaaccgtattactagttcggacgacgggtcggggtcgtacggggaaccgtnttttccgacttcctaccaccacttcgaagccacggtcctgacgtaggtctaagggaaagtacggttggtacgggtacttaaggttttaacttaacgttggtactaaacggtaccttaaaacttacgtttaaactttacccttttacgttttcccggttacgtttaaccgggtttccggggaacggggttaaccggggtaaaccggttaaggggttaacgggtaacgaaaccgttaaacggtaaaaacccggttacggttagggttcgggtacccgttacggaaacccctttaaccctaacggtttaccgtttaccggtttcctttaaccccgttacccg

SEQ ID NO: 64146 - DNA, 864 bp, Homo sapiens
  misc_feature: GYAE6OF01B9NKQ.31.78.H01.1.454.CMB.1.raw
tcagcagtagacgtcacgaccggtgctcgatttagtgtgagtagtttgggtttgggggagctacaacaggcaggcagggggcagcaagatggtgttgcagacccaggtcttcatttctctgttgctctggatctctggtgcctacggggacatcgtgatggagcctagtttccagacctccctggctgtgtctcgtgggcgaggacgggccaccatcaactgacaacgtccacgccagtagttgttttacttaccggccccaacctaataactaactacttagtcttacggtaccagacaaggaaagtacggacacgaccctacctaactcctagtactttaccgtggtcctttcccgtacccgggtctaccggttacccggggttaccctaaccggtacttaccgtaggttcggaccgtacgggtcccggggttaccggtacgggggtaaccccttacgttttcccgaacctttcccttaaccgtacccctaattacccggacgtaccgaccggtcccgtaggcccgtagggaccttaagggaaacgtcggttaggtacgggtacgtttaagtttttaacgttaccgtgttaccgaaacgaacctttaaaaccgtttacgtttaaccttttaacccgtttttacccgtttttacccgggttaccgttttaaacccgggtttttcccgggggaaaccggggttaaccggggtaaccccggtaaagggggttaccggtaaacgggtaaacttaacccggggaaaaacggttaccgttacggggttccggtaccccgtttaggacccccgttaaaccgttacgtttacccggtttaaccggttttcccgttaacccgttaccccgg

SEQ ID NO: 64147 - DNA, 780 bp, Homo sapiens
  misc_feature: GYAE6OF01BS658.31.78.H01.1.454.CMB.1.raw
tcagcagtagacgtcacgaccggtgctcgatttagtgtgagtagtttggggtttggggggagctacaacaggcaggcagggggcagcaagatggtgttgcagacccaggtcttcatttctctgttgctctggatctctggtgccgtacggggacatcgtgatgagccctagtttccagacctcccgtggctgtgtctcgtgggcgaggacggcccacatacaactgacaagtccagccagtagttgttttacgttcggaccccaacaaataactaactacgttacgcttacggtaaccagacaacggaaaaggtacggaacacgtaccctacctaaaacctccgtagtactttaccgtcgggtacctttaccggtaccccgggctaaccggttcccggggttaccctaaaccgtattccgtagtttcggcgtacggtcggggtcttacgggggacccttatttaccgacttccgtactaaccccgtatccgacgacccgtacgtcccgtaggaccggacggtacgtaacgtaaacggtacgttgggtaccgtaggtttacgttttaacgttaacgttcgttaaccaaggttacctaaacttacttttaaccgttaccttttccggtttccgttaaccgttaccggtttccgggaaccgggaacgggttaaacccggtaagggtagggtaacgtaacgttaaccgtaaacggtaggttaacgggttcggacccgttagaccggtaaccttaccgttacgtttccttaccgttcctaacccg

SEQ ID NO: 64148 - DNA, 644 bp, Homo sapiens
  misc_feature: GYAE6OF01BH05Z.31.78.H01.1.454.CMB.1.raw
  modified_base (601)..(601): a, c, t, g, unknown or other
  misc_feature (601)..(601): n is a, c, g, or t
  modified_base (611)..(611): a, c, t, g, unknown or other
  misc_feature (611)..(611): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagacctccctggctgtgtctcgtgggcgaggacgggccaccatcaactgacaagtccagcctagtagttgttttattcggaccccaacaataacaactacttagcgttagaccagacaagaagtagacacgcctacctaactcctgtactttacgcggtctccgtaccggctacggttcccgggtacctaaccgtattccaagttcggacgtacgggtcgggttcgtacggggtacccgttacttttaccaccttcctaccgtacccagttcacgcacgtcctgaccgtaggccttaaggaagtactggtacgtcgtaagtttttatacctgtaccagtacctaagtttattaacttactttcgttacgttacctacggtttcggggaccggaaggtaccgtaagggtgaacgtactacgaaaacgttntggtacggtntaccgacgtaacctgttacgttctcgtcctacg

SEQ ID NO: 64149 - DNA, 703 bp, Homo sapiens
  misc_feature: GYAE6OF01DONFR.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagttccagacctcccgtggctgtgtctcgtgggcgaggacggcccaccgataccaactcgacaagtccagccagtagttgttttattccggaccccaacaaataaacctaactacgttacgacgttacggtaaccagacgaagaaacgtaggacacgtacccttaacctaaacctccgtagtactttcggtcggtacctttccggacccgggtctacggttaccccggggttaccctaaaccgtctttacgaagttcggacctagggtccgggtacgtacggggtaacccttagtttcccgaaccttcccgtaccgaacccctaataccgaacggaccgtacgcccgtacgaccgtaacgggtccgtaaggaaacgtagtcgtacgtacgttagttttactacgtgtacgaagactaactctttaatcgttcctttgtactacgttcggacggtacgacgtagggtagagtaaccgtaaccgaaagtagttacggtcgacgtcgtaccacgttattacgttactccgttcgtaacccg

SEQ ID NO: 64150 - DNA, 632 bp, Homo sapiens
  misc_feature: GYAE6OF01BTMWP.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagacgggcccaccatcaactgacaagtccagccagtagttgttttattcggccccaacaataacaactacttagcttaggtaccagacagaaagtaggacagcctacctaaactcctagtactttacgtgggcttccgtacccgggctacgttcccggggttacctaaccgtattcagttcggcacggcgggtcgtgggacctatttccactccacaccatcgacgcacgcctgcgagctagaagtagtggtacggtactaaggttttactacgtcgtacacgtactaactactttaacttacctttccgtttacgtaccgttacggtttaccgggacgggtacgggtaaccgtaagggtacggtaagtaacgtacgaaaacggtacgtggtcggaccgtcgacctacctagttaccttcgtcccttcgtacccg

SEQ ID NO: 64151 - DNA, 901 bp, Homo sapiens
  misc_feature: GYAE6OF01AUROL.31.78.H01.1.454.CMB.1.raw
tcagcagtagacgtcacgaccggtgctcgatttagtgtgagtagtttgggtttgggggtaggctacaacgaggacgaggcaggggcagcgaaggatcggtgttgccagacccgaggtcttcctatttcctccttgttcgcctctggatctctggtcgccgtacggggtacagttcggtgacgtagacgcctagtttccagtacctccctcggtctgttcgttccgtcgtcgggaccgaggacggacccaccgataccgaactgtacgaacgtccgagccgaaggtagttgttttaagttaccggaccccctaacgtaaactaactaacgttaaccttaacgcttaggtaccacgacgaagaaacgtcgacacgtcccttacctaaacgtcctagtacgtttacgtcgggtacttccggtaaccccgggcgtaaccggttcccggggttaacctaaacccggtacttacgtacgttacggtaccgtaacggtccggggttaccgtaacggggaaacccgtttaccgtttacccgaaccgtttacccgtaccccgtaaacccccgttaaagttaccccggaacggaccccgtaacggtacccgttaccgggaaccggtaacggggtaccgtaaggtaaacggtagttacggttacggttaaccgttttagtttaacgttaacgtttggtaaccgtaaacggttaccttaaaacgtttaacgtttaactttaacgttttacccgtttaccggtttaccggttaaccggtttaccggggaaccgggtaaccgggaaccgttaaggggtaccgtaaccggtaacgtaaccgtaaaacgaccggttacgtacggtaccctacgtacctaaccccggtattacccgtttcgttcctttcccgtacccg

SEQ ID NO: 64152 - DNA, 572 bp, Homo sapiens
  misc_feature: GYAE6OF01BY89M.31.78.H01.1.454.CMB.1.raw
  modified_base (445)..(445): a, c, t, g, unknown or other
  misc_feature (445)..(445): n is a, c, g, or t
  modified_base (569)..(569): a, c, t, g, unknown or other
  misc_feature (569)..(569): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcagagggccaccatcaatgcaagtccagccagagtgttttattcggccccacaataacaactacttagcttggtaccagcagaaagtaggacagccctacctaaactcctgtactttaccgtgggtccttccgtaccccgggcacgttccccgggggttacctaaacccggtattccatttcggcacggtcgggtctaggggacccgtatttccgacttctcaaccatcacgcagcctgcaggctagaagntgtggctagttttactactgtcagcaactattacttactttctttcgtactacgtttcggcggtaggaccgtaaggtgaagatacgaaacgacttggtcgctgacctacacttcctgttccttntac

SEQ ID NO: 64153 - DNA, 576 bp, Homo sapiens
  misc_feature: GYAE6OF01ES3I2.31.78.H01.1.454.CMB.1.raw
  modified_base (361)..(361): a, c, t, g, unknown or other
  misc_feature (361)..(361): n is a, c, g, or t
  modified_base (428)..(428): a, c, t, g, unknown or other
  misc_feature (428)..(428): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccaccaataacaactacttagcttggtaccagcagaaagtagacagcctacctaaactcctagtactttacgtgggtccttcgtacccgggctacgttccggggttaccctaaccgnttctattggcaggcgggtctgggaccgtatttcactctcaccatcagcacgcctgcaggctagaagntgtggctagtttatactgtacagtaccaactattacttaccttctttcgtctacgtttcgggacggacgggtaccaagggtcgaagactaacgaaacggtactggtcggacctggaccctactacgttacctgttcccttgtaacccg

SEQ ID NO: 64154 - DNA, 781 bp, Homo sapiens
  misc_feature: GYAE6OF01ENMT3.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtcgaccgtacgggacatcgtgagtgacgcctagttccagtacctcccgtggctgtgtctcgtgggcgaggacggccaccataccaacgtgacctaacggtcccagtaccaggttagtttcgtttttacttccggaccccctaaactaaataaccaactacgttacgtccgttacggtaccgagacgaaggaaagtacggaacaccgtacccttaccgtaaaccttccgttagtactttacggtcgggttccttacccggtaccgggtaccgtacggttacccggggtttaccctaaccgtagttactacggtcggaccgtcgggtcgggtcgtacgggtaaccttcttaccgacttcctaccctactacttacgacgtactccgtacctgaccgtacggtctaaggtagtacgttggtacgtacgtttaacgtttacgttacgtacgtaacgtaccgtaactaactttagtttaacctttacgtttacccgtttacgttaccgtttaccggtttacgggaaccgggtaaccgggtaacggtaaggtacggaacgtaaacgtaaccggttaaacgtaggtacggttcggtacctacggtaaccgttacttaccgttagtttaccgttccgtttaccgtaccccgg

SEQ ID NO: 64155 - DNA, 861 bp, Homo sapiens
  misc_feature: GYAE6OF01DMKTU.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcattctctgttgctctggatctctggtgccgtacggggacagtcgtgatgacgcctagtttccagcctcccgtggctgtgtctcgtgggacgaggacggccaccatcaactgacaacgtcacgccagtagtttgttttacgttccggacccctaacctaaactaaacctaacttacgttacgtacgttacggtaaccgagacgaaaggtaaacggtacggaaccgacgtaccccttaaccttaaaaccgtccgttacgttaacttttaaccggtccgggtaccgtttaccccggtaccccgggtacgttaccgggttccccggggtttaaccctaaaccgtacgtttaccgaacggtttcgggaccggtacggggtcccggggttacggttaccgggggtacccgttaacgttttacccgaaccgtttccttaaccccgaaccgttacgttaccggaacgtacccggtacgttaccccgtacgggtccggtaacgggttcgtaaacggtaaagggttacggtttacgggtacggttacgtttaagtttttaaaccgttcgttaacgtaccgaacgttaactaaacttacgttttaacgtttaccgttttccgttacgttacccggttaccggtttcggggaacgggtaaccggtacggtaacggttacggaacgtacgtaaaccgtaaccggtagttcggcggtactaccgtaccgtaacccttgttaccttcgttcccttacgttccccg

SEQ ID NO: 64156 - DNA, 743 bp, Homo sapiens
  misc_feature: GYAE6OF01DZPCS.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagacctccctggctgtgtctcgtgggcgaggacggccaccatacaactgacaagtccagccagtagttgttttacttcggaccccaactaaataacctaacgttacttagcttacggtaaccagacaagaaagtaggacacgtccctacctaaactcctagtactttacgtcgggtcttccggacccgggctaccggttcccggggttaccctaaaccgtcttaccgaagttcggacgtacgggtccggggttcgtacggggtaccgttactttccaacccgttcctacctaaccctactaccgaacggtccaacgtccccgtaggaccgtacggtaccgtagggaaagtacgttggtccgggtactttaaggtttttaaccttacgttcggtaacactaacgtaaactttatttaactttaccttttccgtttacgttccgttaccggtttccgggacgggtacgggtaacccggtaagggttaggaacgtaactaaccggaaaaccgttagttcggtacggacttccgaccctaaccttaacgtcgtttaccgttccgttccgtacccg

SEQ ID NO: 64157 - DNA, 726 bp, Homo sapiens
  misc_feature: GYAE6OF01E4KDL.31.78.H01.1.454.CMB.1.raw
  modified_base (432)..(432): a, c, t, g, unknown or other
  misc_feature (432)..(432): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagactccgtggctgtgtctcgtggcgagacggccacatcaactgcaacgtccagccagtagttgttttacgttccggaccccaacgaaataacaaccttacttacgtcgttacggtaaccagactaaggaaagtacggacacgtaccctacctaaacttccgtagtactttacgcggtaccttaccggtacccgggctacggttccgggttacctaaccgtattcgagttcggactacggtcgggtacgtcgggtaccgtntttaccaccgttactaccgaaccagttacgacgtaccgtacgtcccgtaggaccgacgggtctacgaagtacgttaggttacgtacttaaggttttagtaccgttgtaaccgaacggtaacctaacgttaactttacgtttaaccgtttccgtttaccggttaccgttaccggttttcgggggaacccggtacggggtaaccgtaagggtggtaaacgtacgtaaaccggaaacgttaacggtcggtcgggtccttacggcctaaccgtattacgttacgttcctccgttaccg

SEQ ID NO: 64158 - DNA, 835 bp, Homo sapiens
  misc_feature: GYAE6OF01B0TZU.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgacgcctagtttccagacctcccgtggctgtgttctcgtgggcgaggacgggcccaaccactaccaactgaccaaacgtccacgcccgaaggttagtttacgtttttacgtttaccggacccccaaaccctaaaacttaaaacctaaaccttaaccgtttacgtaccgtttacggtaaccctaggaacgtaaaggtaaaaggtacggaaccgacgtaccctaacctaaacctccgtagtacgtttacgtcggtaccttccgtacccgggctacggtacccgggttacctaaccgtattctacgttggacgtagggtccgggtcgtagggtacccgttactttccacgtcctaccgtaaccagtaccgacgactaaccggtccctaggaccgtaccggtaacttaacggaaggtacgttacgggtacggtaccgttttaaaggtttttaaccttaccggtttacgtacgttacgaaaccttaaacctttgttttaacctttaccgtttttaccgtttaccgttaccggtttaccgggtttacccgggtaacggggtaccggtaaacgggttaagggtacgtacgaaaccggttaaacgaaacccgggtagtgggttaaccgcgttaccgtaacccgaacttacccggttatttacccgttactttacgttacccccg

SEQ ID NO: 64159 - DNA, 783 bp, Homo sapiens
  misc_feature: GYAE6OF01BH6Q6.31.78.H01.1.454.CMB.1.raw
  modified_base (190)..(190): a, c, t, g, unknown or other
  misc_feature (190)..(190): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtcgccgtacggggacagtcgtgatgacgcctagttccagacctccctgctgtntctcgtgggcgaggacggccaccatacaacgtgacaaggtccagaccgaaggtacgtttgtttttacgttccggaccccctaaacaaacttaaacgaacttacgttaagtcgttacggtaaccaagtacaaggtaaacggtacggaacacgtacccttacctaaaacctccgttataactttaccgtcgggtacctttaccggtaccccgggactaaccggttccccggggtttaaccttaaaccggtattaccgtaggttcggaccgtaacgggtcccggggttacgtaccggggtaccttaattttcccgaacgttcctaaccgaacctagtccgacgaccgtacgtccctaggccgacggtactagaacgtagtcggtacggtacttaacggtttatcgtacgtacaacgtacttaactagttttaccgttaacctttccgtttacgtacctttaccggttacgggacccgggtaacgggtaaccgaagggttccggtaaagtaccgttaaaccggtaaacgtaccgttggtaccggtctaaccgacccgtaacccgttattacccggttcgttacccttcgttaccccg

SEQ ID NO: 64160 - DNA, 828 bp, Homo sapiens
  misc_feature: GYAE6OF01AZXZ6.31.78.H01.1.454.CMB.1.raw
  modified_base (644)..(644): a, c, t, g, unknown or other
  misc_feature (644)..(644): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgacgcctagtttccagacctccctggctgtcgtctcgtgggcgaggacgggccaaccatcaactcgacaacgtccagacctaaggtagtttcgttttaacttccgggacccctaaacctaaataaacctaaacttacttaacggtctttacggtaaccaaggtacctaaaaggtaaaaggtaacgggaaccaacggtcccctaacctaaacctccgttaagtaccttttacggtcgggtaccttaccgggtaccccggacgttaaccggttcccggggtttaacccctaaccggtacttactaacggttcggacggacgggtccgggtacgtacggggtacccgtactttaccaccgttcctaaccacctatcgacgcgtaaccgtccgtacgcggtaacggactaacggaacggttaacgtcggttacggtaactttaaggttttaactacgttacggtaccctaacggttaccctaaaagttntttaaccgtttaccgttttaccgtttaccgtaccgttacggtttaccggggaaccggggtaagggtaaacccgtaaggggtacgtaaaccggttaaaccgtaccggtaaaaacggttcggtcggtaaccggaccttaacggtacccaaacgtttcgtaacttttcggtcccctttacgtaaccc

SEQ ID NO: 64161 - DNA, 720 bp, Homo sapiens
  misc_feature: GYAE6OF01DDA0D.31.78.H01.1.454.CMB.1.raw
  modified_base (571)..(571): a, c, t, g, unknown or other
  misc_feature (571)..(571): n is a, c, g, or t
  modified_base (679)..(679): a, c, t, g, unknown or other
  misc_feature (679)..(679): n is a, c, g, or t
  modified_base (693)..(693): a, c, t, g, unknown or other
  misc_feature (693)..(693): n is a, c, g, or t
  modified_base (716)..(716): a, c, t, g, unknown or other
  misc_feature (716)..(716): n is a, c, g, or t
tcagcagtagacgtcacgaccggtgctcgatttagtgtgagtagtttgggttgggggggagctacaacaggcaggcaggggcagcaagatggtgttgcagacccaggtcttcatttctcgtcgttgcctctggactcctctggtcaccgtacggggactagtcgtgagtcgacgcctagtttccagtacctccgtggctgtcgtcctcgtcgggacgacggacgggcccgacccgataccgaacgtcgacaacgtccacgtccgtaggtaggttttacgttttacgttccggaccccaaactaaattaaaccgtaaactttacttacgtacgtttacggtaacctaggactaaaggaaacgtacgaaccacgtacccttaacccgtaaacctccgtagttactttaccggtacggccgtttaccggacccgggtactacgttacccggggttaccctaaccggtcttacgacggttccggacgtaacgggtcggttccgtacggggaccttacctttaccgaaccttcgtacccgacctctaacccgacgacctacgtcccgtgtaaccgngggtactacggtaaggtacgtcggtcggtagtagttttacactgtacgtaactcgtactaatttctaactttcgtacgtcttacgtgggacgtgaacgtagaggatanacgaaggtgtcggngacacggctacagttctctcgtntacc

SEQ ID NO: 64162 - DNA, 838 bp, Homo sapiens
  misc_feature: GYAE6OF01EKUAR.31.78.H01.1.454.CMB.1.raw
  modified_base (457)..(457): a, c, t, g, unknown or other
  misc_feature (457)..(457): n is a, c, g, or t
tcagcagtagacgtcacgaccggtgctcgatttagtgtgagtagtttgggttgggggagctacaacaggcaggcaggggcagcaagatggtgttgcagacccaggtcttcatttctctgttgctctggatctcgtggtcgccgtacggggacatcgtgatgacgcctagtttccagtacctcccgtggctgtcgtcgtcgtgggcgaggacggcccaccatacaactgacacgtccagccgagttagttgttttagttccgacccctaactaataactaacttacgttagaccgttaggtaaccaggacgtaaaggtaaacggtacggacacgtacccctaacgtaaacctccgtagttaacgtttacgtcgggtaccttacccggtaacccgggtctaccggttccccgggttacctaacgtcttccgtacgttcggaccgtacggtcgggttacncggggtaacccttagtttcccacgtcccgtaacctaacgtacgttaccgacgtaccgtaccggtaccgttacggaccgtaaggtaccgttaaacggaacgtacggttacggtacggtaccggttttaacgttttaacccgttacgtaccgtaccgtaacggttaaccctaaacgtttacgtttaacctttacccggttttactttcccgggttaacgtttaccgggtttaaccggggaacgggtaaccggggtaacgtaaggggttaccgtaaacgtaaccgttaaaccggtaaaccggttacggttacggggtaacgtacggtacccgaaccggttaaccttacggttaccccgggtttattccccgttaactaccccgg

SEQ ID NO: 64163 - DNA, 662 bp, Homo sapiens
  misc_feature: GYAE6OF01BUT9S.31.78.H01.1.454.CMB.1.raw
  modified_base (348)..(348): a, c, t, g, unknown or other
  misc_feature (348)..(348): n is a, c, g, or t
  modified_base (374)..(374): a, c, t, g, unknown or other
  misc_feature (374)..(374): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacgggacatcgtgatgagccagtttccagactcctggctgtgtctcgtgggcagaggccaccatcaactgcaagtccagccagtagttgttttatcggcccctaacaaataacgtaactacttagcttaggaaccagacaagaaaacgtaggacagtacctacctaaaacgtcctagtactttacgtggtcctttccgacccggntaacgttcccggggttacaaaccgtnttcagttggacaggcggtactgggacctattcactctacaccgatcagcacgtcctcgacgtaggcgtagaacgtagtacgtacggtacttaagtttaacgttaccgtaggtacctaagtacctaaacttaattaacctttaaccgtttccttttaccgtaccgttaaccggttttacgggaccgggtaagggtaacccgtaaagggtaacggtagtaaacgtaaccgaaaacgtaagtaggtcggacgttcggaactacctagttacgtacgttccgttacgtaccc

SEQ ID NO: 64164 - DNA, 586 bp, Homo sapiens
  misc_feature: GYAE6OF01EMU47.31.78.H01.1.454.CMB.1.raw
  modified_base (318)..(318): a, c, t, g, unknown or other
  misc_feature (318)..(318): n is a, c, g, or t
  modified_base (433)..(433): a, c, t, g, unknown or other
  misc_feature (433)..(433): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggccccacaataacaactacttagcttggtaccagcaagaaagtaggacagcctacctaaactcctagactttacgngggtccttcgtacccgggctacgttcccggggttacctaaccgattcagttcggacaggcgggtctacggggacctatttcacttctcaaccatcagcagcctgcagctagaagntgtggactagtttattacgtgtacagtacaactattaattacctttctttcgttactacgtttcgggacggtacgggacgtaagggtagtagtactaaccgaaacgtacgtaggtcggtactcgacctacctacttcgtcgttccttctaccg

SEQ ID NO: 64165 - DNA, 779 bp, Homo sapiens
  misc_feature: GYAE6OF01CTU6Z.31.78.H01.1.454.CMB.1.raw
  modified_base (500)..(500): a, c, t, g, unknown or other
  misc_feature (500)..(500): n is a, c, g, or t
  modified_base (734)..(734): a, c, t, g, unknown or other
  misc_feature (734)..(734): n is a, c, g, or t
  modified_base (757)..(757): a, c, t, g, unknown or other
  misc_feature (757)..(757): n is a, c, g, or t
tcagcagtagacgtcacgaccggtgctcgatttagtgtgagtagtttgggttgggggagctacaacaggcaggcaggggcagcaagatggtgttgcagacccaggtcttcattctctgttgctctggatctcgtggtcgccgtacggggacagtcgtgatgacgcctagtttccagtacctcccgtggcttggtcgtcctcggtcgggcgacggacggccctacatacaactgacacgtccacgacctagtacgtttgttttacgtccggacccctaaactaaactaaacctaacgttacgttacgtccgttaacggtaaccagtacgaaaaggaaagtacggaactaccgtacccttaaacctaaaccttcgtagttaacgtttacggccgggttacctttccggacccgggtacttaccgggttacccgggttaaccctaaacggtctttccgtaaggttcggacgtacgggtcgggttacggtacgggtacccgttntttaccgaccttctacccaaccgtaatccgacgtctacgtccgaggaccgacggtctaaggaaacgtggtacggttacgtaacgtttagttttactacgtgttaaccacgtaattaaacgttacgtttactttacccgtttaccgtttacccggtaccgtttaccgggttacgggaaccgggtaagggtaaccgtaaggggtaccgtaaggtaacctaaacgggaacgttacgnggtcggcctaacgctaaccgttntccggtcctacgttcgtacccg

SEQ ID NO: 64166 - DNA, 828 bp, Homo sapiens
  misc_feature: GYAE6OF01DASGV.31.78.H01.1.454.CMB.1.raw
  modified_base (243)..(243): a, c, t, g, unknown or other
  misc_feature (243)..(243): n is a, c, g, or t
tcagcagtagacgtcacgaccggtgctcgatttagtgtgagtagtttgggtttgggggagctacaacaggcaggcaggggcagcaagatggtgttgcagacccaggtcttcattttctctgttgctctggatctctggtgccgtacggggacagtcgtgatgagcctagtttccagacctcccgtggctgtgtctcgtggcgagacggccaccatcactgcaagtccagccagtgttgttttnttcgaccccacaataacactacttagcttcgtaccagacaagaaagtacgacacgtaccctaccttaaacctcctagtacgtttcggtacggtcctttaccggtaccccgggtctaccggttacccggggttacctaaaccgtacttaccgtagtttcggaccgtacgggtaccgggttcccggttacggggtaacccgtttaacgttttacccgaccctttacccttaacccgtaaccctaacgttacccgaacgtcccgaaccggtccccgttcggtaaccgtacgggtaaccgttaagggtaaacggttacgtttcggttacgggtacccgttttaaaggtttttaaccgttttaccgttacggttaccgtaaacgtaaccttaaactttaacgtttaacccttttaacccgttttaccgtttttaccggtacccgtttacccgggtttcggggaaccggtaaccgggtaaaccgttaaccgggggtagtaaaccggtattaaacccggtaaaacgtagggtttcggaggtcccgttacgtaacccgtactaacgttcgtttccgttccgtttcgtaccccg

SEQ ID NO: 64167 - DNA, 742 bp, Homo sapiens
  misc_feature: GYAE6OF01BSEFX.31.78.H01.1.454.CMB.1.raw
  modified_base (234)..(234): a, c, t, g, unknown or other
  misc_feature (234)..(234): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagtttccagacctccctggctgtgtctcgtgggcgaggacggccaccatcaactgacaagtccagccagngttgtttattcgacccacaataacactactagcttaggtaccagacaagaagtacggacacgtccctacctaaactcctagtactttacgtgggtcctttaccgtaccgggctacggttccccggggttacctaaccgtattcgaagttcggactaggtccgggttcgtacgggtacccttatttccgaccttccgtaccaacctatccgagtacctacgtccgtcgacgtacggtactaggaaacgtagtcggtacggtacgttaacgtttacgttaccgttacgtacgtaacgtacctaaacttacgttaactttacccttttacgtttacccgttacgttacccgggttttacgggaccggggtaacggtaacccggttaagggtacgggtaaacgttaaccggtaaaccgtaaaccggttaacgttagggttaccggtaccgttaccggtaaccccttaccgtaacgtttcccgttaccgtttccgtttacccgttaaccccgg

SEQ ID NO: 64168 - DNA, 975 bp, Homo sapiens
  misc_feature: GYAE6OF01DU6M9.31.78.H01.1.454.CMB.1.raw
tcagcagtagacgtcacgaccggtgctcgatttagtgtgagtagtttggggtttgggggagctacaacaggcaggcaggggcagcaagatggtgttgcacgacccaggtcttcatttctctgttgctcgtggatctcgtggtcgaccgtacggggacagtcggtgatgacgcctagttccagtacctccgtggtcttgtcgtctcgtgggcggacggacgggacccaccataccaacgtcgacaacgtccacgccgaaggttagtttacgttttacgttcccggacccctaaactaaactaaacctaacttacgttacgtaccgttacggtaaccacgtacgaaaggtaaagtacggaaccacgtcccctaaccgttaacctccgttagttaacgtttacggtccgggttacccgttacccgggtacccgggtacgtacccgggtttaccccggggtttaaccctaaaccgttacttaccggtacggttacggaccggtacggggtccggggttaccggtaccggggtaacccttacgtttaccctaccctttaccgtacccgtaacctacttacccggaacggaccgttaccgtcccggtacggtaaccgaacgggttaaccgtaaagggtaaaccggtttggtcgggggtttaacggttaaccgttttaacggtttttaacgtttaccggtaccgtttaaccggaaactttaaccgttaaacgttttaacgtttttaaccccgtttaagtttttacccccttttaccggggtttacccgtttaaacccgggggtttccgggggtaaacccggggtacgggggttaaaaccggttaagggggtaccgttaaacggtaaaccggtaaaccggtaaaacggggttcggttccgggttaaaccgggcccgttaaccgtaacccgtttaaccccgtttgttacccggtttaacccgtttaccttacccgttacccccg

SEQ ID NO: 64169 - DNA, 669 bp, Homo sapiens
  misc_feature: GYAE6OF01CRQFK.31.78.H01.1.454.CMB.1.raw
  modified_base (235)..(235): a, c, t, g, unknown or other
  misc_feature (235)..(235): n is a, c, g, or t
  modified_base (427)..(427): a, c, t, g, unknown or other
  misc_feature (427)..(427): n is a, c, g, or t
tcagcagtagacgtcacgaccggtgctcgatttagtgtgagtagtttgggtttgggggagctacaacaggcaggcgggggcagcaagatggtgttgcagacccaggtcttcatttctctgttgctctggatctctggtcgccgtacgggacatcgtgatgacgccagtttccagacctccctggctgtgtctcgtgggcagacggccaccatcaatgacagtccagccagagttnttttatcggaccccacaaataacaactacttagcttgtaccagacaagaaagtagacacgcctacctaaactcctagtactttacgtcggtccttaccggtacccggctacgttcccggggtttaccctaaccggtacttcgtaagttcggacgacggtccgggtcgtcggggaccgtactttccacttccncctaaccactccgacgcgacgcctgccgacggcgtagaagtgtggtcgacgttaagtttactacgtcgtacacgtactaacttactttacttacctttcgttttaccgtccgtttacggttaccggggaccgggtaacgggaacgttaagggtacggtaacgtaaacgtaaccgaaacggttaccgttagggtacggtcctccgactacctacttcgttacttcctttccgtcctttccccg

SEQ ID NO: 64170 - DNA, 850 bp, Homo sapiens
  misc_feature: GYAE6OF01DJ0M2.31.78.H01.1.454.CMB.1.raw
  modified_base (441)..(441): a, c, t, g, unknown or other
  misc_feature (441)..(441): n is a, c, g, or t
  modified_base (609)..(609): a, c, t, g, unknown or other
  misc_feature (609)..(609): n is a, c, g, or t
tcagcagtagacgtcacgaccggtgctcgatttagtgtgagtagtttgggttgggggagctacaacaggcaggcaggggcagcaagatggtgttgcagacccaggtcttcatttctctgttgctctggatctctggtgccgtacggggacatcgtgataggacgccgtagtttccacgacctcccgtggctgtcgtctcgtgggcgaggacggccacactcaaactggactaacgtcccaggcctaagtgttttagttttacgttaccgacccccaaactaaataacctaaaacttacgttacgtcgttacggaacccgagaccgtaaaggaaacgtacgggacctaacgtacccctaacttaaacctccgttagtaacgtttaccgtcggtccttacccggtacccggactaccgggttccccgggtacctaaaccgttnttacgtacgttaggcccgtaaggtcccgggttcgtacgggtacccgttaactttccgaccttaccgtaaccacctagtcccgtaagacccgtacgtcccgtagggacgtaacggtacctagggaaaacgtagttccggggtgaacgtttaccgtttaaagtttaccgngttaaccgacgtaactaaacctttaacgtttaacctttacctttttacccgttaccggtttaccgttaccccgggtttccggggaaaccgggtaccggggttaaaccccgttaagggggtaacttaaacccgggaagttaaaacccggtaaaccgggtaaacggttcgtaaccggggacccttacgacccccgttaacctttaggttcccgtttaaccgtttccgttaccccgttaacccg

SEQ ID NO: 64171 - DNA, 750 bp, Homo sapiens
  misc_feature: GYAE6OF01C0YTF.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgacgcctagtttccagacctccctggctgtgtctcgtgggcgaggacgggccaccatcaactgacaacgtccagccagtagttgttttattccgaccccaacaaataacaacttactagtcttacggtaaccagacaagaaacgtaggacacgacctaacctaaactccgtagtacttacgtcgggtaccttccgacccgggctacggttcccggggttaaccctaaccgtacttactagttcgggacgtacggtcggggtacgtacggggaccttaacgtttccaaccttcctaccaacctataccgacgtcgacgtccgtcgacgacggtacgaacgtaaagtagtggtaggtaaccgttaggttttaacttacgttacgtaacgaacggtaactaaacgttaacgttttaacttaccgttttaccgttttaccgtaccgttaccggttttccggggacggaacggggtaaccgtaagggttacggaaacgtaaacgtaaccgtaaaaccgtaacggtttacggcggttaccgtacggtaacccgtaacccgttacttacgttaccggtttccttaacccgttaccccg

SEQ ID NO: 64172 - DNA, 697 bp, Homo sapiens
  misc_feature: GYAE6OF01APMCD.31.78.H01.1.454.CMB.1.raw
  modified_base (677)..(677): a, c, t, g, unknown or other
  misc_feature (677)..(677): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagaggccacatcaactgacaagtccagccagtagtttgttttacttccggaccccaacaataaccaacttacttagcgttaggtaccagacaagaagtaggacacgcctacctaactctatactttacgcgggtccttcgtacccgggctacggttcccgggttacctaaccggtcttacgtagttcggcgtacggtcgggtccgtcgggtaaccgttacgtttaccgacccttccgtacctaaccctacttaccgacgtaccgacggtccgtacggaccgtaacggtaccgttaggaaaggtacggtacggtacggtacgtttaacgttttaacttacgtcgtaccaacgtacctaaacgttaactttaacttacgttttccgtttacgtcgttaaccggtttcgggaacggtacgggtaaccgtagggtacggagtaacgtaccgtaaacggtagtcggttcgcgtacgactaacctnttcgtacgttcttagtcccg

SEQ ID NO: 64173 - DNA, 736 bp, Homo sapiens
  misc_feature: GYAE6OF01EKUJ0.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacgggacatcgtgatgagcctagtttccagacctccctggctgtgtctcgtgggcgaggacgggccaccgatacaactgacaagtccagccagtagttgttttacgttccggaccccaactaataacctaactacttacgtcgttacggtaccagacaagaaagtacggaacacgtaccctacctaaactccgttagtactttacgtcgggtcctttccggtacccgggctacggttacccgggttacctaaccgtatttcgtagttcggaccgtagggccgggttcggtacgggtaccgttactttccactcctacgacctacgtcacggacctacggccgtgaccgtagggtactaggtaaacgtagttcggtacggtactttaacgttttacgttacgttacgtcgtaaacgacttaaacgtttatttaaccgttttcctttaccgtttaccgtaccgtttacgggtttaccgggacgggtaaccgggtaaccgttaagggtacgtacgtaaccttaacggaaaccgttacggttacgggtcgtacgtacgaccctaacttacgttccgtttacttccgttcgttacccg

SEQ ID NO: 64174 - DNA, 797 bp, Homo sapiens
  misc_feature: GYAE6OF01DFI0U.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctgatctctggtgccgtacggggacatcgtgatgacgcctagtttccagacctcctggctgtcgtctcgtgggcgaggacggcccaccatccaactcgactaaacgtcccagccaaggtagtttgtttttaacgttccggaccccctaaccaaaataaacctaaccttaacgttacgtaccgtttacggtaacccaggaccaaaggtaaaacggtacggaaccaccgtacccttaacccttaaaaccgttccgttaacgttaacgttttacggtcggggtaccttttaccggtaccccgggtacgttaccgggtttaccccgggggtttaccctaaaaccccggtatttaccgtaacgtttcggaccgtagggtcccggggtaccgttacggggaacccttacgtttccgaacctcccgtaaccaaccgtacttccgaacgccgtaacgccctcggaccgtaggtccgtaagaacgtgtagggtcggttattaacgtttttaacttaccgtcgttacacgtactaagttaatttaccgtttactttccgttacgttccgttacggttacggacgggtacggaccgtaaggtcggaaagtacgtaacgtaaacgtagttcgggtacggactacggtaccctaacgtacgttccgttcgttcttaccgtacccg

SEQ ID NO: 64175 - DNA, 740 bp, Homo sapiens
  misc_feature: GYAE6OF01DRNH4.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagttccagacctccctggctgtgtctcgtgggcgaggacgggcccaaccagtacaactgacaacgtccagccagtagttgttttacttcggaccccaacaataaccaacttactagtcttacggtaccagacaagaaaggtggaccagtaccctacctaaactccgtagtactttacgtcggtacctttaccgacccgggctaccggttcccggggttaaccctaaccggtacttcgtagttcgggacgtacgggtccggggtcgtacggggaacccgtatttccgaccttcctaccactactcaacgtcaacgtcctgacgacggtctaggaaagtcgttggttcggactttaagttttacttacggttactacgtaacgtaaccttaactaagttttaccttaccttttcccggttttaccgttaccttaaccgggtttccggggtaaccgggtaacggggtaaaccgtaaggggtaacgggtacgtaaaccgtaaccggtaaaacggtacgttcgggtcggtacccgtacgacccgtaacttacgttacgttaccgttccgtcccttaaccg

SEQ ID NO: 64176 - DNA, 651 bp, Homo sapiens
  misc_feature: GYAE6OF01CAWU9.31.78.H01.1.454.CMB.1.raw
  modified_base (398)..(398): a, c, t, g, unknown or other
  misc_feature (398)..(398): n is a, c, g, or t
  modified_base (517)..(517): a, c, t, g, unknown or other
  misc_feature (517)..(517): n is a, c, g, or t
  modified_base (627)..(627): a, c, t, g, unknown or other
  misc_feature (627)..(627): n is a, c, g, or t
  modified_base (635)..(635): a, c, t, g, unknown or other
  misc_feature (635)..(635): n is a, c, g, or t
tcagcagtagacgtcacgaccggtgctcgatttagtgtgagtagtttgggtttgggggagctacaacaggcaggcagggggcagcaagatggtgttgcagacccaggtcttcatttctctgttgctctggatctctggtcgaccgtacggggacatcgtgatgagcctagtttccagacctcccgtggctgtgtctcgtgggcgaggacggcccaaccatccaactcgacaacgtccagccaaggtagtttgttttacgtccggaccccaacaaataaactaacttacttgtcgttagaaccagacgaaagaaagtacggacacgtccttaacctaactcgtagtactttacgcggtccttaccgtaccgggctaaccggttccgggttaccaacgtnttcgtagtcggacgacgggtcgggtcgttacgggaccttacttccactcctaccaaccatcgacgcacgtcctagcgacggtctaaggaagtatcggtagtaccttagtttactccgtntacactactaactatttacttctttcgttactccgttacggttcgacgggtacgacgtaaggtagacgttaagtaccgaaacgttagcggtcgcgtacgaccaaccgttnttaccgtnttaccctcgttaaccg

SEQ ID NO: 64177 - DNA, 636 bp, Homo sapiens
  misc_feature: GYAE6OF01CGICB.31.78.H01.1.454.CMB.1.raw
  modified_base (617)..(617): a, c, t, g, unknown or other
  misc_feature (617)..(617): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagactccctggctgtgtctcgtgggcgaggacggccaccatcaactgcaagtccagccagtagttgttttacttcggaccccaacaaataaccaactacttagcttaggtaccagtacgaagaaagtacggactacgaccctacctaaacctcctagtactttacgtcggtccttccgtacccgggctacggttcccggggttaccaaccgtatcagttcggacgtacggtcggggtctacgggtaccgtacttccgtactcctacctaccgatacacgaccacgtcctgcgaggactagaacgtgtgtagacttaagtttactacgttcgacaacgtactaactattacgttaccttcgtttacctcgttaccgttcgggaacggtacggaaccgtagggtacgaacgtataaccgaaacgtagttcggcgtactcgactactnttactcgttctcgttaccc

SEQ ID NO: 64178 - DNA, 551 bp, Homo sapiens
  misc_feature: GYAE6OF01BDYQJ.31.78.H01.1.454.CMB.1.raw
  modified_base (411)..(411): a, c, t, g, unknown or other
  misc_feature (411)..(411): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcccagtttccagactccctggctgtgtctctgggcgagagggccaccatcaactgcaagtccagccagagtgttttatttggccccacaataacaactacttagcttggtaccagcagaaagtaggacagccctcctaaactcctgatttactggtcttctacccgggcagtcccggggttcctaaccgattcattggcagcgggtctgggacccgatttcgactctcaccatcagcagctgcagctganatgtgctagtttatactgtacagcaacgtattacgtaacttctttacgtctaactttcggacggtacgggaccaagggtcgagacgttacgaaaccgtacgttggcggtcctacgactacccattctcgttcttcgtaac

SEQ ID NO: 64179 - DNA, 749 bp, Homo sapiens
  misc_feature: GYAE6OF01A0DRD.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttctatttctctgttgctctggatctctggtcgccgtacggggacatcgtgatgacgcctagtttccagtacctcccgtggctgtcgtctcgtgggcgaggcggacccaccatcaactgactaacgtccagcctagtagtttgttttacttaccggacccctaactaaataacctaacttacgttagtcgttaggacctagacaagaaggtacgacacgacccttacgtaactcgtagtacttcgtcggtccttaccgaccggctacggtcccgggttacctaaccgtgttccagtcggctacgggtccggtacgtacggggtacccgttatttcccgaaccttccacctaaccgtacgtaccgacgtaccgtaccgtccgtcgggtaccgtacggtactacgggtaacgtcggttacggttaggtacgtttaagttttacgttacgttcgtaccggtacgtaaccttaacgtttaactttaacgtttaccctttcgtttaccgttaaccgttaccggtttaccgggacgggtacgggtaaccgtaagggtacggtaacgtaaccgtaaccggtaaaccggttaggtacggtacggtaccgtacgtacctaccttattccttacgttccttccgttacccg

SEQ ID NO: 64180 - DNA, 739 bp, Homo sapiens
  misc_feature: GYAE6OF01C7BW3.31.78.H01.1.454.CMB.1.raw
  modified_base (139)..(139): a, c, t, g, unknown or other
  misc_feature (139)..(139): n is a, c, g, or t
  modified_base (181)..(181): a, c, t, g, unknown or other
  misc_feature (181)..(181): n is a, c, g, or t
  modified_base (390)..(390): a, c, t, g, unknown or other
  misc_feature (390)..(390): n is a, c, g, or t
  modified_base (703)..(703): a, c, t, g, unknown or other
  misc_feature (703)..(703): n is a, c, g, or t
tcagcagtagacgtcacgaccggtgctcgatttagtgtgagtagtttgggtttggggagctacaacaggcaggcagggcagcaagatggtgttgcagacccaggtcttcatttcctctgttgctctggatctcgtggtnccgtacgggacagtcgtgatgacgcctagttcagtactccgnggtctgtcgtctcgtgggcaggtacgccactatccaagtcgacgaacgtcacgtccaagttgtttcgttttacgccgacccctaataagtaacctacgtattcgtacgttacggaccagtacaaaggtaagtcgacctacttacccgttaacctaaaccgttcgttagttaaccgtttccggtcgggttacccttaccggaaccgggtntttaaccgggttcccgggttaaacctaacgggttcttaacgtcggttacggacgtcggttacccggggttattaccggggtaaactttccgttaacgtaccgtttccgaacctaccgtagttcggaaccgtcgacgtccgtaggtacccgtaggtacgtacgtaagtcgtggttacgtacgtttaatttaccgacgttagtccgaacggtactaacgttagttacttaaccgttttcgtacgtacgttccggtaggtacggtaacgtacggtacgtagaccttagtaacgtaaaccgtggtcgtaaccggttntaacgtccctacggtattccggtctccttagccccg

SEQ ID NO: 64181 - DNA, 733 bp, Homo sapiens
  misc_feature: GYAE6OF01DXUQF.31.78.H01.1.454.CMB.1.raw
  modified_base (324)..(324): a, c, t, g, unknown or other
  misc_feature (324)..(324): n is a, c, g, or t
  modified_base (374)..(374): a, c, t, g, unknown or other
  misc_feature (374)..(374): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagttccagactccctggctgtgtctcgtgggcgaggacgggccaccatcaactgcaagtccagccagtagttgttttacttcggccccaacaataaaccactaacttagcttggtaccagacaagaaagtagacacgcctacctaactctagtatttacgngggtccttccgtacccgggctacggttccccggggttaccctaaccggtnttaccgtaacgtttcggaccgtacgggtccgggggttccgtacgggggtaccccgttaatttccgaaccttccgtacccaaccctagttccgaacggccgtaacggtcccttacgggaccgtacgggtaccgttaggtaaacgtaacggttcgggtacgggtacgtttaagggtttttaactttaccggttcggttaccgtaaggaacccttaacgttatttaaccgtttaacttttcccgttttcgttaccttaccggttttcgggaccgggtaacgggtacccgtaagggtaggaagtactacgaaaacggtactggtcggcttcgacctaccgtacttcttacgttctacgtcccg

SEQ ID NO: 64182 - DNA, 626 bp, Homo sapiens
  misc_feature: GYAE6OF01B71E2.31.78.H01.1.454.CMB.1.raw
  modified_base (240)..(240): a, c, t, g, unknown or other
  misc_feature (240)..(240): n is a, c, g, or t
tcagcagtagacgtcacgaccggtgctcgatttagtgtgagtagtttggggtttggggggagcgtacaacaggcaggcaggggcagcaagatggtgttgcagacccaggtcttcatttctctgttgctctggatctctgggtgccgtacggggacattcgtgatgagtccagtttccagactccctggctgtgtctcgtgggcgagacgggccgacatcaactgacaagtccacgccagngttcgttttacttcggccccaactaataacctaacttacttagtcctttacggaaccagtacaagaaagtaggacagcctacctaaactcctagtactttacgcgggtccttcggtacccgggctacggttcccgggttaccaacgtacgttcagttggcaggtcgggtcgtagggaccgtatttcacttctacactatccagctacgcctagcgaggtctagaacgtagtcgtcggactaagtttactactagtcgtacgactaatacttatactttacttacgtactacgtttcggacggtacggaacgtacgggtaggacgtacaacgtaaacgtatagggtacgcgtagtaccgtaactactacgttcgttcctgttacccg

SEQ ID NO: 64183 - DNA, 756 bp, Homo sapiens
  misc_feature: GYAE6OF01DHT7V.31.78.H01.1.454.CMB.1.raw
  modified_base (403)..(403): a, c, t, g, unknown or other
  misc_feature (403)..(403): n is a, c, g, or t
tcagcagtagacgtcacgaccggtgctcgatttagtgtgagtagtttgggttgggggagctacaacaggcaggcaggggcagcaagatggtgttgcagacccaggtcttcatttctctgttgctctggatctctggtgcctacggggacagtcgtgatgagcctagtttccagacctcccgtggctgtcgtctcgtgggcgagcggccaccatacaactgacaacgtccagccagtagttgttttacgttccggaccccaacctaaataaccaacttacgttacgtcgttacggaccagaccgaaagtaaagtaggaccacgaccctaaccgtaaactccgtagtactttaccgcgggtccttccgtacccggctacggttccccggggttacctaaccggtnttaccgtacgttcggaccagggttcccgggtacgtcggggtaacccttagtttcccaccgttcctaccaacccgtattaccgaagtcccacggtcccgttaggaccggtacggtaccttaagggtaaaacgtggttacggggttacggtacctttaaggtttttactaccgtacggtacctaacggaacttaaactttaatttaccttttaaccgtttcctttccgtaaccgttccggtttcggggaaccggtaacgggaaccttaggggtacgaactaaccgtaacgtaaacggtgttaccgggtgtacccgtagaccccgtaatcgttacgtccttaccgtcgttaccccg

SEQ ID NO: 64184 - DNA, 690 bp, Homo sapiens
  misc_feature: GYAE6OF01DZ1SK.31.78.H01.1.454.CMB.1.raw
  modified_base (371)..(371): a, c, t, g, unknown or other
  misc_feature (371)..(371): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagttccagactccctggctgtgtctctgggcgagacgggccacatcaactgcaagtccagccagtagttgttttatcggcccctacaataacaactacttagcttggtaccagacaagaaagtagacagccctactaaactcctgtactttacgtagggtccttaccgtacccgggctaacgttcccggggttacctaaaacccggtnttaccgagtttcggacgtacgggcccgggtacgtacggggtaacccgttatttccgaacttcccgtacaacccgtaatcccgaaggcccacgtacccgtggacgacggtaccgtaaggtaacgtaagtgggtaccgggtactaagttttacttaaccgttgtacctaagacctaactaatttaacttaccgtttacgtttccgtacgttaccgtttcgggaccgggtacggtaccgtaaagggttagacgtacgtaaccgaaaccgtaagtcggtacgcctagaccctaacccgtatccgtttacgtcttccgtaaccg

SEQ ID NO: 64185 - DNA, 804 bp, Homo sapiens
  misc_feature: GYAE6OF01CD52C.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagtacctccctggctgtgtctcgtgggcgagacgggccacctatcaactgacaacgtccagaccagtagtttagttttacgttccggacccctaaaccgtaataaacctaacttactttaacggcgtttacggtaaccaggtactaaggtaaaacgtaggaaccacggacccttacctaaacctcctagtaactttacgcgggtaccttccgtacccgggtctaacggttcccggggtttaaccctaaccggtattaccgtaacgtttcggaccgtaacgggtccggggttacgtacggggaacccttagtttacccgaacgttcccgttaaccggaccctaagttcccgaaaggtcccgtaacggtccccgttacggaccgtaggggtacgttaacggtaaacggtagttacgggtacgggtaaccgtttaggttttaacttacggttacgtacgaacgtacctaaacgttatttaacctttaaccgtttccgtttacgttaccgttaccggttttacgggacgggtacgggtaaccgtaagggtacggtaaacgtacgtaacgaaacgtagttcggtacggtaccgttagacccgtaacttacgttacttcgttccttaccgttaccccg

SEQ ID NO: 64186 - DNA, 782 bp, Homo sapiens
  misc_feature: GYAE6OF01DZ5JY.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggactagttcgtgatggacgcctagtttccagtacctcccgtggctgtgtctcgtgggcgaggacggccaccatacaacgtgacaacgtccagccgagtagttgttttacttccggaccccctaacaaataaaccaacttacttacgtcttacggtaaccagacaaagaaagtacggacacgtacctacctaaactccgtagtacgtttacggcggtccttaccgacccgggctacggttcccggggttaacctaaccggtattaccgtaggttcggacgtacgggtccgggttcgtacgggtaacccgttactttcccacgttccctacaacccgtagtccgaacgtccgtaaccgtcccgtacggaccgtaacgggtcctaaggtaaacggttaagtacggttaccggttactttaacggttttaaccttaccgtcgttacgtaacgaaccttaacttaatttaccgtttaccttttcgtttaccgttaccgttaccggtttccggggaaccggtaacgggtaaacccggtaagggttacggaacgttaacgtaaaccgtaaaaccggttagtacgggtacgtaccgtccgaaccgtaccgtaacgttcgtaccgttaagttccgttaacccg

SEQ ID NO: 64187 - DNA, 792 bp, Homo sapiens
  misc_feature: GYAE6OF01B0HSA.31.78.H01.1.454.CMB.1.raw
tcagcagtagacgtcacgaccggtgctcgatttagtgtgagtagtttggggtttgggggagctacaacaggcaggcaggggcagcaagatggtgttgcagacccaggtcttcatttctctgttgctctggatctctggtgccgtacggggacatcgtgatgagccagtttccagactccctggctgtgtctcgtgggcgaggagggccaccatcaactgacaagtccagccaagtagttgttttagttccggaccccaacaataacaacttacttagtcttacggtaccagacaagaaagtacggacacgccctacctaaactcctagtatttacgtggtccttcgtccggcccggacgtaccgggttcccggttaacctaaccgtacttactaggtcggacgtacgggtccggttacggtaccgggtaccgtttacttcctaccgttcctaccaacctacgacgacgaccgtaccgccgtagaccggtacgtacgtaaggtaacgtcggttacgggttaccgtagttttaaccgtttacttacgtacgtaaccggtacgtaaacctaaacgttttaacttttaaccgtttacccgtttttaccggttttccctaaccgggttttaccgggttaacccgggggaacggggttaacccgggtaaacgggttaagggtaaacgggtaacgtaaacccggttaaaccgggtaaaaccggttcgggtacgggttacggtacccgccggttaaaccccgactttaccttcccgggtttctttaaccccggttacccg

SEQ ID NO: 64188 - DNA, 788 bp, Homo sapiens
  misc_feature: GYAE6OF01A47OF.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagtctagtttccagactccctggctgtgtctgtgggcgacggaggccaccatcgaactgacaagtccagaccagtagttgttttacgttccggaccccaactaaataaccaacttacgttagtcgttacggtaaccagacaaggtaaaggtacggaacacgtacccttaccgtaaactcccgtagtactttacgtgggtaccttccgtacccgggctaacggttcccgggttacctaaccggtattacgtagttcggctacgggtcggttacgacggggtacctaatttccgaaccttccgtacctaaccgtatacccgagtacctacgccgtacggtacgtacggtacgtaacggtaagtaacttcggggtacggtaacgtttaacggttttaacttacgtcggtaactaacggttaactaaacgttacttttaacctttaccgttttaccgtttacccggttaaccgttaaccggtttaccggggtaaccgggtaacgggttaaaccgtaaggggttaaggaaccggttaaacctaaaccggaaacgggttaacccgttagggtaccgtccggttaacgaccctaaccgttacgttacgtttacccgttacgtttcccgttacccg

SEQ ID NO: 64189 - DNA, 822 bp, Homo sapiens
  misc_feature: GYAE6OF01ESW6J.31.78.H01.1.454.CMB.1.raw
  modified_base (240)..(240): a, c, t, g, unknown or other
  misc_feature (240)..(240): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgattagcctagtttccagacctccctggctgtgtctcgtggggcgaggagggccaccatcaactgacaagtccagccagtagttnttttacttcggaccccaacaataacaactacttagcttagtaccagacaagaaagtaggacacgacctacctaaactcctagtacttttaccgtgggtccttaccgtacccgggctacggttccccgggggtttaccctaaccggtatttccgtaagttcgggacgtacgggtccggggttaccgtacgggggtaacccgtaagttttacccgaaccgtttcctacccgtaaccctacgttaccaacgggtacccgtaacgggtcccttcgggtaccgtaacgggtccggttaagggaaagggttaacgttcggggttacggggtaccgtttaacgggtttttaacgttttaccggttacgttaaccgtacggtaacctaaaccgtttacttttaaaccttttaccgtttttacccttttaccggttacccgtttacccgggttttaccggggggtaaccgggtaacggggtaacccggtacggggttaggtaacgtaaacgtaccgtaaaacggtaccggttaggtacgggtctacggtacctaacccgtagttccgttcgttaccttcgtaccttacccg

SEQ ID NO: 64190 - DNA, 792 bp, Homo sapiens
  misc_feature: GYAE6OF01A7XRQ.31.78.H01.1.454.CMB.1.raw
  modified_base (412)..(412): a, c, t, g, unknown or other
  misc_feature (412)..(412): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagtttccagactcccgtggctgtgtctcgtgggcgaggacgggccaccatccaactgacaacgtccagcctaaggtacgtttgtttttacgttccggacccccaactaaacttaaaccaaaccttaactttacgtctttacgggtaaccaaggtaccaaaggaaaacggttaacggacaacggtccccttaacctaaaacctcccgttagtacttttaacgtgggtaccctttaccgtaccccggggntaccggttccccgggggtttacctaaaccgtattcgtaagttcggcgaggtccgggtacgtcgggaacccgttatttccgaccttcctaccaacctagttccaacgtaccgacgtcccgtaggccgaacgggtctaaggaaaggtagttcggtacggtacgttaagtttttaacgtaccgttaggtacctaacgtacctaaacttacgtttaactttaccgtttttccgtttaccggttacctttaaccggtttccggggacggggaacgggtaaccgtagggttacgggataaccgttaacggaaaaccgttacgttagggtcggtaccgttaccggacctaaccgttacgttacgtacgtttccttacgttaaccccg

SEQ ID NO: 64191 - DNA, 819 bp, Homo sapiens
  misc_feature: GYAE6OF01A2M10.31.78.H01.1.454.CMB.1.raw
  modified_base (498)..(498): a, c, t, g, unknown or other
  misc_feature (498)..(498): n is a, c, g, or t
tcagcagtagacgtcacgaccggtgctcgatttagtgtgagtagtttgggtttgggggagctacaacaggcaggcaggggcagcaagatggtgttgcagacccaggtcttcattctctgttgctctggatctctggtgccgtacggggacatcgtgatgagccagtttccagtacctccctggctgtgtcctcgtgggcgagcggccaccatcaactgacaagtcccagccagagtttcgttttattcggaccccaacaataacaactacttacgcttacggtaccagactaaggaaacgtacggacacgtaccctaaccgtaaactcctagtaactttacggtcgggttaccttccggtaccccgggtcgtaacggtttaccccgggggtttacccctaaccggtatttccgtaggtttcggccggtaaggtcccgggggttacgttacgggggtaaccccgtaattttcccgaaccttccgttaccgaacccgttntacccgtacgacccgtacggtaccccggtggtacccgtagggtaccgttaaaggaacggttaccggttacggttcgggtaacccgtttaaggtttttaaccttaccggtagttacctaaggaaccgtttaaacttactttttaacgttaaccgtttttcccgtttaccggttaccgtttaccgggtttaccggggtacgggtaaccggggtaacgttaaggggtacggtaacgaacgttaaccgaaaaccgggttagtacgggtccggtacccgtacgtacccgtaaccgttagttccctcgttcccgttaactacccccg

SEQ ID NO: 64192 - DNA, 757 bp, Homo sapiens
  misc_feature: GYAE6OF01D5J21.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggttcttctatttctctgttgctctggatctcgtggtcgtccgtacggggacagtcgtagatggacgccgttagtttaccagtacctccgtggtcttggtgtcgtcggtgggacgacggacggacccaccgatacctaacgtacgacctaacgtccacgtccgtagttaggtttgttttacgtcccgacccctaactaaataacctaacttacgttacgtccgttacggtaccagaacgaaaggtaagtacgaccaccgtaccctaaccgttaactccgttagtaacgtttacggtcgggttcccttacccggtacccggtactaccgggtttacccgggtaccctaaccgtattacgtagtcggacgtacggtcggtacggtcggaccgttacttacactacctaccgtacacgtacgacgactaccgtcgtacgacgacggtacgtaacggacgttaggtcggtaggttactttaagttacgtcgtacacgtacgaacttactagttttccttaccgtttacttccggtaccgtttaccgggttcggaaccggtaagggtaaccgtagggttacgacgttaaaccgtacggaacgttagtcggtccgaccgttacacccgtacgtactttaccgttactcccttcgtcccg

SEQ ID NO: 64193 - DNA, 709 bp, Homo sapiens
  misc_feature: GYAE6OF01EZO1M.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctcgtgggcgagacgggccaccatcaactgacaagtccagccagtagttgttttattcggcccccaactaaataacaactacttagcttaggacagcaagaaagtaggacacgaccctactaaacctcctagtactttacgtcgggcttccgtacccgggtctacggttcccgggttacccaaccggtatttccagtttggcctaagggccgggttcgtacggggacccgttatttccgaacctccgttaccacctatccgaacgccgtacgccctaggccgtaagggtccctaggaaaggtagttcggtacggtaccgttaagttttactttaagtcgtaaccaacgtacctaaactatttaacttaaccgtttccgtttaccgttacgttaccgtttaccgggacgggtaacgggaacccgtaaggggtacggtaacgtaaccgttaaccgtaaaacggtacgttacggtcggtaccgttacgaccgtaccgtaattcccttacgttacctcttacccg

SEQ ID NO: 64194 - DNA, 706 bp, Homo sapiens
  misc_feature: GYAE6OF01DDMNN.31.78.H01.1.454.CMB.1.raw
  modified_base (694)..(694): a, c, t, g, unknown or other
  misc_feature (694)..(694): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgacgcctagtttccagtactccctggctgtgtctcgtgggcgagacgggccaccatccaacgtgacagtccagccaggtagtttgtttttattccggacccctaacctaaataaacctaacttaacttagtccttacggtaaccaagaccaaaggaaaaggtacggacgtacgtaccccttaaccgttaaacctccgttagtaccttttaccgcgggtacctttccgtacccggggctaccggttacccggggtttacccaaacggtacttacgacgtttcggcgacggggtcggttaccgtcggggtaaccgttctttaccgacttcctaccgaacctataccgagtacacgcctagaccgtaggacttaggaagtagtaggttacgaccgttaatttacgttacctagttaccacgaactaacttagtttaaccttacgtttccgtttcgttacctacgtttccgggacgggtacggtaccgaagggtacgagtaacaacgtaaacgagtacgcggactagacctactagttntgttcctcgtcc

SEQ ID NO: 64195 - DNA, 655 bp, Homo sapiens
  misc_feature: GYAE6OF01CYEG2.31.78.H01.1.454.CMB.1.raw
  modified_base (286)..(286): a, c, t, g, unknown or other
  misc_feature (286)..(286): n is a, c, g, or t
  modified_base (349)..(349): a, c, t, g, unknown or other
  misc_feature (349)..(349): n is a, c, g, or t
  modified_base (435)..(435): a, c, t, g, unknown or other
  misc_feature (435)..(435): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagttccagacctcctggctgtgtctcgtgggcgaggacgggccaccgatacaactgacaagtccagccagtagttgttttattcggccccaacaataacactattacgctttacggaccanacaagaaaggtagacacgcctacctaaactcctagtaactttcgacgggtcttacgacccggntacggttccggggttaccctaacgtattcagttcggactagggtccgggtcgtacggggacctacgtttctacgtctacgaacctntaccaggtcacgtcccgtgaccgtaggctaggaacgtagtacggtcggtacttaggttttactacgtcggtacacgactaaactatttaactacgttttcctttacggtactacggtttacgggaccggtaggaaccgtaagggtcgaagttacaacgaaacggtagtacggttcggcctaaggacctacttacgtgttacccgttacgtccttaaccgg

SEQ ID NO: 64196 - DNA, 749 bp, Homo sapiens
  misc_feature: GYAE6OF01BV10O.31.78.H01.1.454.CMB.1.raw
tcagcagtagacgtcacgaccggtgctcgatttagtgtgagtagtttgggtttgggggagctacaacaggcaggcaggggcagcaagatggtgtgcagacccaggtcttcatttctctgttgctctggatctcgtggtcgccgtacggggacattcggtagataggacgcctagtttccagacctccgtggtctgtcgtctcggtgggcgaggacggccacactacactcgacaacgtccacgcctaggtagttttcgttttacgtccggacccaaacgtaacttaaccaacttacttacgtcgttacgacagacgaacgaaggtacgacacgtacccttaaccgtaactccgttagttacgtttacgtcgggtacctttacccggacccgggtacgttacccgggttaccccgggtttaacctaaccgttacttaccgtacggttcggacgtacgggtacgggtcgtacggtacgttacttccacgttaccacacacgtacgacgtcgtaccgtcgtacgcgtacggtactaaggtaacgtgtacgtagggtacctttaaggtttacgttaggttccgaataacgttacgttaaacttatttacctttaacgttttccgttaccgtacggtttaccgggttacgggaaccggggttacggaaacggttgggacggtaactaaccggtaaaggtactagggtcggtacgccttacggacctacgtcttattcgttaccgttcctaccgg

SEQ ID NO: 64197 - DNA, 906 bp, Homo sapiens
  misc_feature: GYAE6OF01D4EF2.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacgggacatcgtgatgacgcctagtttccagtacctcccgtggtctgtcgtctcgtgggcgaggcggacccacataccaacgtgactaacgtccagcctaagtcgtttagtttttacgttccggaccccctaactaaactaaacctaaccttacgttacgtaccgttacggtaaccaaggaccgtaaaggtaaacggtaacggaacctacgtaccccttaacccttaaaaccgttcccgttaaggttaaccgttttaccggtaccgggttaccgtttacccgggtaaccccgggttaccttacccgggtttaccccggggtttaaccctaaaccggttactttacgtacgttcgggaccggtacggggttacccggggtaccggtacggggtaacccttaacttttcccgaaccgtttaccctacccgtaaccgtacttacccgaccggtaccgtaccggtacccgtcggaaccggtacgggtaccgtaagggtaaacgtcggtttgggtaaccggttacgttttaacgttttacgttaccgtacgtacccgtaacgtaacctttaaagtttaacgttttaaccgtttaaccctttttcgttaacccgggtttaccgtttaacggggtttacccgggaacgggttaaccgggtaacggttaaagggtcggttaacgtaacccgtaaaccggtaaacggttacgtcggttacgacgtacccgtaacgtaacccttgtaccgtttcgttccgttccgttaacccg

SEQ ID NO: 64198 - DNA, 804 bp, Homo sapiens
  misc_feature: GYAE6OF01B5QRU.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtcgccgtacggggacatcgtgatgagcctagtttccagtacctcccgtggctgtgtctcggtcgggacgagggacggaccaccgtataccaaacgtcgaacgtaaccgtaccgacggtaccgaaggttacgttttaggtttttacgttacccggaccccctaaactaaactaaacctaaccttaacgttacgtacgttacggtaaccagacgaaaggtaaacgtacggacacgtacccttaaccgtaactccgttagtactttacggtcggtccttaccggacccggtacgtaccggttacccgggttaaccctaaccgttacttacgtaggttcggactacggggtcgggtacgtacgggtaacttacttccaccgttctaccactactcgaaccgcgaccgtcgtcggacgtacgtacgtaggaaacgtgtacggtcgtacgttacgttttaactacggttacgtacgtaaccgtaactaaacgttacgtttaacctttacggtttaccgttcgttaaccggttcggtttaccgggacggggtacggtaaccggtaagggtaggtacgtaaaccgtaacggtaaaccggttaacggcggttcggtaaccgttaccgaaccgttaaccgtagtttacccgtaccggtttctaaccgtttaccccgg

SEQ ID NO: 64199 - DNA, 846 bp, Homo sapiens
  misc_feature: GYAE6OF01BTI45.31.78.H01.1.454.CMB.1.raw
  modified_base (415)..(415): a, c, t, g, unknown or other
  misc_feature (415)..(415): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagtttccagacctcccgtggctgtgtctcgtgggacgaggacggccaccatacaactgacaaagtccagccaagtagttagttttagttcggaccccctaaacaaaataaaacctaaaccttacgttaacgtctttaacgggaaacccaaggtacgaaacggtaaaaggttaacggacctaaccgtacccttaacccctaaaacttcccgtagtaacttttacggcgggtacctttacgaacccccgggtntaaaccgggttccccggggtttaaccctaaaccggtattccgtaagtttcgggaccgtaacgggtcccgggggttactacgggggtaacccttaagttttaccaacctactacccaaactactaacgacgtaccacgtacctcgacgacggtaacgtacggaaagtagttacggtacgtacgttaagttttaactaacttacggtaacctaacggaactaaacttaacgttaactttacctttacccgtttacgtaccgttaaccggttttacgggaaccgggtaacgggtaaaacccggtaaaggggttaaccgggtaaaacgtaaaccgttaaacccgtaaaaaaggttaacccgggttaggtaacggtaccgtacccgtaaccgtaaaccctacgttaaccgtttcggttaacccttacgttaacccg

SEQ ID NO: 64200 - DNA, 630 bp, Homo sapiens
  misc_feature: GYAE6OF01EI6QV.31.78.H01.1.454.CMB.1.raw
  modified_base (410)..(410): a, c, t, g, unknown or other
  misc_feature (410)..(410): n is a, c, g, or t
  modified_base (440)..(440): a, c, t, g, unknown or other
  misc_feature (440)..(440): n is a, c, g, or t
  modified_base (452)..(452): a, c, t, g, unknown or other
  misc_feature (452)..(452): n is a, c, g, or t
tcagcagtagacgtcacgaccggtgctcgatttagtgtgagtagtttggggtttgggggagctacaacaggcaggcagggggcagcaagatggtgttgcagacccaggtcttcattttctctgttgctctggatctctggtgccgtacggggacatcgtgatgagcctagtttccagacctccctggctgtgtctcgtgggcgaggacgggccaccatacaactcgacctaacgtccagccaggtagtttcggtttttacttccggacccccaaacaaactaaactaaccttacttacgtcttacggtaccagacaaaggaaagtacggacacgtacctacctaaacctcctagtactttacgtcgggtacttccggtaccgggctacggttcccgggttacctaacgtntctagtcggcaggtcggtcgtcgggacctnttcactcacacntcagcacgcctgcacggtctagaagtgtggtgtacttagtttactcgtgtcacgtactatacttactctttcgtctacgttcgttcgggacggaacggtacgtaagggtgaacgtacgtaccgaaacgttggtcgtcgtaccgtcgaccctactacgttagtcttacctcgtaacccg

SEQ ID NO: 64201 - DNA, 890 bp, Homo sapiens
  misc_feature: GYAE6OF01DK9L5.31.78.H01.1.454.CMB.1.raw
  modified_base (807)..(807): a, c, t, g, unknown or other
  misc_feature (807)..(807): n is a, c, g, or t
tcagcagtagacgtcacgaccggtgctcgatttagtgtgagtagtttgggttgggggagctacaacaggcaggcaggggcagcaagatggtgttgcagacccaggtcttcatttctctgttgctctggatctctggtcgccgtacggggactagttcggtgatggacgtccgtaacgtttccagtacctcccgtggtctgtcgtctcgtgggacgaaggcggcccacatcgaactgacgaacgtccagtcctaaggtacgtttacgtttttacgttcccggaaccccctaaaacctaaaacttaaaccctaaaaccgtttacgttaacgtcgttttaccggggtaaacccctaggaacctaaagggtaaaaacggtaacggaaccgtaaccggttacccccgtaaacccctttaaaaccgtcccgttacggtaacttttttaaacccgggccgggttaccgtttaccccggtaaccccggggtaccttaaccgggtttacccccgggggggttttaacccctaaaaccccgggtacttttaaccggaacggtttaccgggtaccggaccggggttcccgggggttacgttaccgggggaccccgttaaacttttccggaaccttacccggtaacctaccgtaactcggtaaccggccgtaaccgtcccgtacggtaccgtacggtcgtaaggtaacgacgttgggtaccgtagttaacgtttagttactcgtaccgagtactaacttaacgtttcttaccgtttactttccggtacttaccggttacggacgggtagggtaacccgnggtaaggtacgaaacttaccggaaagtaccggtggtcggtctaccgacctaccgttaatcgtaccggttcctcgttaaccccg

SEQ ID NO: 64202 - DNA, 946 bp, Homo sapiens
  misc_feature: GYAE6OF01ARZIH.31.78.H01.1.454.CMB.1.raw
  modified_base (412)..(412): a, c, t, g, unknown or other
  misc_feature (412)..(412): n is a, c, g, or t
tcagcagtagacgtcacgaccggtgctcgatttagtgtgagtagtttgggtttggggagctacaacaggcaggcaggggcagcaagatggtgttgcagacccaggtcttcatttctctgttgctctggatctctggtcgccgtacggggacagtcgtgatgagcctagtttccagacctcccgtggctgtgtctcgtgggcgaggacgggccaccatcaacgtgacaagtccagccagtagttgttttacttccggacccctaacaaactaaaccaaccttacgttaagtccgtttacggtaacccaggaccaaaggtaaaacggtacgggaaccaacgtaccccttaaccgttaaaaccttccgttaggtaactttttaccggcgggtaccctttccggtaaccccgggtntaccgggtttccccggggtttaacctaaaccggtactttcgaacgtttcgggaccgtaaggggtcccggggttccgtacgggggaacccctttagttttacccgaccgtttaccttacccgtaaacccgtacttaccggaacgggtcccgtaaacggtccccgtagggaccccgtaacggggtacccgttaaacgggaaacggttaacgttcggggtttaccggtaaccggttttaaacggttttttaacttacccggttacggtaccgtaaacggtacccttaaaacgttaacgttttaccgtttaaccgttttcccgttttaccggttaccgtttacccgggtttaccggggaccggggtaaaccgggtaacccggttaacggggtaccggggtaaaattaaacccggtttaaaccggaaaaacccgggttacccgggttacgggttaacccgggttaccgttaccggttaaccccgtaaacccggttcgtttacccgtttaaccggtttcccgtttaaacccggtccccgg

SEQ ID NO: 64203 - DNA, 891 bp, Homo sapiens
  misc_feature: GYAE6OF01DBWT6.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagtagttgttttattcggccccaccaaataacaactaacttagcttaggtaccagacaagaaagtaggacagccctacctaaacctcctagtactttacgtggtcctttaccgtacccgggactacggttcccggggttacccctaaaccggtactttacgtaagtttcgggaccgtaacgggtcccggggttacgttacgggggtaacccgttaagttttcctaacccgttccttacccaaccctaagttacccgaacggccgtaacggtccccgttaggacccgtaacgggtacccgttaagggaaacggtaacgtttcgggtacggggttaaccctttaaggttttttaaaccgtttaaccgttggttaacccgtaaacggtaacccttaaaaacgtttaacgttttttaaaccttttaaccgtttttttacccggtttttaacccggtttacccgttttaaccgggtttttacccggggggaaccgggggttaaccgggggtaaacccggttaaaagggggttacggggaaaaccgttaacggtaaaacccggtaaaaaccgggtaaccgtttcggggtaaccgggtacccgttacggaacccgtaaccccgttaacgtttcccgtttaacgggtttcccttttacccgttaacccccgg

SEQ ID NO: 64204 - DNA, 751 bp, Homo sapiens
  misc_feature: GYAE6OF01A5UK7.31.78.H01.1.454.CMB.1.raw
  modified_base (338)..(338): a, c, t, g, unknown or other
  misc_feature (338)..(338): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagacctccctggctgtgtctcgtgggcgagacggccaccatcaactgacaacgtccagccagtagttgtttttacgttcggaccccaacaactaaactaacttacttagtcttacggtaccagcaagaagtaggacagccctacctaaactcctagtactttacgnggtccttccgtacccgggctacggttccccggggttacctaaccgtacttaccgtacgttcggacgtacgggccggggttcgtacggggtacccgttacgttttccaacccgttcctaccgtaccctataccgaacgtaccgtacgtccctggtaccgacgggtacgtaaggaaacgttagttacgggtacggttacgtttaacgttttaacggtttaaccgttacggttaccgtaaacggtaccttaaacttacgtttaactttacccttttaccgtttccgttacccgttaaccggtttccgggacggggtaaccgggtaaccgtaagggttacggagtaaaccgtaacgaaaccggttaggtacggtcgacgtacgaccctaacgtacttcgttcgttccgttcctaccg

SEQ ID NO: 64205 - DNA, 834 bp, Homo sapiens
  misc_feature: GYAE6OF01CMP5O.31.78.H01.1.454.CMB.1.raw
  modified_base (347)..(347): a, c, t, g, unknown or other
  misc_feature (347)..(347): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagactccctggctgtcgtctcgtgggcgaggacgggcccaaccagtacaactgacaacgtccagccagtagtttgtttttacgtcggacccctaactaaataacaacttacttacgcttacggtaccagacaaggaaagtacggacacgcctacctaaacctctatacgtttacncggtcctttaccgacccgggtctacggttaccccggggttacctaaccggtactttacacggtttcggaccgtaacgggtccggggttacgttcgggggtaaccccgttaacttttccgaacccttaccgtcccgtaaaccccgtaccgttcgaacccgggtcgtaaccggtcccgtacggaccggtacgggtaccgttaaggtaaaggtcggtttacgggtacgggttaccgttaaggtttttaaccgtttaccgtaggttaccgtaaacggtaaccctaaacgtttacttttaaccgtttaacctttttcccgttttaacccggttacctttaacccgggttttaccgggggaaccgggtaccggggttaaacccgtaaggggtttacggaaacgtaacgtaacggtaaaaccggtaccggttagggttacccggacgtacgtaacccgtaccttaacggttcttcccgttacgttccctacccg

SEQ ID NO: 64206 - DNA, 766 bp, Homo sapiens
  misc_feature: GYAE6OF01BESFO.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgacgcctagttccagacctcccgtggctgtgtctcgtgggcgaggacggccacatacaactcgacaacgtccacgccaggtacgtttagttttacgttccggacccccaactaaactaacctaacctaacttacgtaccttacggtaaccagaacaaaggaaaggtacggaccacgtaccctaacctaaaccttcctagtacttttacgtcggtaccttaccgtacccggctaccggttccgggttaccctaacgtcttacgtagttcgcgacgggtcgggtccgtacggggtacctacgtttccaccttccaccgtacctagtaccgcgtaccgtacgtccctgaccgtaacggtcgtaagaacgtagtcggtaggactttagtttaacttacgtcgtaacacgtaactaacgttaactttacctttaccttttccgtttaccgtacgtttaccggttaccggggaccggggtaacggtaaccggttaagggtacggtaacgtaaacccgtaaacggtaaaacggttacgttacgggttacgtacccgtaacgggtaacccctacttacgggtttccttacgtttacccgttccgttaacccccgg

SEQ ID NO: 64207 - DNA, 719 bp, Homo sapiens
  misc_feature: GYAE6OF01ATKKE.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacaactacttagcttggtaccagcagaaagtaggacagcctcctaaactcctgatttactgggcttcgtacccgggctacgttcccggggttacctaaccggatttccgagtttcggcacggtccggggttcgtcggggaaccccgtattttccaacgttcctcctaacccgattccaacgggtcctaacggcccgttggaccgtaacggggtccttaggaaacggtagttgggttacgggaccttaagggtttttaacttaaccgttggttaccgtaaggtacctaaaccgtattttaacttaacccgttttccgttttacccgttccgttaaccgtttttccggggaccgggtaacggggtaccctaaaggggttacggaaggtaacgttaaccgaaaacggtaacttgggttacggccttacggaccctaacccgtattaccgttacgttccgtttcgtaaccg

SEQ ID NO: 64208 - DNA, 771 bp, Homo sapiens
  misc_feature: GYAE6OF01ATMBD.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtcgccgtacggggacatcgtgatgacgcctagtttccagtacctcccgtggctgtgtctcgtgggcgagcgggccacatcaactgacaagtccagccagtgttgtttacgtccgaccccaactaataactaaccttagttagcgttacggtaccagtacaagtaaagtacgacacgtcccttaacctaacgtccgtagttactttacgtcgggtcctttaccggacccgggcgtacgggttaccccggggttacctaaaccggtgttaccgtacgttcggacgtacggtccgggttccgtacgggtaacccgtactttaccgacccttccgtacctaaccgtagtaccgtacgtaccctacggtaccccgttggaccgtacgggtcgtaaggaaaccgtaggttcgggtacgtaacggttttaagtttaacgttaccgtgtaaccaacgtacctaaacgtttactttactttaaccgttttccgttaccgtaccggtttccggtttaaccgggacgggttaacggtaaccggtaagggtacgaacgtaaccgtttaaacggaaaccggttacggtcggttggaccccgttagccccgttaacgtacttcgttaaccgttcgttacccgttaccg

SEQ ID NO: 64209 - DNA, 700 bp, Homo sapiens
  misc_feature: GYAE6OF01DBTQ5.31.78.H01.1.454.CMB.1.raw
  modified_base (339)..(339): a, c, t, g, unknown or other
  misc_feature (339)..(339): n is a, c, g, or t
  modified_base (366)..(366): a, c, t, g, unknown or other
  misc_feature (366)..(366): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgaggacgggccaccatcaactcgacaacgtccagccagagttgttttatcggccccacaataacaactacttagcttgtaccagacagaaagtaggacagcctacctaaactctagtatttacgcggtccttcgtacccgggntacgttcccggggttacctaaaccgtnttctagttcggacgtaggtccgggttcgtacggggaccgttaacttccgtaaccttcctacgaacctaagtccgaacgtcaacggtcccttaggccgaagggtccttaacggaagtaagttcgggtacgggtacttaaaggtttttaacttacgtcggttaacaacggtacctaaacgttaactttaccttaacgttttcctttaccgttacgtacccggttttcggggaacgggtacgggtaaccgtaagggtacggaagtacgtaacgtaaaacggtagttggtacggtaccttcggacctaccgttaattccgtacgttcttaccgtaccg

SEQ ID NO: 64210 - DNA, 567 bp, Homo sapiens
  misc_feature: GYAE6OF01EX0YA.31.78.H01.1.454.CMB.1.raw
  modified_base (544)..(544): a, c, t, g, unknown or other
  misc_feature (544)..(544): n is a, c, g, or t
  modified_base (562)..(562): a, c, t, g, unknown or other
  misc_feature (562)..(562): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactcctggctgtgtctctgggcgagagggccaccatcaactgacaagtccagccagagttgtttattcggccccaacaataacaactacttagcttaggtaccagcaaggaaagttaggacagtcctactaaacctctagtattactgggccttcacccgggctacgtcccggggttacctaaccggtattcgattcggcaggtcgggtctacgggaccgtattccactcgtcaccatcagcatccgtgctaggctagaagtatgtggtactagtttattacgtagttacatactaactatttactacttctttcgtcttacgtttcggacggaggtaccaagggtgagtactaacgaacgtaatggtcgcngactaccattctcgtctntaccg

SEQ ID NO: 64211 - DNA, 823 bp, Homo sapiens
  misc_feature: GYAE6OF01EMWYH.31.78.H01.1.454.CMB.1.raw
  modified_base (416)..(416): a, c, t, g, unknown or other
  misc_feature (416)..(416): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctcgtggtcgaccgtacgggacagtcgtgatgacgcctacgttccagcctccgtggtctgtcgtctcggtggcgaggacggccacatacaacgtgactaacgccacgaccgtaggtagttttcgttttacgttcccggacccctaaactaaactaacctaacttactacgttcgttacggtaccaagacgaaaggaaaggtacgactacgtacctacctaacctcgttagtacttacgtcggtaccttccggaccggtctaccggttcccggttaccaacggttntacgtacgtcgcgtacgggtcggttacgtacgggtaccttacttccgtactcctaccactacgtacgacgaccgtacgccgtagaccggtacggtacgtaaacggaaggtacggttcgggtacggttaacgttttacggtttacttaccgttacggttaaccgaacgttaaaccttaacgtttaacgttttaccgttttaccgtttcccggtttaccgttaacccggtttaaccggggtttacggggaaccggggttaaccgggtttaaacccgggtaaagggtaccggaaacgttaaaccggtaaaccgttaaaccggggttagttccgggtaaacggtccggtaaccttaaccccgggtactttacggttaccgtttccgtttacccgtacccgtttaaccccgg

SEQ ID NO: 64212 - DNA, 797 bp, Homo sapiens
  misc_feature: GYAE6OF01C7LVU.31.78.H01.1.454.CMB.1.raw
  modified_base (368)..(368): a, c, t, g, unknown or other
  misc_feature (368)..(368): n is a, c, g, or t
  modified_base (411)..(411): a, c, t, g, unknown or other
  misc_feature (411)..(411): n is a, c, g, or t
tcagcagtagacgtcacgaccggtgctcgatttagtgtgagtagtttgggtttgggggagctacaacaggcaggcaggggtcagcaagatgggtgttgcagtaccaggtcttcatttctctgttgctctaggatctctggtgccgtacggggactactcgtgatgacgcctagttccagactcctggctgtgtctcgtgggcgaggcggccaccatacaacgtcgacgaagtccagaccgaggtagttacgtttttacttccggacccctaaccaaataaacctaacttaacctttagcgtttacggtacccagacctaaggaaagtacggactacgtaccttaccgtaaactccgtagtacttacgnggtccttacgaccgggactacggttaccgggtacctaaacgtnttacgtaacgttggaccgtacggtccgggtacgtacgggaaccgttatttaccaactccgttaccaaccgtactacgaacgcgaacgtcccgtgaccgtaggtactaggtaacgtaagttacggtcggtaacgttaacgttttaacgttaccgtcggttaccaacggtaacctaaacgttacttttaaacttacccgttttaccgtttaccggtccgtttaaccgtttacgggggaaccgggttaccgggtaaaccggttaacggggttaacggacggttaacgtaaaccggtaaaacggttaacggttcgggttaacggtaaccgtagaaacccggttaaccctaaacgtttcggttaaccttccggtttaaccgttaaccccgg

SEQ ID NO: 64213 - DNA, 873 bp, Homo sapiens
  misc_feature: GYAE6OF01EPR9W.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagactcccgtggctgtgtctcgtgggcgaggacggccaccatcaactgcaagtccagccagagttgtttattcggaccccacaataacaactacttagcttggtaccagacaagaagtaggacagtccctacctaaactcctagtactttacgtgggtccttccgtacccgggctacgttcccggggttacctaaccggtattaccgagttcggacgtaggtccgggtaccgtacggggtaacccgttagtttaccgaccttcctaccgtaaccctagttacccgaacggtaccctaaccggtcccttacgggaccgtaacgggtacccgtaggaaacggtacgttacgggttaccggtacgtttaaacggttttttactttaaccgtttacggttaaccgtaacgggtaacccgttaaaacctttaacgttttaaaccgttttaacccgttttttacccgtttttaacccgggttacccgttttaacccgggtttttacccggggggaaccggggttaaaccggggtaaaccccggttaaaagggggtttaaccggggtaaacggttaaaccgttaaacccgggtaaaaacccggttaaccgggtttacggggttaacgggttacccgttacggtaacccccgttaaacccgttaacgtttacccggtttacggtttacccctttaacccgttaaccccgg

SEQ ID NO: 64214 - DNA, 846 bp, Homo sapiens
  misc_feature: GYAE6OF01CBR76.31.78.H01.1.454.CMB.1.raw
tcagcagtagacgtcacgaccggtgctcgatttagtgtgagtagtttgggtttgggggagctacaacaggcaggtaggggcagcaagatggtgttgcagacccaggtcttcatttctctgttgctctggatctctggtgccgtacggggacatcgtgatgagcctagtttccacgactccgtggctgtgtctgtgggcgaggacggccaccagtacaactcgactaacgtccagaccgaagtagtttacgttttttaacgttccggaccccctaacctaaaacttaaccgtaaacctttaactttaacggtaccgttttacggtaacccacggaaccgtaaaaggaaaacggttacggaaccgtaccggtaccccttaaccctaaaaccttcccgtaggtttaacttttaccgtcgggtacctttacccggtaacccgggaccttaacggttccccggggtttaacccttaacggtactttaccgtaggtttaccggacggtacggggttacccggggtttacggaccgggttaacccggtttattttccccaacccgtttcttaaccccgaaacctaccggttacccgaacgacccgtaaccggtacccgttcggaccggtaacggtacgtaacgggtaaacgtacgttagggtaccgtaggtttaacgtttacgttacgtacgttacgaacgtactaacgttacttttacgttaaccttttcgtttacgttacgttccggttacgggtacgtacgggacgtagggtacggtaagtacgtaacgtaaacggtcgtaggtacgtgtaccgactaacgtccgttctacgtccttcgtccttaccccg

SEQ ID NO: 64215 - DNA, 522 bp, Homo sapiens
  misc_feature: GYAE6OF01B3A9E.31.78.H01.1.454.CMB.1.raw
  modified_base (313)..(313): a, c, t, g, unknown or other
  misc_feature (313)..(313): n is a, c, g, or t
  modified_base (424)..(424): a, c, t, g, unknown or other
  misc_feature (424)..(424): n is a, c, g, or t
  modified_base (445)..(445): a, c, t, g, unknown or other
  misc_feature (445)..(445): n is a, c, g, or t
  modified_base (498)..(498): a, c, t, g, unknown or other
  misc_feature (498)..(498): n is a, c, g, or t
  modified_base (513)..(513): a, c, t, g, unknown or other
  misc_feature (513)..(513): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctcgtgggcgagagggccaccatcaactgcaagtccagccagagtgttttattggccccacaataacaactacttagcttggtaccagtcaagaagtaggacagcctcctaactcctgatttacnggcttctaccggcatccgggtcctaaccgatcattgcagcgggtctgggccgatttcgactctcacatcacgcagcctgcaggctgaagatgtggctagtttatacgtgtnagctaactattattacctttntttccgtcgtactttcggacggtaggtaccaagggtgagatacaaacgatggngtctgctaccatctntcttcgtac

SEQ ID NO: 64216 - DNA, 625 bp, Homo sapiens
  misc_feature: GYAE6OF01DQ3HW.31.78.H01.1.454.CMB.1.raw
  modified_base (464)..(464): a, c, t, g, unknown or other
  misc_feature (464)..(464): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactcctggctgtgtctctgggcgagagggccaccatcaactgcaagtccagccagagttgttttattcggccccacaaataaacaactacttagcttggtaccagcaagaaagtaggaacacgcctacctaaaactcctagtatttacgtgggtcctttcgtaccccgggctaacgtccccgggggtttaccctaaaccggtattcagttggccaaggcggggtactcggggaacgtactttcgaactctccaacctaatccaagtcaacgtccctgaccaggactggaaanaagtgtcggactagttttaattactgtcaagctaacgtaatttataactttctttcgtctaacgtttcggacgggtagggaacccgaaaggtcggtagaataccgtaaaaacgaaattcgtaggcctaggactaaccctaatccgttagtccttcgtaaac

SEQ ID NO: 64217 - DNA, 804 bp, Homo sapiens
  misc_feature: GYAE6OF01BZ2DY.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgaggacgggccaccatccaactgcaagtccagccagtagttgttttacttcggccccaacaataaacaacttacttagccttacggaaccagtcgaaggaaagtaggaaccacgcccttacctaaactcctagtactttacggtgggtacttccgtaacccgggctaacgttcccggggtttaccctaaaccgtcttaccgaagtttcggacgtacggtccggggttcctacggggtaacccgtaattttccgaaccttctaccgaaccctattaccgacgtactacggtaccctcggaccgaaggtccttaagggaaacgtcgttacggtacggtaccttaaacggtttttacgttaacgtttacggtacctaaacggtaaccttaaaaccttacgttttaaactttacccgtttttaccgttttaccggtaccgttttaaccggttttacccgggggaccgggttaacggggtaaccccggtaaaggggttacgggtaaaccggtaaccgttaaaccggtaaaaccggttaaccggttacgggtaccgggtacctaccggtaccctaacccgttacgttacgttccgttaccgtttacccgtaccg

SEQ ID NO: 64218 - DNA, 826 bp, Homo sapiens
  misc_feature: GYAE6OF01C3CM1.31.78.H01.1.454.CMB.1.raw
  modified_base (197)..(197): a, c, t, g, unknown or other
  misc_feature (197)..(197): n is a, c, g, or t
tcagcagtagacgtcacgaccggtgctcgatttagtgtgagtagtttgggttgggggagctacaacaggcaggcaggggcagcaagatggtgttgcagacccaggtcttcatttctctgttgctctggatctctggtcgccgtacgggacatcgtgatgacgcctagtttccagtcctcccgtggctgtgtcgtcgngggcgagcggccaccatcaactgactaacgtccagacctaggtagtttagttttacgttccggacccccaaacctaaataaacctaacttacgttacgtaccgtttacgggtaacccaggaccgaaaggtaaaacggtacgggaacctaccgtaccccttaacccgtaaaccgtacccttaggttaactttaaccggtcggggttaccctttaccccggtaaccccggggtaccttacccgggtttacccccgggggttaacccttaaaccggttaacttaccgttaacggtttcgggaccgtacggggtaccggggttcgttaccggggtaacccttacggtttaccacccgttacctacccaacgtacgtaccgacgtaccgtaccgtcccgtaggaccgtacggtactaggtatcggtacggtgtacgtttaaggtttacctacggtctacggtactaccttaaacgttagttttaccttacccgttttaccgtttacgttaccgtttaccgggttaccgggtaacgggaacggtaccggttaagggacgtaaacggtactaaaccggtaacgtaaggtggtacgtcgtacgaccgtacttccgtaatttccgacttcgtaccccg

SEQ ID NO: 64219 - DNA, 698 bp, Homo sapiens
  misc_feature: GYAE6OF01A4ZCY.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagacctcccgtggctgtgtctcgtgggcgaggacggccaccatcaactgacaagtccagccagtagttgtttaccaccccaacaaataacaactacttagcttaggaccagacaagaaagtaggacacgccctacctaaactcctagtactttacgcgggtcttccgtacccggctacggtcccgggttaccaaccgtattcagtcggacaggtccgggtcgtcgggaacctacttccacttcaccacatcacgcacgcctgacgaggtactaggaagtacgtggtacggtacgttaagttttaacttaccgtgtacgaacgtaacctaaacttatttacttaccgtttacgtttaccgtaccgtttaaccgggttttaccggggaaccggggtaaccgggtaaccggttaaggggacggtaacgtaacctaaaccgggtaaaccgtacgggttagggtacggtcgttaccggacccgtaaccttaccgtttacgttacgtttcccgttaccttaccgttcccccg

SEQ ID NO: 64220 - DNA, 688 bp, Homo sapiens
  misc_feature: GYAE6OF01EI2ST.31.78.H01.1.454.CMB.1.raw
  modified_base (480)..(480): a, c, t, g, unknown or other
  misc_feature (480)..(480): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagacgggccaccatcaactgacaacgtccagccaagtagttgtttttacttcggacccccaacaaataacaactacttagtcttacggtaccagcaagaaagtaggacagtccctacctaaactcctagtactttacgtgggtcttccgtaccgggtctacggttcccgggttaccctaaccgattacgagttcggcctagggccgggttcgtacgggaccttactttaccacgttcctaccaaccactcacggcgacgtcctcggacgaggtctagtaaagngttgggtacggtacttagtttacgttacgtgtacagtacctaactattacttacctttcgtttacgtccgttacgtttcgggaccgggtaacgggtaaccgtaagggtaggtaacgtaacgtaaccgaaaacggtacggttaggtcggtaccggtaccgaacccgttaacccgtacttacgtttaccggtttcttacccgttaacccg

SEQ ID NO: 64221 - DNA, 734 bp, Homo sapiens
  misc_feature: GYAE6OF01D2WXB.31.78.H01.1.454.CMB.1.raw
  modified_base (393)..(393): a, c, t, g, unknown or other
  misc_feature (393)..(393): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctcgtggtcgccgtacggggacagtcgtgatgacgcctagttccagtacctcccgtggctgtgtctcgtgggcgaggacggaccacgatacaacgtcgacaacgtccacgccaggtgtttagttttacgtccggaccccaaacgtaaactaaactaacttacgttacgacgtttacgaaccagaacgaaggtaaacgtacgaccacgtaccctaacctaacgtcgtagtacttacggtccggtcctttaccgggacccggtntaccgggtttacccgggttaaccctaaccgttcttacgtaacgttcggacgtacgggtcgggttacggtacgggtacccttagtttccacgtcctaccactactacgacgtccacgtccgtacgcgaggtacgtaggaagttcgtggtacgtacgtttaagtttactcgtacgtactaacgtaactaactttagttaccttactttccgttacgtaccgttacgggtttaccggacgggtacggtaacggtaggtacgacgtaaagtaacccggtaaacggtacgttcggtaccgtacgtacgaccctacgtacttacgtttccgttcctacgttaccccg

SEQ ID NO: 64222 - DNA, 734 bp, Homo sapiens
  misc_feature: GYAE6OF01BPNJH.31.78.H01.1.454.CMB.1.raw
  modified_base (397)..(397): a, c, t, g, unknown or other
  misc_feature (397)..(397): n is a, c, g, or t
  modified_base (570)..(570): a, c, t, g, unknown or other
  misc_feature (570)..(570): n is a, c, g, or t
tcagcagtagacgtcacgaccggtgctcgatttagtgtgagtagtttgggtttgggggagctacaacaggcaggcgaggggcagcaagatggtgttgcagacccaggtcttcatttctctgttgctctggatctctggtcgccgtacgggactagtcgtgagtgacgtcctagtttccgacgacctcccgtggtctggtcgtcgtcgtgggcgaggacggccacatacgaacgtcgacgtaacgtccacgaccgtaggtgtttacgttttacgttccggacccctaaactaaactaaacctaacgttaacttacgtcgttacggaccgagacgaaagaaagtacggactacgtaccctacgtaactcgtagtacttacgcggtccttacgaccggtntaccggtccgggttacctaacgtatacgtagtcggacgacgggtcggtacgtacgggtacctagtttccacgtacctcctaactactaccgagtaccgtaccgtccgaggtaccgacggacgttaggaaacgtcggttaggtacggtactttaagtttactaacgtcgttaanaacgttaactaacgttacttaagttcccttttacggttccgttaacgtcggtttaccggggacggtaaccggtacgtaagggtaacgtataaacggtaacgtaaacggtacgtgggttcacgtacccgactaccgttactaccggtttctgttaccgttacccg

SEQ ID NO: 64223 - DNA, 663 bp, Homo sapiens
  misc_feature: GYAE6OF01DRMAC.31.78.H01.1.454.CMB.1.raw
  modified_base (123)..(123): a, c, t, g, unknown or other
  misc_feature (123)..(123): n is a, c, g, or t
  modified_base (385)..(385): a, c, t, g, unknown or other
  misc_feature (385)..(385): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttnctctggatctctggtgccgtacggggacatcgtgatgagcctagtttccagacctccctggctgtgtctcgtgggcgaggacggcccaccatcaactggcaacgtccagccagtagttgttttactcggccccaacaataacaactacttacgtcttacggtaccagtacaaggaaacgtaggacacgtcctaacctaaactctaggtactttacgtgggtccttcgacccgggctacgtaccggggttcccctaaacggtnttctagttcggactacgggtccgggttcgtacggggacccgttaacgtttcctaccgtctaccctaacctagttcccaagccaacggtccctggaccgtagggtacctagaactaggtgtcggtataagtttatcgtgtacagactaaattacttaactttcgtttacctttcggtacttacggtttccggacgggtaccgggtacgtaaagggtggataacgaccgtaaaacggagttggtcggactgaccctacgtatcccttagtcctcctaccg

SEQ ID NO: 64224 - DNA, 775 bp, Homo sapiens
  misc_feature: GYAE6OF01ALWU5.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtcgccgtacggggacatcgtgatgacgcctagtttccagtacctcccgtggctgtcgtctcgtgggcgaggacggccactataccaacgtcgacaacgtccacgcctaaggtacgtttgttttacgtccgaccccaactaactaactaactacttagtccgttacggtaccaacgacgaaggtaaacggtacgacgaccgtacccttaacccgtaaccttccgtagtacgtttacggtcggtaccttccggtaacccgggcgtaaccggttccccgggttaacctaaccgttattccgtacggttcggacgtacgggtcggttccgtacgggtacccgttatttcctaaccgttccgtaccctaccgacttaccgacgtaccgtaccgtaccgtcggaccgtacggtacgtagtaacggtacgttcgggtacgttagttaacgttttacgttaccgtcgtaactacggttaacctaaactttacttaacgttttacctttcgtttacccgttaccgttaccgggttccgggtaacgggaacggttaccggtaggaggtacgtaacgtaacgtaaacgtacggttacgacggtctacgacccgtacttacgttaccgttacttacccgttacctacccg

SEQ ID NO: 64225 - DNA, 853 bp, Homo sapiens
  misc_feature: GYAE6OF01BZCC2.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgacgcctagtttccagtactccctggctgtgtctgtgggcgaggacggccacatcactgacacgtccagccaagtgtttgttttagtccggaccccaactaaactaacctaaacgttacgttaacgtccgttacggtaacccaagacgtaaggtaaaggtaggaccacggtcccttaacccgtaaaccgtccgttacgttacgttttacggtcgggtacccttaccggtacccgggtacgtaccgggtttaccccgggggtttaaccctaaaccgttacgtttaccgtacggttcggtacgacgggtccggggttaccgttacggggtacccgttaacttttaccgtacccttccgtaccctaacctacgtacgtacgtaccgaaccgtctacggaccgtacgggtacctaacgggtaacgtacgttacgggtacggttaccgtttaacggtttttaacgttaccgttacggttaacgtaacggtaaccttaaaccgtttaacttttaaccgtttacccgtttttaccggttttaccgttaccggtttaccggttttccgggggaacgggttaacggggtaccggtaagggttacggacgtaaacgtaaccgtaaacggttacggttacgggtaccgttcgtaacgtacccgtaccgttacgttacctttcgggtttaccttccgttaccccgg

SEQ ID NO: 64226 - DNA, 583 bp, Homo sapiens
  misc_feature: GYAE6OF01BZES7.31.78.H01.1.454.CMB.1.raw
  modified_base (445)..(445): a, c, t, g, unknown or other
  misc_feature (445)..(445): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagttgttttacttcggccccaacaataacaactacttagcttggtaccagacaagaaagtaggacagcctacctaaactcctagtactttacgtgggtccttccgtacccgggctacgttcccggggttacctaaaccgtacttctagttcggcacgggtcggggttcgtacggggaccgtatttccacctctaccacctatcagcacgcctgcgngcagaagatgtggactagtttacttacgtgtacagtacaatattaacttactttcgttcgttactacgtttcggacggtaggacgtaggtggacgtataacgaacgatggtcggactcgacacctatctctctctacc

SEQ ID NO: 64227 - DNA, 780 bp, Homo sapiens
  misc_feature: GYAE6OF01C1CXP.31.78.H01.1.454.CMB.1.raw
tcagcagtagacgtcacgaccggtgctcgatttagtgtgagtagtttgggtttgggggagctacaacaggcaggcaggggcagcaagatggtgttgcagaccaggtcttcatttctctgttgctctggatctcgtggtgaccgtacggggacagtcgtgatgacgcctagtttccagtacctcccgtggctgtcgtctcgtggcgagacggccacatcaactgcaacgtaccagccaaggtagtttacgtttttacgttccggaccccctaacctaaaaagttaaacctaacctttaacgttaccgtacgtttaacggtaaacccgaagtaaccgaaaggaaaacgtacggacctacgtaccctaacccgttaaacctccgtagtacgttttaaccgcgggtacctttaccggaccccggtagtaacccggtttccccgggttacctaaccggtaactttcgaacgtttcgggacctacgggttccggggtccgttacggggaaccttaacttttccaaccttcgtaccaacccgtattaccgacgtaccgacgctcggacgacgtactagtaagagttcggtgtacgttaagttttatacgtcgtaccgaagtactaacttacgtttaacttaccgtttccgtttacgtccgttacgtttaccggacgggaacggtaccgtaagggtacggaacgtaacgtaaaccgtaaacggtaaccgtggtacggacgttacccacgtaaccttaacgttccttaacgttccgttacggtaacccc

SEQ ID NO: 64228 - DNA, 782 bp, Homo sapiens
  misc_feature: GYAE6OF01ANBC1.31.78.H01.1.454.CMB.1.raw
  modified_base (638)..(638): a, c, t, g, unknown or other
  misc_feature (638)..(638): n is a, c, g, or t
tcagcagtagacgtcacgaccggtgctcgatttagtgtgagtagtttggggtttgggggagctacaacaggcaggcaggggcagcaagatggtgttgcagacccaggtcttcatttctctgttgctcgtggatctcgtggtcgccgtacggggacatcggtgatggacgtcctagtttccacgtacctcccgtggtctgtcgtctcggtgggcgaggacggcccaccacgtacaacgtcgaccgtaacgtccacgaccgtaaggttagtttcggttttacgttcccggaccccctaaacctaaactaaccgtaaaccttacgttaacgtaccgtttacgggtaacccaggtaccgaaaggtaaacggtacggaaccgtaccgtacccttaacccgttaaacctccgttaagttaccgttttacggcggtacccttcccggtaacccgggtacctaccgggtttccccgggttaacctaaaccgttcttacgtacggttcggaccgtacgggtcccggggtacgtacgggtaaccttactttaccgacctttccgactaccactacgacgactacgtccgtacggacgcgtacgtagtaacggattacgggtacgtaccgtttagtttacgtaccgtanacctacgtactaacttactttaccttaccgtttcttacgtacgttacggttacgggacggtacggacgtagggtacgactaacgtaacgaacgttaggtggtacgtctaccgtactaccgttatcggttacttcgtactccccg

SEQ ID NO: 64229 - DNA, 763 bp, Homo sapiens
  misc_feature: GYAE6OF01CIS98.31.78.H01.1.454.CMB.1.raw
  modified_base (131)..(131): a, c, t, g, unknown or other
  misc_feature (131)..(131): n is a, c, g, or t
  modified_base (154)..(154): a, c, t, g, unknown or other
  misc_feature (154)..(154): n is a, c, g, or t
  modified_base (479)..(479): a, c, t, g, unknown or other
  misc_feature (479)..(479): n is a, c, g, or t
tcagcagtagacgtcacgaccggtgctcgatttagtgtgagtagtttgggtttgggggagctacaacaggcaggcaggggcagcaagatggtgttgcacgacccaggtcttcatttctctgttgctctggntctcgtggtcgccgtacgggacngtcgtgagtcgacgtcctagtttccaacggtcctccccgtgggccttggtcgttccgtcggtacggggccggaaggacgggcccaacctatccaaacgtcggactaacggtccacgtaccaggttagtttagttttacgtccggacccctaaacgtaataacctaactattacgcgttagaaccagacgtaaggaaagcgtacacgtccctaactaacgttctagtactttacggcggtccttaccgtacccgggtactaccggtttacccgggtacctaccggtattcgtaacgtggccgaggtcgggtaccgtgggtaacctntttaccgacttcccgtactaacctcgttaacgaccggtctcgtccgcgtaccgagtacgtaggtaacgtggtacggtacggttactaaggttttactcgtacgttacgaacgtaacttaaaccttaggtttactttaacccgtttacggtttaccttaccggttaccgggttttaccggggaccgggtaaggtaaccggtaacgggtaacgtacgtaacgtaaccggtaacgttaggtaccggtaggtccgtacacgtacctagttcttcgttacctcttaccg

SEQ ID NO: 64230 - DNA, 757 bp, Homo sapiens
  misc_feature: GYAE6OF01B68V2.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcattttctctgttgctctggatctctggtgccgtacggggacatcgtgatgagccagtttccagactccctggctgtgtctcgtgggcgaggacgggccaccatacaactgacaacgtccagccaggtagtttagttttacgttccggaccccaacaataactaactacttagtacgttcggtaaccagtacaaggaaagtacgacacgccctacctaactcctagtacttacgcggtctacgtacccggctacgtccgggttacctacgattcagttgcgacgtcgggtctacgggacctattcaacttctaccgactagtcacgtcgacgtcctggacgtacggtacgtaggaaagtcgtcggtacggttacttaacggttttacttaccgtagtaccgaacgtaacgtaaactttacttttaaccgtttaaccgtttttccgtttaccggttaccgtttaaccgggttttccggggaccgggttaaggggtaacccggttaaaggggttcgggaaaaccgttaaaacgttaaacccggtaaaaacccgggttaggttaccggggttacggtcccgttaaacccgaaccgttaaccccgggttaactttacccggtttccgttacctttacccggttaacccccg

SEQ ID NO: 64231 - DNA, 718 bp, Homo sapiens
  misc_feature: GYAE6OF01DZFJO.31.78.H01.1.454.CMB.1.raw
  modified_base (333)..(333): a, c, t, g, unknown or other
  misc_feature (333)..(333): n is a, c, g, or t
  modified_base (388)..(388): a, c, t, g, unknown or other
  misc_feature (388)..(388): n is a, c, g, or t
  modified_base (583)..(583): a, c, t, g, unknown or other
  misc_feature (583)..(583): n is a, c, g, or t
tcagcagtagacgtcacgaccggtgctcgatttagtgtgagtagtttgggtttggggagctacaacaggcaggcagggcagcaagatggtgttgcagacccaggtcttcatttctctgttgctctggatctctggtcgcctacgggacatcgtgatgagcctagtttccagacctcccgtggctgtgtctcgtgggcgagacggccaccatcaactgacaagtccagccagtattgttttactcgaccccacaataacaactactagcttaggtaccagactaagaagtacggacacgtaccctacctaaaacgtccttagtaacttttacgngggtcctttaccgtaccccgggtataccggttcccggggttacctaaaaccggtntttacgagtttcggctacggtccggggtcgtacgggacctatttaccacttcctactaacccgattcccgaagccgtacgtcccttaggaccgtaggtacttaacggaaaggtagttaaggtcgggtacgtttaacgttttacgttacgttcggttacaggtaacctaaacttaactttactttaacccgttttntttacccgttcttaaaccggtttccgggtaacggtacgggtaaccgtaacggggttagaagtaactaacggaaacgttagtacggtagcttaacggaccttaacccggttatcgttacgttcgttcttaaccccg

SEQ ID NO: 64232 - DNA, 742 bp, Homo sapiens
  misc_feature: GYAE6OF01B600H.31.78.H01.1.454.CMB.1.raw
  modified_base (730)..(730): a, c, t, g, unknown or other
  misc_feature (730)..(730): n is a, c, g, or t
  modified_base (737)..(737): a, c, t, g, unknown or other
  misc_feature (737)..(737): n is a, c, g, or t
tcagcagtagacgtcacgaccggtgctcgatttagtgtgagtagtttgggtttggggagctacaacaggcaggcagggcagcaagatggtgttgcagacccaggtcttcatttctctgttgctctggatctctggtgccgtacggggacagtcgtgatgagccaagtttccagactccctggctgtgtctcgtacgggcgaggacggccaaccgatcaaacgtgacctaaggtcccagtaccgaggtacgtttagtttttaacgtttccggaccccaaccgtaaaagttaaaccgtaaaaccttaccgtttaaggcccgtttttaggggtaaccccaggtaccgtaaaggaaaacggttacgggaaaccacggtaccccttaacccgtaaaacgttccccttaggtaactttaaccggtgggcccttttaccgtaacccggggctaaccgttccgggggttacctaaccggtaactttaccgtatttacggcgaacggtccgggtactacgggaacccgttagtttacccacggttcgtacccaccggtaactcacgaccgacgtccgacggccgaggacgttcgaaagtagtggtcgtagttagttactaacgtgactagacaacgtacttacgtactttacgtttacgtccgtaacgtttcgggacgtacggaaccgtaggtagaccgtataaccgaactacgtagtcgcgtagcgtaaccagttacngtacttntaccg

SEQ ID NO: 64233 - DNA, 740 bp, Homo sapiens
  misc_feature: GYAE6OF01B758V.31.78.H01.1.454.CMB.1.raw
  modified_base (516)..(516): a, c, t, g, unknown or other
  misc_feature (516)..(516): n is a, c, g, or t
  modified_base (544)..(544): a, c, t, g, unknown or other
  misc_feature (544)..(544): n is a, c, g, or t
  modified_base (576)..(576): a, c, t, g, unknown or other
  misc_feature (576)..(576): n is a, c, g, or t
tcagcagtagacgtcacgaccggtgctcgatttagtgtgagtagtttgggttgggggagctacaacaggcaggcaggggcagcaagatggtgttgcagacccaggtcttcatttctcttgttgctctaggatctcgtggtcgccgtacggggacagtcgtgatggacgcctacgttccagtacctcccgtggcgtgtcgtctcggtcgggacgaggacggccaaccatacaactggacaacgtccagcctaggtacgtttcgttttacgtaccggaacccctaactaaaataaccctaacgttacttaggtcttacggtaaccgagaaccgtaaggaaagtcggaaccgtacaccccttaacctaaactccgttacgtacgtttacgtccgggttaccttaccggacccgggactacggtccccgggtttaacctacgttacttacgtacgttcggactaggggtccgggacgttaccgggaccctttagttccaaccgttacctaccgaaccctnaccgacgtcacgtccgtagacgtacgtnaacgagtagtgtacgtacgttagttagttacncgtacactacgtaaattcgttaaccttaccgtttcgttaccggttaccttaacgggtttcggaacgggaaccgggagttaagggtcggtaacgtaacgtaacggtaaccgtagttcgacgggttcaccgttacaaccttacgtacttacgttctccgtaacccg

SEQ ID NO: 64234 - DNA, 652 bp, Homo sapiens
  misc_feature: GYAE6OF01A2POG.31.78.H01.1.454.CMB.1.raw
  modified_base (389)..(389): a, c, t, g, unknown or other
  misc_feature (389)..(389): n is a, c, g, or t
tcagcagtagacgtcacgaccggtgctcgatttagtgtgagtagtttgggtttgggggagctacaacaggcaggcaggggcagcaaagatggtgttgcagacccaggtcttcatttctctgttgctctggatctctggtgcctacggggacatcgtgatgagccagtttccagacctccctggctgtgtctcgtgggcgaggacggccaccatcaactgccaagtccagccagtacgttgtttttacttcggacccccaactaataacctaaacttaacgttagcttacggtaaccagacaagaaagtaggacacgtccctacctaactcctagtattactgggtccttccgacccgggtcacggttcccggggttacctaaaccggtnttcgattcggacgaggtcggggtcgtagggtacctactttctactcctcctacctatccagccagccgtagccgaggtcctaggaagtagtggtacggtacttaaggttttacttaacgtgtacctacggactaactatttacttacctttctttacgtccgttaacggtttcgggaccggtagggaccgtagggtaggacgtagtaaccgaaacgtagttggcggtcgtacgacctactacgttactcgttccttgtacccg

SEQ ID NO: 64235 - DNA, 632 bp, Homo sapiens
  misc_feature: GYAE6OF01B0XI6.31.78.H01.1.454.CMB.1.raw
  modified_base (235)..(235): a, c, t, g, unknown or other
  misc_feature (235)..(235): n is a, c, g, or t
  modified_base (413)..(413): a, c, t, g, unknown or other
  misc_feature (413)..(413): n is a, c, g, or t
  modified_base (613)..(613): a, c, t, g, unknown or other
  misc_feature (613)..(613): n is a, c, g, or t
  modified_base (626)..(626): a, c, t, g, unknown or other
  misc_feature (626)..(626): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctgggtgccgtacggggacatcgtgatgagccagtttccagactccctggctgtgtctcgtgggcgaggacgggccaccatcaactgacaagtccagccagngttgttttattcggaccccaacaataactaactacttagcttaggtaccagacaaggaaagtacgacacgcctactaactcctagtactttacgtcgggtccttccgtacccgggctacggttcccggggttacctaaccgtacttctacgttcggcgaggtcgggtctcgggacctnttccacttcaccaccataccacgcacggtcctgacgtacggtctaaggaaacgtgtacggtggtacttaagttttagccttgacgtacgactaacgttattacttaccgtttcgtttccgtaccgttacgttccggggaggtaccggaacgtagggtcgaacgtactacgaaacgtgtcgggtcgtcgacgccgtaactntcgttcgtccttntacccg

SEQ ID NO: 64236 - DNA, 745 bp, Homo sapiens
  misc_feature: GYAE6OF01CIYI0.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagactccctggctgtgtctcgtgggcgaggacggccaccatcaactcgacaagtccagccagtagttgttttattcggcccaaccaataacaactactagtcttaggtaccagacaagaaagtagacagccctacctaaactcctagtactttacgcggtcttaccgacccgggctacgttcccggggttacctaaccgtattcgagtttcggctacgggtcgggtcgtacggggtaacccgttatttaccgaaccttcctaccaacccgtattccgaacgccgtaacgcccgttacggaccgtagggtcctaaggaacggtagttcgggtacgggtactttaacggtttttacgtaactacggtactaacgtactaaacgttactttaaccgtttacctttacgtttttaccgtaccgtttaccggtttacccggggacggggtaaccgggtaaccgttaagggtaacggaggtaaccgttaaaccgaaaccggttaacggttcgggtacggaccgtaccggtaccctaaaccggttactttaccggtcctttacccgttaccttaacccccg

SEQ ID NO: 64237 - DNA, 726 bp, Homo sapiens
  misc_feature: GYAE6OF01C2O7A.31.78.H01.1.454.CMB.1.raw
  modified_base (324)..(324): a, c, t, g, unknown or other
  misc_feature (324)..(324): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagttcagactccctggctgtgtctcgtgggcgagagggccaccatcaactgcaagtccagccagtagttgttttacttcggccccaacaataactaactacttagcgttaggtaccagcaagaaagtagacacgacctacctaaactctagtactttacgngggtcttcgtacccgggctacggttccgggttacctaaaccggtattctaagttggcctacgggcgggtacgttgggaacccgtatttccgacctctaccgaaccatccgagtccgacgcctacgcgtaggtactaggtaagtacgttggtacgggtactttaaggttttaacgttacctggttaccaaggacctaaacgttatttaaaccttacgttttcccgttttcgttaccgttaaccggttttccgggaccgggggtaacgggtaacccggttaaaggggtacgggaaaccgttaaggtaacccgtaaaacggtaccggtttagggtcgggacccgttaacgggtaccctaaacccgtttacgtttccggttacccgttccgtttccgttaaccccg

SEQ ID NO: 64238 - DNA, 752 bp, Homo sapiens
  misc_feature: GYAE6OF01EP81K.31.78.H01.1.454.CMB.1.raw
  modified_base (516)..(516): a, c, t, g, unknown or other
  misc_feature (516)..(516): n is a, c, g, or t
tcagcagtagacgtcacgaccggtgctcgatttagtgtgagtagtttgggtttgggggagctacaacaggcaggcaggggcagcaagatggtgttgcacgacccaggtcttcatttctctgttgctctggatctctggtcgccgtacggggacagtcgtgatgacgcctagttccagacctccgtggctgtcgtctcgtgggcgaggcggccacatacacgtgactaacgtccacgccaaggtagtttcgtttttactaccggacccctaaacaaactaaaccgaaacttaccgttacgtcgttacggtaccagacgaaggaaacggtacggacacgtacccttaactaacctcgtacgttacgtttaccgtcgggttaccttacccggtaaccggcttaccgggttacccgggtttacccgtaaaccgtattaccgtaggttcggaccgtagggtcccgggtacgttaccggggaccttacgttcctaccgttccacctaacgtgaccacgtacncgtaccgtacgacgaggtacacgtaagtcggtacgtacgttagtacgtttaacgtgtacgtacgaactaacctaattactttacgtttaccttcgttaaccgttacgttccgggttaacggtccggtaacgggtaaccggtacgggtacgtacgtaaactaacgggtaaacgttggacgggttcctaccgacggtaaccctacgtacgttaccttcggttaccctcgttaaccccg

SEQ ID NO: 64239 - DNA, 727 bp, Homo sapiens
  misc_feature: GYAE6OF01DUPAD.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctgggtgcctacggggacatcgtgatgacgccagtttccagacctccctggctgtgtctcgtgggcgaggacgggccaccatcaactgcaacgtccagccagtagttgtttttacgttcggaccccacctaaactaaccaactacgttagtacgttcggtaaccacgacgaagaaaggtagacacgtcctacctaacctctagtatttacgtcggtcttccggtaccgggctacgtccgggttacctaaccgtactctagttcggcgtaggtcgggtcgtacgggtaccgttagtttcctacgtctaccacctacgtacgacgtcacgtcccgtagacgacggtacgtaggaaacggtagtacggtacggtaccgttaagttttaccttacgttacgtacgtaagtaacctaagttaactttaacgtttaccctttacgttttaccgtaaccgttaccggttttacccggggacgggtaccgggtaacggtaaagggttagaacgtaaacgtacggaaaaccgttaagggttcggtagggtacccgtacgtacctaacccgttacttacgtttaccgttccttccgttaacccg

SEQ ID NO: 64240 - DNA, 686 bp, Homo sapiens
  misc_feature: GYAE6OF01BORBP.31.78.H01.1.454.CMB.1.raw
  modified_base (387)..(387): a, c, t, g, unknown or other
  misc_feature (387)..(387): n is a, c, g, or t
  modified_base (675)..(675): a, c, t, g, unknown or other
  misc_feature (675)..(675): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgtgctctaggtatctcgtggtgccgtacgggacagtcgtagagtgagccagtttccagactcctggctgtgtctcgtgggcgagacgggccaaccgtataccgaacgtcgaccgaacgtccagccagtagttgttttacttcggccccaactaagtaacaactaacttaagtcttacggaccagacgaaggtaaaaggtcggacacggtccctaacctaaacgttccgtaagtacttttacggcgggtaccttaccggtacccggggnttaaccggtcccgggtttaccctaaaccggtacttcgtaacgttggaccgtaacgggtcgggtactcggggacctagtttccgacgtcctacgaacctgtacacgccgtacgaccttcgacgtaacgtcgagaacgtagtcgtcggtacttacggtttaattaccgtacgtaacgtacgacgttaaactaacgtttattacgtttccgttacgtcgttacggttcgacggtaggaccgtaggcgtaagacgttaacgaacgtacgtgacgtcgacgactactactcgnttcgtctaccg

SEQ ID NO: 64241 - DNA, 531 bp, Homo sapiens
  misc_feature: GYAE6OF01D9ML5.31.78.H01.1.454.CMB.1.raw
  modified_base (492)..(492): a, c, t, g, unknown or other
  misc_feature (492)..(492): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagtgttttattggccccacaataacaactacttagcttggtaccagcaagaaagtaggacagcctacctaaactcctagactttacgtgggccttcgtacccgggcacgtccgggttacctaaccgattcattggcagcgggtctgggacctattcactctcacatcagcagcctgcaggctagaagatgtggactagtttactactgtcagcaactattatactttcttcgtctactttcgggcggaggacctaaggtgganatacgaaacgtagtgtggctgactacatctcgtctctac

SEQ ID NO: 64242 - DNA, 705 bp, Homo sapiens
  misc_feature: GYAE6OF01BS1BT.31.78.H01.1.454.CMB.1.raw
  modified_base (415)..(416): a, c, t, g, unknown or other
  misc_feature (415)..(416): n is a, c, g, or t
  modified_base (420)..(420): a, c, t, g, unknown or other
  misc_feature (420)..(420): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagacctcctggctgtgtctcgtgggcgaggagggccacatcaactgacaacgtccagccaagtagttgttttattcggaccccaacaataacaactactagtctagtaccagcaataaagagacacgcctacctaaactctgtatttacgtggtccttcgtaccggctacgttcccgggttacctaaaccgtacttcgtagttggcgtacggccggtcgtcgggaccgtatttccactctcacnncacncacgccgtgcgacggtacgtagtaagtacgtggtacggtacgttagttttaacttacgttacgtcaacgtaacctaacgtaagttttaacctttaccgttttaccgttttaccgtttaaccgtaccggtttttaccgggggaaccgggttaacgggggtaaaccgtaacggggttaacggtacggaaaccgtttaaccggaaaaaccggttacgttaacggggtccgttaccggtaccgtaccgttaaccctagttaccgttccgtttaccgtttaccctacccg

SEQ ID NO: 64243 - DNA, 668 bp, Homo sapiens
  misc_feature: GYAE6OF01A248X.31.78.H01.1.454.CMB.1.raw
  modified_base (346)..(346): a, c, t, g, unknown or other
  misc_feature (346)..(346): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgacgccagtttccagactcctggctgtgtctcgtgggcgagagggccaccgatcgaactgacaagtccagccaggtagttgttttacgttcggacccctaactaataacctaactacttagcttaggtaccagcaagaaagtggacagccctacaactcctgtatttcgtggtcttccgtacccggnacggttcccgggtacctaaccgtattcagttggcagggtccggtcgtagggaccgtatttaccgtaccttctaccgacctaagtcctagccaggtcctcggtacgacggcttaggaacgtagttcggtgtacgttagttttaacttaccgtagtaccgtagacctaaagtattaactttacctttacttacgttacctacggttttacgggacgggtacgggaaccgtaaggggtacggtaacgtactaaaccgaaaccggtagttacgggtaggtacctacgaaccggtactacgttacgttcgttaccttccgtaacccg

SEQ ID NO: 64244 - DNA, 743 bp, Homo sapiens
  misc_feature: GYAE6OF01AUY16.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagtttccagacctccctggctgtgtctcgtgggcgaggacgggccaccatcaactgacaagtccacgccagtagttgttttacttcggaccccaaccaataacaactacttacgtcttggtaccagacaagaaagtaggacacgtaccctacctaaacctcctacgtactttacggtcgggtccttaccgtacccgggtctaccggttccccggggttaccctaaccgtacttcgtacgttcggacgtacggtcggggtcggtacgggtaccgtacttccacgttccctacctaacctacgtccacggactacggtccctggaccgacgggtctaggaaagtcgtggtacgggactttaagttttagttccgtacgttaccgacgtaacctaacgtaatttttaacctaccgttttacccgtttaccgtttacctttaaccggtttccgggggtaaccggtaggggttaccccggtaagggtagggtaacgtaaccttaaccggtaaaacgtacggttacgggttacggtccgtacggacctaaccgtacgtttccttcgttcccgtttaccgtacccg

SEQ ID NO: 64245 - DNA, 724 bp, Homo sapiens
  misc_feature: GYAE6OF01ELA2C.31.78.H01.1.454.CMB.1.raw
  modified_base (392)..(392): a, c, t, g, unknown or other
  misc_feature (392)..(392): n is a, c, g, or t
  modified_base (422)..(422): a, c, t, g, unknown or other
  misc_feature (422)..(422): n is a, c, g, or t
tcagcagtagacgtccacgaccggtgctcgatttagtgtgagtagtttgggtttgggggatctacaacaggcaggcaggggcagcaagatggtgttgcagacccaggtcttcatttctctgttgctctggatctctggtgccgtacggggacatcgtgatgacgcctagtttccagtacctcccgtggctgtgtctcgtgggcgaggacggccaccatccaactgacaagtccagccagtagtttgttttacttcggacccccaactaaataacctaacttacttagtccgttacggtaaccagacaaaggtaaaggtacggacacgtacccttaacctaaaccttccgttaggtactttacggtcgggtccctttaccggtaacccgggtntaccgggttcccggggttaccctaacggtnttccagtttggacgtacgggtcgggtacgtacggggacccttatttccgaccttccaccaacctagtccacgtccacggtcctcggaccgtaggtaccgtaggtaacgtagttggtacgtacgttaagttttaccgtacgtcgtaccagtacctaattactttacttacgtttcctttacgttacccgttacggtttccgggaacgggtaccggtaacgtaagggtcgtaaagtacgtaacgtaaaccggttagtcggttcggacctagacccgtactagttccttacgttcttcgtacccg

SEQ ID NO: 64246 - DNA, 753 bp, Homo sapiens
  misc_feature: GYAE6OF01EKQ6J.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagacctcccgtggctgtgtctcgtgggacgaggacgggccaccatacaactgacctaacgtccacgccaaggttagtttgtttttacgttccggacccccaactaaataaacctaacttacgttaacgtcgttacggtaaccagaccaaggtaaacggtacggacacgtaccctacctaaacctcctagtactttacgtcggtacctttccggtacccggctaccggttcccgggttacctaaccgtattcgagttcggctacgggtccgggtcgtacggggtacccttacgtttacctaccgttcctaccaacccgtagtaccgacgtaccgacgtcccgtaggaccgacggtcgtaaggaagtgttaggtacggtactttagttttactacgttcgtaccaagtacctaatttactttaacgtttacctttcgtttactaccgttacggtttacgggacgggtacggaaccgttagggtacgtaacggtaaacgttaacccggaaacggttaggtacgggtcgtacggtccgtaacccgtaccgttacgttaccgttttcgttcccttacgttaccccg

SEQ ID NO: 64247 - DNA, 756 bp, Homo sapiens
  misc_feature: GYAE6OF01CI8NR.31.78.H01.1.454.CMB.1.raw
  modified_base (453)..(453): a, c, t, g, unknown or other
  misc_feature (453)..(453): n is a, c, g, or t
  modified_base (480)..(480): a, c, t, g, unknown or other
  misc_feature (480)..(480): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacagtcgtgatgagcctagtttccagacctccctggctgtcgtctcgtgggacgaggacggccaaccatacaaactgacaacgtccagccaagtagtttgttttaacgttccggacccctaactaaaactaaacctaaacttaacttacgtcgttaggtaaccaggacaaggaaagtacggacacgacctaacctaaactcctagtacttacgcggtacttccgtaccggctaacgtcccgggtacctaacgtactactatacggcagggcgggtcggtacgggtaccgtacttaccgacttcnccaacctagtaccaagccacgtacccnggtaccaggtactaggtaagtaacgttgggtaaggtaccgtttaaagttttaacgttacccgtaggttaaccgaacgttaaccgtaaaacttacgttttaactttaaccgttttacccgtttaacgggttacccttaaaccgggttttcccgggaacgggggtaaccgggtaaaccggtaaaggggttacgaaacggtaattaaacccgaaaacggttaacgtgggtccgacgttacgaccgtaaccgtattacccgtacttccttacgtaccccg

SEQ ID NO: 64248 - DNA, 722 bp, Homo sapiens
  misc_feature: GYAE6OF01EJE2L.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctcgtggtcgccgtacggggacatcgtgatgacgcctacgtttccacgtacctcccgtggctggtgtctcgtgggcgaggacgggccacactacaacgtgacaacgtccagccgaggtagtttgttttacgttccggaccccaacgtaaactaacctaacttacgttaacgtcgttacggtaaccgagtacgaaggaaaggtacgacaaccgtccctacctaaaccgtccttagtactttacggtcgggtaccttacccggtacccgggtctaccggttacccggggtttaccctaaaccggtacttacgtagttacggcgtacggtccgggttacggtcgggtaaccttacgttccacttccaccaccgtactacgaacgcgtacgccgtcgacgtaggtacgtagaacgtagtcggtacggtacttagtttactacgttgtacacgtactaaccttattactttacctttcgttccgttcgttacggtcgggaacggtaacgggacgtaaggtcggtaactaacggtaacgtaaacgtactgggacgttcgtacacccgtacttacgttccttcgttacctcgtacccg

SEQ ID NO: 64249 - DNA, 670 bp, Homo sapiens
  misc_feature: GYAE6OF01DT5TI.31.78.H01.1.454.CMB.1.raw
  modified_base (206)..(206): a, c, t, g, unknown or other
  misc_feature (206)..(206): n is a, c, g, or t
  modified_base (241)..(241): a, c, t, g, unknown or other
  misc_feature (241)..(241): n is a, c, g, or t
  modified_base (284)..(284): a, c, t, g, unknown or other
  misc_feature (284)..(284): n is a, c, g, or t
  modified_base (346)..(346): a, c, t, g, unknown or other
  misc_feature (346)..(346): n is a, c, g, or t
  modified_base (377)..(377): a, c, t, g, unknown or other
  misc_feature (377)..(377): n is a, c, g, or t
  modified_base (465)..(465): a, c, t, g, unknown or other
  misc_feature (465)..(465): n is a, c, g, or t
  modified_base (617)..(617): a, c, t, g, unknown or other
  misc_feature (617)..(617): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctcgtggtgccgtacggggacatcgtgatgacgcctagttccagtacctccctggctgtgtctcgtgggcgaggnggccaccatcaactgcaacgtccagccagtagttnttttatcgaccccacaataacaactactagcttacggacaganaacgaagtagacctagtacctacctaaactctagtactttaccgtggtccttacgcccgggntaccggttcccgggtacctaaccgtttacgngttggctaggtcgggtctacgggtaaccgtctttacgactccgttaccacgtatccgagcaccgtcgtacgcgtaaggctaaggtaancgttggtacgtattaatttaccgttctagtaccgaagtactaacgttatttaacgttcgttttccttacggtcgttaccgggtttcgggaccgggtaacggtacgtaaggggtagtaacgtacgtaaccgtaaaccggtaacgttcggggtnaacccgttcgaaccctacgtttacgaccgttttcggtccctttaacttccccg

SEQ ID NO: 64250 - DNA, 794 bp, Homo sapiens
  misc_feature: GYAE6OF01AXJ2J.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctcgtggatctcgtggtcgaccgtacggggacagtcggtgatgacgcctagtttccagacctccgtgctgtgtctcgtagggcgaggcggccacgtatacgtaactgacaacgtccagccgagtgttgttttacgtcggacccctaacaattacaacttacgttacgcgttacgtacagtacgaaaggtaagtacgaccgacgttccctaacgttaaacctccgtagtacctttacggtcggtacctttacccggacccgggtactaccgggtccgggtttaccctaacggtcttacgagtcggacgtacggtccgggtgttacccggggaacttctttaccgcgttacctaccgaaccgttacgtacccgtagtaccgtcgtcccgtacggtacggacccggtattaacccggtaggtacgttacgggtcgtttaccgttaagttttaaccgttagtccggtacgtaactaaccgttaattacttttaacggttacctttccgtccgttaacggttacccggttaggggtaccggaaccgggttacgaaacgggttagaccgttaaacggttaacccgttaaacggttccggtagggttacccgtacggtacccggttaaaccctacggttaccgtttacctttccgttaaccgttcccgttaaccccgg

SEQ ID NO: 64251 - DNA, 541 bp, Homo sapiens
  misc_feature: GYAE6OF01EDQVK.31.78.H01.1.454.CMB.1.raw
  modified_base (349)..(349): a, c, t, g, unknown or other
  misc_feature (349)..(349): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacaactacttagcttggtaccagcaagaaagtaggacagccctacctaaactcctgatttacgtgggcttcacccgggcagtccgggttctaaccgnttcattggcaggcgggtctgggacctatttcactctcaccatcagcacgcctgcaggctagaagatggtgctagtttatactgtcagcaactattatactttcgtttcgtctacgtttcgggacggtagggaccaagggtgagatacgaaacgtagtggtcggactgacctaccatccttgtccttcgtacg

SEQ ID NO: 64252 - DNA, 803 bp, Homo sapiens
  misc_feature: GYAE6OF01BDNWX.31.78.H01.1.454.CMB.1.raw
  modified_base (382)..(382): a, c, t, g, unknown or other
  misc_feature (382)..(382): n is a, c, g, or t
  modified_base (409)..(409): a, c, t, g, unknown or other
  misc_feature (409)..(409): n is a, c, g, or t
tcagcagtagacgtcacgaccggtgctcgatttagtgtgagtagtttgggtttgggggagctacaacaggcagggcaggggcagcaagatggtgttgcagacccaggtcttcatttctctgttgctcgtggatctcgtggtcgccgtacggggacatcgtgatgacgcctagtttccagacctcccgtggctggtgtctcgtgggcgaggacggccacctatcaactgacaacgtccagccagtagttgttttacgttccgaccccaacaaataacctaacttactagtcgttacggtaaccagacaaggtaaagtacggacctacgtccctaacctaaacctcgtagtaactttacgtgggtccttaccggtaacccgggntaccggttccgggttacctaaaccgtnttactagttcgggcgtacggtcgggtacgtcggggtaaccttactttccgaccttacccgtaccaacctacgtaccgaacgtaccgtacgtaccccggttggaccggtaacgggtacttaaggaaacggtggttacggtacggtacgttttaagttttaacgttacggtcgtaactacgtaacgttaaccttaatttaacctttacccgttttaccggttacctttaaccggtttaaccggttttccgggggaacgggtaaccggggtaaacggtaaacgggggttacgtaaagtaaacccggtaacgtaaaaccggtaggttacggtcgggtaaccgtacggaaccccttaaccgttacgttaccggttacctttaccgttaccgttaacccg

SEQ ID NO: 64253 - DNA, 766 bp, Homo sapiens
  misc_feature: GYAE6OF01C5LNC.31.78.H01.1.454.CMB.1.raw
  modified_base (140)..(140): a, c, t, g, unknown or other
  misc_feature (140)..(140): n is a, c, g, or t
  modified_base (459)..(459): a, c, t, g, unknown or other
  misc_feature (459)..(459): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctgggtnccgtacggggacatcgtgatgagccagtttccagacctccctggctgtgtctcgtgggcgaggacggccaccatcaactgacaacgtccagccagtagttgttttactcggaccccacaatacactaacttacgtactcgtacgtacagagtaaaggaaggcgacaccgtaccttaacctaacgttccttagttacgttacggtccggttaccgtacccggtaccggtacgtacccgggtttacccggttaaccttaaccgttcgttacgttggttaccgggacgtcgggtcccgggttaggtaccgggtaaccctttnttacccgtacctccgtaaccctaacgttacgtaacccgtcgtaaccgacccgttcggtaaccggaacggtacggtaacgttaacggaagttcgttaggtaccggttaagttttaacggtttaactccggttataacaaggtacctaagttaacttttacgtttacctttcgtttacgtacgttaccggttacgggacggaaccgggttaacgtagggtaggttaaccaacggttaaaacccgaagttacgttcgggtaccggtacaccgaacccgttacttagttaccggttcgttacgttaccccg

SEQ ID NO: 64254 - DNA, 844 bp, Homo sapiens
  misc_feature: GYAE6OF01E0KHZ.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagacctcccgtggctgtgtctcgtgggcgagacgggccaccatcaactgacaacgtccagccagtagttgttttacgttcgaccccaacaataacaacttacttagccttacggtaccagacaaggaaagtaggacacgtcctacctaaactcctagtactttacgtcgggtccttaccggacccgggtctacggttcccgggttaccctaaccgtacttcctagttcggcgtacgggtccggggtcctacggggacccgttatttccaccttccgtaccaacctacgtacccgaagtcccgacgtcccgtacggaccgtaacgggtaccgttaaggaaacggttacggttacgggtacgggttaccgtttaaaggtttttaacgtttaccggttacggttaccgtaacggtaaccctaaaccttaacgtttttaaccgttttaacccgtttttacccgtttttacccgggttacccgtttaacccggggtttttacccggggaaccggggtaaaccggggtaaccggttaaaggggttcgggtaaaacgttaaaccggttaaacccggtaaaaccgggttaacggttacgggttaccgggtacccgttacggaaccccgttaacccgttacgtttacccggtttaccgtttcccgtttaaccgttaccccg

SEQ ID NO: 64255 - DNA, 839 bp, Homo sapiens
  misc_feature: GYAE6OF01CLNWV.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgacgcctagtttccacgtacctccctggctgtcgtctcgtggcgaggacgggccaccatacaactgacctaagtccaagccaaggttgtttcgtttttacgttcccggacccctaaacctaaaataaaccctaaactttaacgttacggtccgtttacggtaacccaaggtaccgaaaggtaaaacggtaacgaaccgacgtaccccttaacctaaaaccttcccgttagttaacgtttacgtcgggttaccttacccgtacccgggtactaccgggtttaccccgggttaccctaaccggtaactttccgtaacgttcggacgtaccgggtcggggttacgttacggggtaacccgttacgttttccaaccttccgtaccctaacccctaagttaccgaacggttcccgtaaccggtacccgttaccggaccgggaacggtaccgtaagggtaacgtagttacgggttacggttacgtttaacggttttaactttacgtaccggtttacgtaactaccgtaaaacgtttaactttaacgtttaccgttttacccgttttaccggttacccgttaccgggtttacgggtaccggggtaacgtaaccggtaacggtaggtagtacgtaacgtaaacgtagtcggtgtcgtacactactaaccgttgtacttcgtacctacg

SEQ ID NO: 64256 - DNA, 593 bp, Homo sapiens
  misc_feature: GYAE6OF01ANBVI.31.78.H01.1.454.CMB.1.raw
  modified_base (425)..(425): a, c, t, g, unknown or other
  misc_feature (425)..(425): n is a, c, g, or t
  modified_base (431)..(431): a, c, t, g, unknown or other
  misc_feature (431)..(431): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctcgtgggcgaggacgggccaccatcaactgacaagtccagccagtagttgttttattcggaccccaacaactaacaactacttagcttcggaccagcaagaaagtggacacgtccctacctaactcctagtactttacgtcggtccttaccgtacccgggctacggttcccggggttacctaaccgtattcgagttcggcgaggtcgggtcgtagggacctattccactcacaccntcagcncgctgcgagtctagagtgtgtcgtatatttacgtctagtacacgtactacttattactactttcgttacgtacgttacgttcgggacgggtaggtaaccgtagggtacggatacgtaacgaacgtacgtggtcgcgtcgactactagtactcgttctcgtcg

SEQ ID NO: 64257 - DNA, 810 bp, Homo sapiens
  misc_feature: GYAE6OF01EIKRI.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagttccagacctcccgtggctgtgtctcgtgggcgagacggccacatcaactgacaagtccagccagtagttgttttacgttccggacccccaacgtaaactaaacctaaccttaccgtttaagtccgtttacggtaacccaggaccgtaaaaggaaacggtacggaaccacggtaccccttaaccgttaaacctccgttacgttaacgtttaccggtcgggtacctttacccggtaccccgggtacgtaccgggtttacccccgggggtttaccctaaacccggtatttaccgaggtttcggacgtacggggtcgggttaccggtacggggtacccttaagtttcccgaaccgttaccctacctaccgtactacgacgtaccgtacgtccgtacgcgtacggtcgtagaacgtagtcgggtacgtacgttagttttacttcgtacgtacgtaacgtaccttaacttaacttttacgtttaaccgttttccgtttaccggttaccgtttaccgggtttaccgggggtccggtaaaccggggtaaccgtaaacgggggtaggtaaaccgtacgtaaaacccggtaaacgttaacggttgggtccgtcgtaccgtaccgtaactacgttcgttcgttacctcgtacccg

SEQ ID NO: 64258 - DNA, 753 bp, Homo sapiens
  misc_feature: GYAE6OF01CTSRZ.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtcgccgtacggggacatcgtgatgacgcctagttccagctccctggctgtgtctcgtgggcgaggacggccacatacaactgacaacgtccacgcagtagttgttttacgtccggacccaacgtaaataaactaaccttacgttacgcttacggtaccagaactaaggaaaggtacgacacgtaccctaacctaaactccgttgtacctttacgcgggtacctttaccggtacccggactaccgggttaccccgggtttaccaaaccggttattacgtacgttcggacgtacgggtcgggttccgtacgggtaaccttacgtcaccgttcctaccaacctgtacgacgcgaacgtcccgtaggaccgtagggtactaaggtaacgtcggttacggtcggttacttaagttttacgtacgtcggtaaccgtacgtaactaacgttactttaaccgtttactttccgtttacgttccggttaaccgggtttacggggtacgggtaacgggtaacgtaacgggttacggtaataacggaaaccgtaaacggtacgttacgggtcgtacgtaccgtaccgtaccgtaatttcccggttacttccgttccgttaaaccccg

SEQ ID NO: 64259 - DNA, 822 bp, Homo sapiens
  misc_feature: GYAE6OF01A9GLK.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtcgccgtacggggacatcgtgatgagcctagtttccagacctcccgtggctgtgtctcgtgggcgaggcgggccaccataccaacgtgacaacgtcccagccagtagttgttttacgttcggccccaacaataaccaacttacttaagtccgttaggtaccagacaaggaaagtacggacacgtcctacctaaactcctagtacttacgtggtccttaccgtacccgggctacggttcccgggttaccctaacgtacttctagttcggacgtacggtaccgggttcgtacggggtaacccttactttccgaccttacccgtaccaaccgtacgtaccgaacgtccgtaacggtcccttacggaccgtacggtaacccgttaagggaaagtaggttcggtacgggtacctttaaggtttttaacgtaccttggaaccctaacggtaacctaaactttacgtttaaacctttacgttttccgtttaccggttacccgtttacgggtttacccggggtacgggtaacccggggtaacctaaacgggggttacgtaaacgggtaaaccgttaaaacccggaaaacgggtttaccgggttacggttacggggtacccttacccggtaaccccgtaaacgttacccgtttaaaccgtttcccgggtttacctttaacccgggtttaccccc

SEQ ID NO: 64260 - DNA, 706 bp, Homo sapiens
  misc_feature: GYAE6OF01AVYAH.31.78.H01.1.454.CMB.1.raw
  modified_base (426)..(426): a, c, t, g, unknown or other
  misc_feature (426)..(426): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagttccagactccctggctgtgtctcgtgggcgaggacgggcccaccatcaactgcaagtccagccagtagttgttttattcggccccaacaactaacaactacttagcttagtacagcaagaaagtaggacacgcctacctaaactcctagtactttacgtggtccttaccgtacccgggctacgtcccggggttacctaaccggtacttcagttcggcacggcgggtcgtacgggtaccgtattccacttcctcaacctntacacgcacgccttgacacgggtctagaacgtactcggtaggtaccttagtttaacttccgtagtcgaacgtaccgtaaactaactttaacgtttaaccgtttaccgtttacccgttaccgttaaccggttttaccggggacgggtaaaccggggtaaccgtaaaggggtacggtaaacgtaaacggttaaacccgtaaaacggtaaccgttagggttcggacccgttacgggaccctaaaccgttacgttaccgttacgttccgtttaccctaaacccg

SEQ ID NO: 64261 - DNA, 759 bp, Homo sapiens
  misc_feature: GYAE6OF01EZXC8.31.78.H01.1.454.CMB.1.raw
  modified_base (178)..(178): a, c, t, g, unknown or other
  misc_feature (178)..(178): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagttccagactccnggctgtgtctcgtgggcgagacgggccaaccatcaactgcaagtccagccagtagttgttttatcggaccccaacaaataacaactactagcttaggacagacaagaaagtacggacacgaccctacctaaaactccgtagtactttacgtcgggtccttaccggtaccccgggactaccggttcccggggtttacccctaaaccggtatttaccgtaacgtttcggaccgtaggtcccgggggttaccgtaccggggtaacccgttaacttttaccgacctttacctaccgaaccacgttaccaaggccaagccctggaccacgggtactagtaaacgattggaggtaccttaaggttttatacgtcgtacacggtaaccctaaatattttaactactttcgttaccgtttacgtaaccggttttcgggaaccgggtaagggtaaccgtaaaggggttacgggtaaacgtaacgtttaaaccgaaaaaaccgggttaacgttgggttaccggggacttaaccggtaaccctaacccggttaacttaccctttcgggttaccctttacccgttaaacccgg

SEQ ID NO: 64262 - DNA, 829 bp, Homo sapiens
  misc_feature: GYAE6OF01D76UQ.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctcgtggtcgccgtacggggactatcggtagatggacgcctacgttccagtacctccgtggctgtcgtctcgtgggcgaggacggccacatacaacgtcgacacgtccagccgtagtagtttagttttacgttaccggacccctaactaaataacctaacttacgtacgtccgttacggtaaccagacgaaaggtaagtacgacctacgtaccctaacctaactccgttagttacgtttacggtccggttaccgttacccggtaccggtacgttaccggttccccgggttacctaaccgtctacgtaggtcggaccgtacgggtccgggttacggtaccgggtaccttactttacccgaccttcccgtacccgtaactaccgtacgaccgtaccgtacggtcccgtacggtaaccggtagtaccggtaagggaaacggtttgttcggggtacggttaacgttttaacgttttaaccgttaccggttacgtaccgtaacggttaaccttaacgtttaaccttttacgttttaccctttaccgtttacccgttaaccggtttaccgggttacggggacggggtacggtaacccgggtagggtacggtaaccgtaccgttaaacggtaaaccgggtttagtcggtacggtacctacgtaaccctacgttacctttacgttaccgtttcctcccgttacccg

SEQ ID NO: 64263 - DNA, 830 bp, Homo sapiens
  misc_feature: GYAE6OF01E4X2H.31.78.H01.1.454.CMB.1.raw
  modified_base (409)..(409): a, c, t, g, unknown or other
  misc_feature (409)..(409): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatggacgcctagtttccagacctcccgtggctgtgtctcgtgggcgaggacgggccaccatcaactgacaacgtccagccaggtagtttgttttacgttccggaccccaacctaaataaaccaacttacttagcgttacggtaccagacgaaaggaaagtacggacacgtaccctacctaaacctcctagtaactttacgtcggtccttaccgtacccgggtctacggttccccgggttaacctaaccggtnttacgtagttcggccgtagggtccgggttacgtacggggtaacccttactttaccgaccgttacctacccaacccgtactaccgaacggaccgtaccggtcccgtacggaccgtacgggtaccgtaaggtaaacggtacgttacgggttacggtacgttttaacgttttaccgttaaccgtcggtaccgtaacgtaacccttaaaacttacttttaaccgtttaaccctttccgttttacccgttacccgtttaaccggggtttaccgggggaccgggtaaccggggaacccggttaaaggggtaccggtaaaggtaacccgttaaaccggtaaaaccgggttaggttacggtccgggtacccgttacggaccctaaacccgttcgttaccgtttacccgtttccgttaccttacccccgg

SEQ ID NO: 64264 - DNA, 917 bp, Homo sapiens
  misc_feature: GYAE6OF01BCKIA.31.78.H01.1.454.CMB.1.raw
tcagcagtagacgtcacgaccggtgctcgatttagtgtgagtagtttgggttgggggagctacaacaggcaggcaggggcagcaagatggtgttgcagacccaggtcttcatttctctgttgctctggatctcgtggtcgccgtacggggacatcgtgatgacgcctagtttccagtacctcccgtggtctgtgtctcgtgggcgaggcggacccacatacaactgactaacgtccgacgaccgtaggtagtttagttttacgttccggacccctaaaccgtaaactaaacctaacttaacgttacggtccgttaggtaaccaagacgtaaggaaaggtacggactaccgtaccctaaccgttaaaccgtccgttagtaacgttttaccggccggttaccgtttacccggtaccccgggtacgtacccggttaccccgggggtttaacccctaaccgttacgttaccgtaggttacggacgtaacggggtcccgggttcggttacggggtaccctttaacttacccgtaccgttaccctacccgtaaccgttacgtacccgtaaccggtacgtacccgtaccggtttaccggaccggtaaccgggtaccgttaaagggtaaaacggttcggttcgggttaaaccgggttacttttaaacggttttacgtttacccggttacggtaacctaaccggtaaccttaaacgtttaacgtttaaacctttttacccgtttacccgttttacccgtacggttacccgggtttcggggtaacccgggtaacggtaacggttaaggggtacgtaaaccgttaaaccggaaaccggttaaaccgttacggtcgggttacccgggcgtaaccgttacccgtaccggttctttaaacccgtttcggtaacctttacgtttaacccccg

SEQ ID NO: 64265 - DNA, 799 bp, Homo sapiens
  misc_feature: GYAE6OF01CY1K0.31.78.H01.1.454.CMB.1.raw
  modified_base (151)..(151): a, c, t, g, unknown or other
  misc_feature (151)..(151): n is a, c, g, or t
  modified_base (185)..(185): a, c, t, g, unknown or other
  misc_feature (185)..(185): n is a, c, g, or t
  modified_base (201)..(201): a, c, t, g, unknown or other
  misc_feature (201)..(201): n is a, c, g, or t
tcagcagtagacgtcacgaccggtgctcgatttagtgtgagtagtttgggttgggggagctacaacaggcaggcagggcagcaagatggtgttgcagacccaggtcttcatttctctgttgctctggatctcgtggtcgaccgtacggganagtcgtgatgacgtcctagttccagacctcccgngtctgtcgtcgtcggngggacgagacggacccagactacaacgtgacaacgtcagcctaaggttagttttcgtttaacgtcccggacccctaaactaaacttaaacctaacgtaacgttacgtacgttacgtaaccacgtacgaaggtaaaggaccgacgtacgtaccctacgtaaactccgtagttacgttaccggtcggtaccgtttacccggtaccggaccgtaccggttacccggggttaccctaacgtaccgttacgtacgttacggcggtacgggtccgggtacgtaaccgggtaccgttaacgtttccgtaccttaccgtacccgtacccgtaagtccgtaaccgggacctaaccgccgttacgaccggtacggtcgaagttaacgcggttacgggtacgaaccgttttagtttaacgtcgttagtaaccgtacgtactaactttattttaaccgttccgttttaccgtttacggttcccgttaaaccgggttcgggaaccgggtaaaccgggtccgtaggggtaacgtacgtaaacgtaacggtaacgtaggttccggacgttaccgaccgacttaccggtactacgtcgttccgtaccgttcccg

SEQ ID NO: 64266 - DNA, 740 bp, Homo sapiens
  misc_feature: GYAE6OF01DJ8HM.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctcgtggtgcctacggggacatcgtgatgagcctagtttccagacctccctggctgtgtctcgtgggcgaggacgggccacctatcaactgccaagtccagccagtagttgttttacttccggaccccaaccaaataaccaacttaacgttacgtcttacggtaaccagactaaggaaagtacggaaccacgtaccctaacctaaacctccgtaggtaacttaccgtgggtaccttacccggtacccgggtactaccgggttaccccggggttaacccctaaaccggttattacgtaacgtttcgggacgtaacgggtccggggttaccgtacgggggtaaccccttagtttcccgaacctccgtacctaaccgactccgaacgtccaacgtcccgtgacgtacggtcctaaggaacgtagtcgggtacggtacttagttttaactacgtacggtacctaagtacctaaacgttaactttacgttaccttttaccgtttcgtacgttaccggtttcgggaacggtagggaccgtaaaggttcggaagttaacacggtaaaacgtagtggtacgctagaaccctactacgtacgttactccctgtaaccc

SEQ ID NO: 64267 - DNA, 611 bp, Homo sapiens
  misc_feature: GYAE6OF01CBTXK.31.78.H01.1.454.CMB.1.raw
  modified_base (455)..(455): a, c, t, g, unknown or other
  misc_feature (455)..(455): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctcgtgggcgaggacgggccaccatcaactgcaagtccagccagagttgttttattcggccccaacaataacaactacttagcttggtaccagacaagaaagtaggacagaccctacctaaactcctagtactttacgtcgggtcttccgtacccgggctacggttcccggggttacctaaccgtattccagttcggcagggtcgggtcgtcggggaccctatttccactcctaccacctatcagcacgtcctgcgaggctagaagngtggtcggacttagtttactacgtgtacagactaactattacttactttcgtttaccgtacttaccgtttcgggacgggtacggaaccgtaagggtcggaacgtaactacgaaacgtagtggtcggactcgacctaccattctcgttcctcgtacc

SEQ ID NO: 64268 - DNA, 823 bp, Homo sapiens
  misc_feature: GYAE6OF01BMDFI.31.78.H01.1.454.CMB.1.raw
  modified_base (368)..(368): a, c, t, g, unknown or other
  misc_feature (368)..(368): n is a, c, g, or t
  modified_base (414)..(414): a, c, t, g, unknown or other
  misc_feature (414)..(414): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagacctccctggctgtgtctcgtgggcgagacgggccaccatcaactgacacgtccagccagagttgttttattcggccccaacaataacaacttacttagcttggtaccagacagaaagtaggacacgcctacctaactcctgtactttacgtggtccttccgtacccgggctacgtcccgggttacctaaccgnttcagttcggcgacgggtcgggtcgtacgggtacccgtactttccnccttccgtacctaacccgtactaccgtacggaccgtaccggacccgttccggaccgtaacgggtaccgttaacgggaaacggtacgttggggttacgggtaccttttaagggtttttaacctttaaccggttccgttacgtaaacccgtaacttaaaccgtttacttttaaacgtttacccctttttacggtttttccgttaacccggtttacgggtttttaccccgggggaagggggtaaccggggttaaacccggttaaaggggggttcgggtaaacgtaaacggtttaaaacccggaaaacccgggttaacgtttcggggttaccgggttacccgttaccggaaccccgttaaccccggttactttacccgggttttcggtttaccccgtttcggtttaacccccc

SEQ ID NO: 64269 - DNA, 878 bp, Homo sapiens
  misc_feature: GYAE6OF01DKR3G.31.78.H01.1.454.CMB.1.raw
  modified_base (138)..(138): a, c, t, g, unknown or other
  misc_feature (138)..(138): n is a, c, g, or t
  modified_base (197)..(197): a, c, t, g, unknown or other
  misc_feature (197)..(197): n is a, c, g, or t
tcagcagtagacgtcacgaccggtgctcgatttagtgtgagtagtttgggtttgggggagctacaacaggcaggcaggggcagcaagatggtgttgcagacccaggtctcatttctctgttgctctgatctcgtggtnccgtacgggacatcgtagatgacgcctagttccagtacctccgtggctgtcgtctacgngggacgaggacggccactatacacgtacgactaacgtccacgacctaggttacgtttacgtttttacgtccggaacccctaacgtaaaactaaacctaacgtttaaccgttacggtaccgtttacggtaaaccaacggaaccgtaaaggtaaaacggttaacgggaacctaccggttaccccgttaaacctttaaaccgttccgttacggtttaaccttttacgggtaccgggttccgttttacccgggtaaccccgggtaccgtttaaccgggttaccccggggtttaacccttaaaccggttcgtttaccgttaaggttccgggtacgtacgggggtccgggttaccggtacggggtaacccgtttactttacctaacgtcccgttaaccaaccgttacgaccgtaaccggcgtaccgtaccgtacggttaccggacggtacgtacggtaacgtagttggtaccgttacgtttacggtttaaacgttcgtaggttaactacggaaccttaacgtttattacctttaaccgttttcgttacgttacccggttacgggtttagaaccgggacggtaacgttaacgggagtaacggtaactaacccgggtaaagttaacggtcggttccggaccgtactacgtaaccgttggttacctttaccggtcctttcgttacccccg

SEQ ID NO: 64270 - DNA, 630 bp, Homo sapiens
  misc_feature: GYAE6OF01EH7LU.31.78.H01.1.454.CMB.1.raw
  modified_base (349)..(349): a, c, t, g, unknown or other
  misc_feature (349)..(349): n is a, c, g, or t
  modified_base (374)..(374): a, c, t, g, unknown or other
  misc_feature (374)..(374): n is a, c, g, or t
  modified_base (593)..(593): a, c, t, g, unknown or other
  misc_feature (593)..(593): n is a, c, g, or t
  modified_base (613)..(613): a, c, t, g, unknown or other
  misc_feature (613)..(613): n is a, c, g, or t
  modified_base (618)..(618): a, c, t, g, unknown or other
  misc_feature (618)..(618): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacgggggacatcgtgatgagcctagtttccagacctccctggctgtgtctcgtgggcgaggcgggccaccatcaactgacaagtccagccagagttgttttattcggacccccacaaataacaactacttagcttggtaccagcaagaaagtaggacacgcccttacctaaactcctagtactttacgtgggccttcgtacccgggntacgttcccggggtacctaaccgtnttcagttcggcacggtcgggtactcgggtacctatttccacttcctactaccagtccagcctagccctggacgacggtcgtaggaagtattggtcggtacttacgttttactacgttcgtacacgtacctaacgttatttaacgttactttccgtttcgtacttaccggtttacgggacggtacgggacgtaagggtggacgtactacgaaacgtacgnggttacgcgtgacctacctnttacncgttctctaccg

SEQ ID NO: 64271 - DNA, 877 bp, Homo sapiens
  misc_feature: GYAE6OF01ACHWA.31.78.H01.1.454.CMB.1.raw
  modified_base (429)..(429): a, c, t, g, unknown or other
  misc_feature (429)..(429): n is a, c, g, or t
  modified_base (756)..(756): a, c, t, g, unknown or other
  misc_feature (756)..(756): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctcctggctgtgtctcgtgggcgagacggccaccatcaactgccaacgtccagccagtagtttgtttttacttccggaccccaaccaacgtaaacctaaccttacctttagtcctttacggtaacccagaccaaagtaaacggtaggaacctacgacccttaaccccgtaaaccttccttaggtaaacgttttacggttcgggtacctttcccggtaccccggggactacggttcccgggtttaaccctaccgtnttacccgtgttcggacgacggtaccggttcggtaggggtaacccgttattttaccgaaccgttcctacgtacctacgttaccgaccggacttacccggtaccccgttggtacccgtaaccgggttaccgttaacggtaaaagggtccgtttaaggggttaccggtacgttttttaaacggtttttaaaccggttccttaagggtacccctaaaccgggtactaaaaccgttttaccgttttaacgtttacccgtttttccgttttaacccggtccgtttaaccggtttcccgggggaacggggtaacccggaaccgtttaagggggngttaaaaccggttaactaaacccgggtaaaaacccgggtctttacccggggtggttacccttaaccggggaccttacccgggttacttaacggttcctttaccgtttacccgttaaccccg

SEQ ID NO: 64272 - DNA, 722 bp, Homo sapiens
  misc_feature: GYAE6OF01DFN2P.31.78.H01.1.454.CMB.1.raw
  modified_base (716)..(716): a, c, t, g, unknown or other
  misc_feature (716)..(716): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctcgtggtcgccgtacggggacatcgtagatgacgcctagttccagcctccgtggtctgtgtctcgtggcgaggacggccacatacaactgacaacgtccagaccaggtatttcgttttacgtaccgaccccaactaaactaactaacttactacgtacgttacggaccacgtacaaggaagtacggactaccgtaccttaacctaaacctctagttacgttacggcggtaccttaccggacccggtatacccgggtccgggttaacctaacggttcttacgtagttcggacgtacgggtcgggtacgtacggggtaccttacgttcctaccgtaccttaccaaccttataccgacgccgtacgtccgtacgtaccggacggtacgtaggtaacggtacgtaggtacggtaccgttagtttacgttacgtacgtacgtactaactaacttaacgtttacttactttaccgttacgttaccgttacggttacgggtacgggtacggtacggtaacggtagaacgtacgtaacggtaacgtacggtacggtcggtacgtacgactacctacgttcgttcttccgttntacccg

SEQ ID NO: 64273 - DNA, 657 bp, Homo sapiens
  misc_feature: GYAE6OF01E049V.31.78.H01.1.454.CMB.1.raw
  modified_base (394)..(394): a, c, t, g, unknown or other
  misc_feature (394)..(394): n is a, c, g, or t
  modified_base (472)..(472): a, c, t, g, unknown or other
  misc_feature (472)..(472): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtaacggggacatcgtgatgagcctagtttccagacctcctggctgtgtctcgtgggcgagagggcccaccatcaactgacaacgtccagccaggtagtttgttttacttcggaccccaacaaataaaccaacttaacttagtcgttaggaaccagacaagaaaaggtagaacacgcccttaacctaaactcctagtactttacgtcgggtccttccgacccgggctacggttccgggttaccctaaccggtnttcagttggcgaggtcgggtcgtcgggacctatttccacttcaccacatcgactcgacgtcccgtgcgagctaggaangtcggtgtacttaggtttaactacgtgtacaacgtactaaagttacttacgttacctttcgtttccgtccgttaacgtttccggggaagggtaccggtaacgtagggacgtaagaacgttaacgaaacgtaagttggtcggtactcgaccctaccgttattacccgtgttaacctcgttaacccg

SEQ ID NO: 64274 - DNA, 905 bp, Homo sapiens
  misc_feature: GYAE6OF01CMGRB.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagactccctggctgtgtctcgtgggcgagcgggccaccatcaactgacaagtccagccagtagttgttttacttcggccccaacaataacaactacttagcttaggtaccagcaagaagtaggacacgccctacctaaactcctagtacgtttacgtcgggtcctttaccggtacccgggtactaccggttccccggggtttaaccctaaaccggttactttccgaacgtttcggaccgaaggggtcccggggttacggtacggggtacccgttattttcccgaaccgttccctaccgaaccctacttaccgaacggccgtaaccggtcccgttacggaacccggtaacggggtacccgttaaagggtaaaacggttacgttacggggtttaaccgggttacgttttaaacggtttttttaaacggtttaacccgtttacgggttaacccgtaaacggtaaacccgttaaaccgttttaaatttttaaacccgttttaaccttttttaaccccggtttttacccgttaacccggttttaaaacccgggtttttcccggggggaacgggggttaaacccggggtaaacccggttaacgggggttaaccgggtaaacggttaaccgtaaaacccgggttaaaacgggtaaccggtttacggggttaccggtacccgttaacgaacccggtacccttaaacgttcccgtttacggtttccctttccgttaaccccg

SEQ ID NO: 64275 - DNA, 781 bp, Homo sapiens
  misc_feature: GYAE6OF01DA8X7.31.78.H01.1.454.CMB.1.raw
  modified_base (311)..(311): a, c, t, g, unknown or other
  misc_feature (311)..(311): n is a, c, g, or t
tcagcagtagacgtcacgaccggtgctcgatttagtgtgagtagtttgggttgggggagctacaacaggcaggcaggggcagcaagatggtgttgcagacccaggtcttcatttctctgttgctctggatctcgtggtcgccgtacgggacagtcgtgatgacgcctagtttccagacctcccgtggctgtcgtctcgtgggcgaggacgggccacctatacaacgtgacaacgtccagaccaggtagtttagttttacgtccggaccccaacaaataaaccaacttagttacgtacgttacggtaaccanacgaacgtaaacgtacggactacgtaccctaacctaaacctccgtagttacttacggtcgggtacctttaccgacccgggctacggttccggttaccgggttacctaaacggtactttacgacgttcgggacgtacggggtaccgggttacgtacgggtaaccgttactttaccgacctccgtaaccacctaatccggaacgtacccgtacggccgttacgacgaacgggtacctaagggtaacgtcggtcggtaggtacctttaaggtttactagtcgtacaagtaccctaaagtttactttaactcgtttttaccgttacgtaacccgttacgggttaccggggaccgggtaacgggtaaccgtaaacggggtcggtaaataaccggttaaaaccgtaaacggttacggttcgggtaccgaccgttaaccggtacctaacggttacttcgttaccgttcgttaacccg

SEQ ID NO: 64276 - DNA, 778 bp, Homo sapiens
  misc_feature: GYAE6OF01BHQRQ.31.78.H01.1.454.CMB.1.raw
  modified_base (406)..(406): a, c, t, g, unknown or other
  misc_feature (406)..(406): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagttccagactcccgtggctgtcgtctcgtgggcgaggacgggccaccatcaactgacaacgtccagccgtagtagtttgttttactccggaccccaactaataacctaacttacttagcttaggtaaccagacaaagtaacgtacggacacgtaccctaaccgtaaactccgtagttaatttaccgtacgggtccttaccggtacccgggactaccggttaccgggtaccctaaccggtntaccgtacgttacggaccgtacgggtccgggttacgtaccggggtacttactttaccaacttcctacccgaacctacgtacgacggtccacgtcccgtggactacgggaccgttaggaaacggtactcgggtacgtactttaacggttttataccggttcgacaacggtaactaacctttaatttacgtttaaccctttccgtttaccggtaacccgtttacgggttcccggggaaacgggtacggtaaaccgggttaagggttaggaaacccgttaacgtaacccgggtaaaaccggttgttaacgggtcgggtaccgtacaacccggtttacacccggttttactcggttttaacccctgttaacccccg

SEQ ID NO: 64277 - DNA, 744 bp, Homo sapiens
  misc_feature: GYAE6OF01DCJAB.31.78.H01.1.454.CMB.1.raw
  modified_base (139)..(139): a, c, t, g, unknown or other
  misc_feature (139)..(139): n is a, c, g, or t
  modified_base (352)..(352): a, c, t, g, unknown or other
  misc_feature (352)..(352): n is a, c, g, or t
  modified_base (379)..(379): a, c, t, g, unknown or other
  misc_feature (379)..(379): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtncctacggggacatcgtgatgagccagtttccagactccctggctgtgtctcgtgggcgagacgggccaccatcaactgccaagtccagccagtagttgttttacttcggacccccacaaataaactaactacttagcttggtaaccagacaagaaagtagacacgccttacctaaactcctagtatttacgcgggcctttacgtaccccgggntacgttcccggggttccctaaaaccgntttacgatttcggctacgggtcgggtccttacggggaaccgtacttttaccaaccgtcttaccaacccctagttaccacggtcaacggtacccgttcggaaccgtagggtccgtaagtaaagtaattgggtcggttacttaagtttttaacgttaccgtttaggtacctaacggacctaaactactttaactttaccgtttaccttttaccgtaccttaccggttttacgggaccggggtacgggtaaacccgtaaaggggtagggaaacgttacgtaaccgtaaaaacggtaacccttgggtccggtacgtacggaacccttaacccgttaagtttacttaccgtttcccgttcgttaaccccg

SEQ ID NO: 64278 - DNA, 631 bp, Homo sapiens
  misc_feature: GYAE6OF01AXIH9.31.78.H01.1.454.CMB.1.raw
  modified_base (363)..(363): a, c, t, g, unknown or other
  misc_feature (363)..(363): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgacgccagtttccagtactccctggctgtgtctcgtgggcgagacgggccaccatcaactgacagtccagccagtgttgttttacttcggacccaacaataacaactacttgcttacggtaccgagcaagaaagtacggacacgcctacctaactcctgtacttcgtggcttcgtaccggcacggtccgggttacctaaccgtntctagtcggcaggcggtgtacggacgtacttcgactctcacctatcgacgacacgccgtagcgacggtctagaagtatggtacgacttagtttactacgtgtacagtaactaatacgtttaacttacctttcgtttacccgtaccttaccggtttgggaccggtaacgggtaccgtaagggttacggaacgtaacttaaccggaaacgttaaggcggttacggaccttcggaaccttaccgtagttaccgttcgttccttcgtacccc

SEQ ID NO: 64279 - DNA, 681 bp, Homo sapiens
  misc_feature: GYAE6OF01BC5MV.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagacctccctggctgtgtctcgtgggcgaggacgggcccaccatcaactgacaagtccagccagtagttgttttattcggccccaacaataacaactacttagtcttacggtaccagacaaggaaagtaggacacgtccctacctaaacctcctagtacgtttacgtgggtcctttccgtacccgggctacgttcccggggttacctaaccggtattcctagttcggccagggtccgggttacgtggggaccctatttccacctctacaacctatccacgcacgcctgcgaggtctagaagtagtggtacgtacgttagtttaacgttacgtgtactaacgactaaattacttaacttaccttttccgtttaccgtcgttaccggtttcgggacggggtaacgggaaccgtaaggggtacgtaacgtaacgtaaccgtaaaaccggtacgttcgggtaccggtcgtcggaaccctaccgttacttccgtcgtttccgttaccgtacccg

SEQ ID NO: 64280 - DNA, 629 bp, Homo sapiens
  misc_feature: GYAE6OF01EBCQP.31.78.H01.1.454.CMB.1.raw
  modified_base (448)..(448): a, c, t, g, unknown or other
  misc_feature (448)..(448): n is a, c, g, or t
  modified_base (468)..(468): a, c, t, g, unknown or other
  misc_feature (468)..(468): n is a, c, g, or t
tcagcagtagacgtcacgaccggtgctcgatttagtgtgagtagtttgggtttgggggagctacaacaggcaggcagggggcagcaagatggtgttgcagacccaggtcttcatttcctctgttgctctggatctctggtgcctacggggacatcgtgatgagcctagtttccagacctcctggctgtgtctcgtgggcgaggacgggccaccatcaactgcaagtccagccagtagttgttttattcggacccccaacaataacaactacttagcttagtaccagacaagaagtagacagaccctactaaactcctagtactttacgtcgggtaccttaccggtacccggtcgtacggttccccgggttacctaaccggtattccaagttcggacgacgggtccgggtcgtacgggacctatttccactcctacctaccatcgagcncgcctgcgagactagaagtntggtacgctatttatctgtacacgtactaacttatttaccttactttcttccgtacgttaccggtttccgggacgggtacggaaccgtaagggtgtaagacgtaacgtaaacgtacgtaggtcggctagacccgtacctattcgtacgttctacgtacccg

SEQ ID NO: 64281 - DNA, 663 bp, Homo sapiens
  misc_feature: GYAE6OF01BHJ7K.31.78.H01.1.454.CMB.1.raw
  modified_base (648)..(648): a, c, t, g, unknown or other
  misc_feature (648)..(648): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagacctccctggctgtgtctcgtgggcgaggacggccaccatcaactgcaagtccagccagagttgttttattcggaccccacaataacaactacttagcttaggtaccagacagaaagtacggacagccctactaaacctccgtgtactttacgtcgggtcttaccgtacccgggtactacggttacccggggttacctaaccggtacttcctagtttcggcgtacgggcggggttccgtacgggacccggtatttaccgtacctaccgtcgtaacctctaccgacgtaccacggtacccttgaccgtaggtaccgtaggaaagattggtcggacttaggtttacttaacgtgtacagtactaaacttattacgttacctttcgtttacgttaccgtcgttttaccgggacgggtacggtaccgaagggtcgaagtacgtaagtaaacgattcgggacgtctacgactacacgttntacgttctctacccg

SEQ ID NO: 64282 - DNA, 1015 bp, Homo sapiens
  misc_feature: GYAE6OF01DED2K.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctcgtggatctcgtggtcgccgtacgggactagtcgtgatgacgcctagtttccacgtacctcccgtggtcctggttcgttccgtcggtcggggacggacgggaccgggaccctaacctagtaccaaccgtgacctaacggtcccgacgccgtaaggttacggtttcgtttttaaccgtttcccggaacccccctaaactaaaacttaaaacctaaaccgtttaaccgtttaacgtaccggtttaacgggtaaacccctaaggaaccgtaaaagggtaaaacggttacgggaacctacccggttaaccccttaacccgttaaaaccttccggttagttaaaccgttttaccgggtcgggttaccctttacccgggaacccgggttccgttaacccggggtttaccccggggtttaaccccgttaaccgttacgttaccgtaacggtttcgggacggtaacggggtcccggggttaccggtacgggggtaaccctttacgtttacccgaaccttcccgtacccgtaaacccgtacgttaccgaaccgtaccgtaccggtaccgtccgggtaacggtacggttacgtaaacgtaacggtaggtttcgggtaaccgtttacgtttaaacggttttacctacgttacggtaaccgacgtaacctttaacgtttaacgttttaccgttttaaccgttttcccggttttaccgggttaccccgtttaacggggtttacccgggaaccgggggtttaaccgggtaaaccggttaagggggtttaaccgaaaccgttaaccgtaaaaccggtaaacggtacccggtttaggtacccgggtacctaccgtaaccgttacccgttagttacccgtttcgtttacccgtacccgtttaccccg

SEQ ID NO: 64283 - DNA, 683 bp, Homo sapiens
  misc_feature: GYAE6OF01C77E9.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctcgtggtgccgtacgggacagtcgtgatgagcctagtttccagactccctggctgtcgtctcgtgggcgaggacggccaccatcaactgacaacgtccagccgagtagtttgttttatccggacccctaacgaaataaccactacttagcgttaggaaccagagaaggaaagtagactacgtcctaaccgtaactcgtatagtttaccgtggtccttacggtaccccgggatacggttcccgggtaccctaaccgtatttcgaagtttcggacgtacggggtccggttaccgtcggggtaaccctacgtttcccgacgtttccgtaccaacctgttaccgacgtacacgtccgtgaccgagacgtagaagtgtgtagtacgttagtttactacgtgtaccagtactaactacgtttaacttacctttcgtttaccgtaccgttcggttccggtaacgggtacggtacggtaggtacgtacgtaagtaccgaaaacgttgtacggtcggtacgtacgacgtacctacgtgtttacgtccgtttacgtacccg

SEQ ID NO: 64284 - DNA, 668 bp, Homo sapiens
  misc_feature: GYAE6OF01EMS3Z.31.78.H01.1.454.CMB.1.raw
  modified_base (329)..(329): a, c, t, g, unknown or other
  misc_feature (329)..(329): n is a, c, g, or t
  modified_base (345)..(345): a, c, t, g, unknown or other
  misc_feature (345)..(345): n is a, c, g, or t
  modified_base (367)..(367): a, c, t, g, unknown or other
  misc_feature (367)..(367): n is a, c, g, or t
  modified_base (396)..(396): a, c, t, g, unknown or other
  misc_feature (396)..(396): n is a, c, g, or t
tcagcagtagacgtcacgaccggtgctcgatttagtgtgagtagtttgggtttgggggagctacaacaggcaggcaggggcagcaagatgggtgttgcagacccaggtcttcatttctctgttgctctggatctctggtgcctacggggacatcgtgatgagcctagtttccagacctccctggctgtgtctcgtgggcgaggagggcccaccatcaactgcaagtccagccagtagttgttttattcggaccccaacaaataacaacttctaagcttaggtaccagacaagaaagtggacacgtccctactaaactctagatttacgnggtcttccggaccggntacgttccgggttaccaacgtnttcagttggctaggcggtcgtcgggactnttcacttcacacatccgagcacgcctgcgtaggtcgtagtaaacgagtggtacggtacttaggttttaacttacgttacgtactacgtaacctaacgttaacgtttaactttaccctttacgttttacccgtaccgttaaccggttttccggggaccgggtaaccggggtaaccggtaagggtacggtaacgtaacgtaaccggtaaacgtaacggttcggtcgggtacgtacgaccgtaaccttacttacgttcgtttccttacgtacccg

SEQ ID NO: 64285 - DNA, 812 bp, Homo sapiens
  misc_feature: GYAE6OF01AWY62.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtcgccgtacggggacatcgtgatgagcctagtttcccaggtacctcccgtggtcctggttcgtctcgtgggcgaggacggcccaccataccaacgtgacaacgtaccacgccgaggttagtttgttttacgttaccggacccccaaactaaactaaacctaaccttaaccgttaggtccgtttacggtaaccaagaccgaaaggtaaaacggtacggaccgtacggtaccccttaactaaaccgttccgtagttacctttacggtcggttacccgtttcccggtacccgggagttacccgggttccccgggtttaaccctaaaccgttattaccgtacggtttaccggccgtaggggtcccgggttacgtacggggtaccttaactttcccgaacgtttcccacgtacccctaatcgtacgcccgtacgtccgtagacccgtaggtacgtaacggtaagttacggtgggtacggttaacttggttttaaacgtccgtttagacgtaacggttactaaagttacgtttaactttccgtttacttccgttaccgttcggtttacccgggaggggaccgtaacgggttaggtacgtaaacgtacgtaaccggtaacgttaccggtggtacgtaccgtactaccgtactacgttaccgttcgttccgtccgtttacccg

SEQ ID NO: 64286 - DNA, 665 bp, Homo sapiens
  misc_feature: GYAE6OF01ACF42.31.78.H01.1.454.CMB.1.raw
  modified_base (146)..(146): a, c, t, g, unknown or other
  misc_feature (146)..(146): n is a, c, g, or t
  modified_base (335)..(335): a, c, t, g, unknown or other
  misc_feature (335)..(335): n is a, c, g, or t
  modified_base (533)..(533): a, c, t, g, unknown or other
  misc_feature (533)..(533): n is a, c, g, or t
tcagcagtagacgtcacgaccggtgctcgatttagtgtgagtagtttggtttggggagctacaacaggcaggcacgggcagcaagatggtgttgcagacccaggtcttcattctctgttgctctggatctctggtgcctacggganatcgtgatgagtcctagtttccagtacctcctggctgtgtactcgtggcgagacgggccaccgatccaacgtgaccaagtccagccagtagttgttttacttcggaccccacaagtaaccaactacttagccttaggtaccagtcagtaacgtaggacagtccctacctaaactccgtagatttaccgngggtccttaccggacccggggtctacggttcccgggggtttacctaaccggtactttaccgaggtttacggaccgtaacgggccgggttaccgtacggggtaacccgttaacttttcgaaccgttccgtaccaccgtattccggagaccgaacgtccctcgctacggctaggaagtacgtggtagacgttaaggtttntaacgtcgtacgacgtacaacgtattacttacgttcgttacgtacgtacgttcggacggtacgacgtaggtcgagtactacggaacctaggtaggtcgacgtacgcaacgtactagtcttcgtcgttacccg

SEQ ID NO: 64287 - DNA, 769 bp, Homo sapiens
  misc_feature: GYAE6OF01BZ26W.31.78.H01.1.454.CMB.1.raw
  modified_base (483)..(483): a, c, t, g, unknown or other
  misc_feature (483)..(483): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagacctccctggctgtgtctcgtgggcgaggacgggccaccatcaactgcaacgtccagccgaagtagttgtttttagtttccggacccctaaccaaactaacaaaccgttaccgttagtacctttacggtaacccaaggacgaaaggaaaaggtacggaacaccggtacccctacccttaaacctccttagtaacttttacggtcgggtccttaccggacccgggtctacggttccccggggtttaaccctaaccggtattcagttcggacgtacgggccgggtcgtcggggacctctttccacgttccnccgaccatcgacgcgacgtccgtcgcgcggtactaggaagtacgttgggtacggtactttaggttttaacgtacgttcgtaccgtaacgtacctaacgttacttttaacgttaccttttccggttttaccgtaccgttttaccgggtttcccgggaacggggtaacggggtaacccgtaaggggtacggtagtaacgttaaaacccggaaacggttaccggttaggtccgggtacgtaccgaccgtaacctacgttaccgtttcgttaccctttacccgttacccg

SEQ ID NO: 64288 - DNA, 853 bp, Homo sapiens
  misc_feature: GYAE6OF01AYL7S.31.78.H01.1.454.CMB.1.raw
  modified_base (523)..(523): a, c, t, g, unknown or other
  misc_feature (523)..(523): n is a, c, g, or t
  modified_base (603)..(603): a, c, t, g, unknown or other
  misc_feature (603)..(603): n is a, c, g, or t
  modified_base (703)..(703): a, c, t, g, unknown or other
  misc_feature (703)..(703): n is a, c, g, or t
  modified_base (739)..(739): a, c, t, g, unknown or other
  misc_feature (739)..(739): n is a, c, g, or t
tcagcagtagacgtcacgaccggtgctcgatttagtgtgagtagtttgggtttgggggtaggctacaacaggcaggcgaggggcagcaagatggtgttgcagaccaggtcttcatttctcttgttgctctggatctctggtgccgtacggggacagttcgtgatggagcctagtttccagtacctcccgtggctgtagtcgtcgtgggcgaggacgggcccacacgtcaaccgtgaccaacggtccagacccgaggtagttttaggtttttaacgtttccgggacccccctaacaaacgttaaaacctaaccgtttaactttaacggtccttttacggggaaccccaacggaaccgtaagggtaaaacggttacggggaacccaaccgggttaccccttaacctttaaaaccgtcccgttaagttaaccgttttacgggtccgggttaccctttacccgggtaaccccgggtccgtaacgggtttaccccccgggggttaaccttaacccggtatttaccggngtttaccgggctaacggggtcggggttcctacgggggaacccgtttctttaccgtacggtacccttaccgaacccgtacnccgttaacggccctaacggtaccccgtcgaccggtaaccggtcggtttacgaaaccgggtagtttcggtaccggagtttacgttaactttcgacgtctanactaaccgtttaattacgtttaaccgttctttaccncgtttaccggttcgggaaccggtacggtaacggtaggtaccggagtaaccttaaccggaagtaacggttggtccgagtaccgtacccacgttacttcgtcggttctgttacccg

SEQ ID NO: 64289 - DNA, 688 bp, Homo sapiens
  misc_feature: GYAE6OF01BI3SA.31.78.H01.1.454.CMB.1.raw
  modified_base (340)..(340): a, c, t, g, unknown or other
  misc_feature (340)..(340): n is a, c, g, or t
  modified_base (356)..(356): a, c, t, g, unknown or other
  misc_feature (356)..(356): n is a, c, g, or t
  modified_base (427)..(427): a, c, t, g, unknown or other
  misc_feature (427)..(427): n is a, c, g, or t
  modified_base (436)..(436): a, c, t, g, unknown or other
  misc_feature (436)..(436): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtcgccgtacggggacatcgtgatgagcctagtttccagacctcctggctgtgtctcgtgggcgagacgggccaccatacaactgacaacgtccagccagtagttgtttttagttcggcccctaacaaactaaaccaacttacgttacgtccgttggtaccagacaagaagtacgacacgcctacctaactcctagtacttcgnggtacttcgtaccggntacggtccggtactacgtatgtatcgcgacggtcggtcgtcggacgtacttcactctacacgtactcgacncacgtccgngcgacggtctaggaagtcgtcggtacgtcgttaagttttacgttactcggtacacgaacgttaactaatttacgtttacctttcgtttacctaaccgtttaccggtttccgggaaccggggtaccgggtaacggtaacggggtacgtaaaccgtacttaaaccggaaaaccggttacggttcgggtaccgtacggttaacccgaccgttaaccttcgttaaccgtttcgttacccgtttcccttaaccccgg

SEQ ID NO: 64290 - DNA, 758 bp, Homo sapiens
  misc_feature: GYAE6OF01BIF8R.31.78.H01.1.454.CMB.1.raw
  modified_base (737)..(737): a, c, t, g, unknown or other
  misc_feature (737)..(737): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtcgccgtacggggacatcgtgatggacgcctagtttccagacctcccgtggtctggtcgtctcgtgggcgaggcggccacatcaacgtgctaacgtccacgccgtagtagtttgttttagttcccggacccctaactaaataaacctaacgttacttacgtacgttacggtaacctaagaccgtaaggaaaacgtacggaacaccggtaccctaaccgtaaaccttccgtagtacgtttacgcggtccttacccggtacccgggtctacggttcccgggttacctaacgtacgttacgtacgtcggacgtacgggtcgggtacggtacggggttaacctacggtttaccacgttaccgtacctaaccgtactacggacgtaccgtaacgtcccgtacgcggtacggtcgtaacggtaacggtgtacggttaggtacgtttaggtttaacttccgtacggtactaacggtacttaaacgttactttaccgtttacgtttcccgtttaccgttaccttaccgggtttacgggaccgggtaaccgggacgttaagggacgtaacgtaacgtaacgaaagttcgtaggtcgctcgacccgtacncgttactcgttctgttacccc

SEQ ID NO: 64291 - DNA, 862 bp, Homo sapiens
  misc_feature: GYAE6OF01B0YHQ.31.78.H01.1.454.CMB.1.raw
tcagcagtagacgtcacgaccggtgctcgatttagtgtgagtagtttgggtttgggggagctacaacaggcaggcaggggcagcaagatgggtgttgcagacccaggtcttcatttctctgttgctctggatctctggtgtcgtacggggacatcgtgatgagcctagtttccagtacctcccgtggtctgtgtctcgtgggcgaggacggcccacatcaacgtgactaacgtcacgcctagtagtttgttttacgtaccggaccccaactaaactaaacctaaaccttacgtttacgtaccgtttacggaacccaggaacgtaaacggtaaaacggtaacggaaccaaccggtaccccttaaccctttaaaaccgttcccgttaggttaacctttaccggtcggggttaccttaccccggtaccccgggtacgttaccggttaccccgggggtttaaccctaaccgtactttaccgtaacggttcggaccgtacggggtcgggttaccggtacgggtaaccgttactttaaccgaccctacctacccgtaacctacgtaccgacggtacctaccgtcccgtacggacgtaacgggtccgtaagggaacgtaggttcggtacggttaccttttagttttaaccgtaccgttacgtaacgtaactaacgtaaacttaacgttttaacttttacccgtttacccgttttccggttaccgtttaccgggtttaccggggaccgggttaacgggaaccggttagggtacgggtactaaacggtaaaccggtaaaccggttacggttggtaccggtactccggtaacctaaccgttacgttacctttcgttcccttacgttaccccg

SEQ ID NO: 64292 - DNA, 703 bp, Homo sapiens
  misc_feature: GYAE6OF01CMZ0Y.31.78.H01.1.454.CMB.1.raw
  modified_base (674)..(674): a, c, t, g, unknown or other
  misc_feature (674)..(674): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactcccgtggctgtgtctcgtgggcgaggacggccaccatcaactgcaacgtccagccagtagtttcgttttagttccggaccccaaccaaataaaccgtaacttacttagtcttacggtaccagacaaggaaaggtacgacgacgtacctacctaaacctccgtagtactttacgtcggtccttccggtacccgggcgtaccggttcccggggttacctaaccgtacttacgacgtttcggacgtacgggtcgggtaccgttacgggtacccggttactttacctaccgttcccttaccgaaccctacgtaccgagtaccacggttccctcggaccgaggtccgtaaggtaaggtacttgggttaccggtactttaaggttttactacgttcgtactaacgtactaaactttagtttaccttacgtttctttacgtccttacggttcgggacggtacggacgtaggtcgaatacgtaacgtaacgtgtacggtgaccgttnacctaccttctacgttctaccttctcccg

SEQ ID NO: 64293 - DNA, 801 bp, Homo sapiens
  misc_feature: GYAE6OF01BTTK5.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgaggacgggccaccatcaactgacaagtccagccagagttgttttattcggccccacaataacaactacttagcttaggaccagacaaggaaagtaggacacgccctactaaacctcctagtactttacgtggtccttccgtacccgggctacggtccccggggtttacctaaaccggtattccgtagttcggacgcgggtccggggttacgtacggggtaaccccgttagttttacccaccgttcctaccctaaccctaagttacccgaacggtcctaaccgtccccgttaggcccgtaacgggtacccgtaagggtaaacgtaggttcgggttacgggtaacctttaacggtttttaacttaccgttacggtacctaacggtaaaccttaaacgtttaactttaaccttttaacccgttttccgttttacccgtacggtttacccggttttacccgggggaacggggttaaccggggaaacccgttaagggggtaccgtaaacgtaaccgttaaccggaaaaccggttaaccgttgggtaccggtacgttaccggacccttaaacgttcgttaaccgtttcgttccccgtttattaacccccg

SEQ ID NO: 64294 - DNA, 788 bp, Homo sapiens
  misc_feature: GYAE6OF01DYSYI.31.78.H01.1.454.CMB.1.raw
  modified_base (375)..(375): a, c, t, g, unknown or other
  misc_feature (375)..(375): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagacctcccgtggctgtgtctcgtgggcgaggacggccacatcaactgacaagtccagccagtagttgttttatccggccccaacaataacaactactagctgtaccagcaagaaagtggacacgtccctacctaaacctctagtactttacgcggtcctttccgtacccgggctacggttcccggggttaccctaaccggtntttcgagttcggcgtaggtccgggtcgtacggggaacccttgtttacccacgttcacccgaccctagttccaacggtccgacgtcccgtaggaccgtacgggtacgttacgaaaggttacgttaggtcgggttacgtttaagtttttaattaccgttacgtacctaaggtaacctaaacttaactttttaactttacccgttttacccgttttaccgttacccggtttaacccggttttcggggaacccggggtaacggggttaaaccccggtaaagggggttaggtaaaccgggttaaacgttaaaccccgggtaaaacggttaacccggttcgggtttacgggacccgttaccgggaaccccttaaccgtacgttttacgttcccgtttacccgtttccgttaacccccgg

SEQ ID NO: 64295 - DNA, 783 bp, Homo sapiens
  misc_feature: GYAE6OF01A48JI.31.78.H01.1.454.CMB.1.raw
  modified_base (751)..(751): a, c, t, g, unknown or other
  misc_feature (751)..(751): n is a, c, g, or t
tcagcagtagacgtcacgaccggtgctcgatttagtgtgagtagtttggggtttgggggagctacaacaaggcaggacaggggcagcaagatggtgtgcagacccaggtcttctagtttcctctgttgctcgtggactctcgtggtggaccgtacggggacatcgtagactgacgccctagtttccagtacctcccgtggctgtcgtactcgtagggccaggacggtcccaaccagtaccgaacgtgacctaacgtcccgagtccgaaggtagtttcgttttaaccgtccggaccccctaacgaaactaacctaacgttaacgttacgtaccgttacggtaacctacgtaccgaaggtaaagtcggtaacacgtaccctaacctaaccgtcctacgtacttaccgtcggtaccttccggtacccgggtctacggttcccggggttacctaaccgtacgtactaggttacggacgtacggtccgggtacgtacgggtacccttacgttaccctacctacctaacctaacccgtagttacccggacggtacgtaccggtaccgttacggaacgtacggtaccgtaaggtaaacggtagttacggtacggttacttacgggttttactacgtcgtaccgtaacgtacgttaaaccttattaccttacgttccttaccgttacgttaccggttaccgggacgggtaacggtaccgtaaggtgaacgtaactaacggaacgtaggtcggctacgtnacccgtacctacgtagtcttcctactaccccg

SEQ ID NO: 64296 - DNA, 791 bp, Homo sapiens
  misc_feature: GYAE6OF01DDKP8.31.78.H01.1.454.CMB.1.raw
  modified_base (386)..(386): a, c, t, g, unknown or other
  misc_feature (386)..(386): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctcgtggggcgaggagggcccaccatcaactgacaagtccagccagtagttgttttattcggaccccacaataaacaactacttagcttaggtaaccagacaagaaagtaggacacgcctacctaaacctcgtagtacgtttacgtcgggtcctttcgtaccccgggctacggttcccggggtttaccctaaaccgtnttacaagtttggccgaagggtccgggtcgttcggggaaccgttatttccaaccgttcctacctaacccgtattaccgaacggttacgtcccgttacggccgtaagggtccgtaaggaagttagttacggtacgggtacctttaaggtttttaagttaccgttagtactaacggtacctaaacttaatttttacgttaacctttttccgttttaccgttaccgttaccgggttttccggggaaccgggttaacggggtacccgttaaaggggttcgggaaacgtaccgttaaaccgtaaaaaccgggtaaccgtttaggggttacccgggtcttaacggaaccccgtaaacccggtttactttaccgttccggttttacccttacgttacccgttttaccccccgg

SEQ ID NO: 64297 - DNA, 739 bp, Homo sapiens
  misc_feature: GYAE6OF01AZDIA.31.78.H01.1.454.CMB.1.raw
tcagcagtagacgtcacgaccggtgctcgatttagtgtgagtagtttggggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtggggcgaggacgggccaccatcaacgtgacaagtccagccagagttgttttacttccggaccccacgaataacaacttacttacgtcttcggtaccagcgaagaaagtacggacacgccctacctaacctcctgactttaccgtcggtccttaccgtacccgggctaccgttcccggggttaccctaaccgtattcacgttcgggccacgggtccgggtcgtcggggtaacccgtctttaccgtaccgttcctaccctacccgtaactcccgaacgtccgtacgtacccgttcggccgaacgggtcgttaaacggaaggtacgttagggtcggacttaaggtttttactttacgtcgttacgaagtacctaaatattttaaccttactttccgttttccgtaccgttaccggtttccgggaaccgggtaacgggtacccgtaaggggtaggtaacggtaacgttaaaccggaaaccgttaacgttgggtccggtacgtaccgacccgtacgttacgttccgttaccgtttcttaccgttaaccccg

SEQ ID NO: 64298 - DNA, 838 bp, Homo sapiens
  misc_feature: GYAE6OF01DZUMB.31.78.H01.1.454.CMB.1.raw
tcagcagtagacgtcacgaccggtgctcgatttagtgtgagtagtttggggtttgggggagctacaacaggcaggcaggggcagcaagatggtgttgcagacccaggtcttcatttctctgttgctctggatctctggtcgccgtacgggactagttcgtgatggacgccttacgtttccaacgtcctcccgtggtctggtcgtctcggtgggcggaggaccggccaccgtatacaacgtcgactacgtccgacgtaccgtagttagtttcgttttacgttccggacccctaaactaaacttaaccaaccttacgttaacgtacgttaacggtaccaggtaacgaagtaaacggtacggaacctacgtacccttaaccttaaccgttaccgttaggttaacctttacggtccgggttacccttacccgggtaacccggtccgttaaccggggtttaccccgggtttaacccgttaaaacccgttcgtttacgtaaccggggttaccggacgttaccgggggtacccgggttaccgggtaccgggggttaacctttaacgtttaccgtacccgtccgttaacccgaccttagtacccgagacccgtaacggtccacggtccggagggttactacggtaaacgacggttgtacggttaacgttacgttttaactcggtactagtaactaacttaacgtttaacttacgtttaaccttcgtttaccgtacgtttccgggtacgggtaccgggtaaggtacgtagggtaactaggtaaacgtacgtaaagtacgtggtacgcgtacctacgttacacgtttaggttccttactcgttacccg

SEQ ID NO: 64299 - DNA, 777 bp, Homo sapiens
  misc_feature: GYAE6OF01AD1QL.31.78.H01.1.454.CMB.1.raw
  modified_base (539)..(539): a, c, t, g, unknown or other
  misc_feature (539)..(539): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtcgccgtacggggacatcgtgatgacgcctagtttccagacctcccgtggctgtcgtctcgtgggcgaggacggcccaaccatacaacgtgacaacgtccacgccgagtagtttcgttttacttccggaccccaactaactaaacctaacttacttagccgtttacggaaccagacgaaggaaaacgtacggaacctacgcccctaaccttaaaccttcctagttacgtttaccgtccggggtacctttacccgggaccccgggtacgtaacccggttccccggggttaaccctaaccgttacttaccgtaggtttccggacggtacgggtccggggttccgtacggggtaccttacctttccgtaactcccgtacctaccaacgtcgacgtccacgtccgngtacggacggtacgttacgaaagtcggtaggttacggtacttttaagtttacttacgacgtaaccgtacgtaacctaaactttacgtttaactttacccgtttcgtttacccgggtcgttaccgggttcgggacgggaacggtaacgtaaggtcgtaaacgtaacgaacgtaaacgtcgttcgggcggtaccctagtacccttacgtacttccgttaccggttcttaacccgtccccg

SEQ ID NO: 64300 - DNA, 645 bp, Homo sapiens
  misc_feature: GYAE6OF01CUACA.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagttcagactcctggctgtgtctcgtgggcgagacgggccaccatcaactgcaagtccagccagtagttgttttacttcggaccccaacaataacaactacttagcttacggaccagacaagaaagtaggacacgcctacctaaacctcctagtatttacgtgggtccttccgtacccgggctacggtcccgggttacctaaccgtcttctagttcggcgtaggtcggggtcgtacggggtacctacgtttcaacctcctacacctactcgaacgcacgtccgtacggacgaggtctaggaacgtagttggtacggtactaagttttacgttacgtacgtcgaacgtactaaacttactttaacttactttccgttttaccgtcgttaccggtttcgggacgggtacgggtaccgtagggtaggacgtataacgaaacgtagtcggtcgactcgactacctcttacttcgtcttcgtacccg

SEQ ID NO: 64301 - DNA, 668 bp, Homo sapiens
  misc_feature: GYAE6OF01AK1ZK.31.78.H01.1.454.CMB.1.raw
  modified_base (634)..(634): a, c, t, g, unknown or other
  misc_feature (634)..(634): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgtttttactttcggcccccactaataacaacttacttagcttaggtaccagacaagaaagtaggacagccctacctaactcctgtatttacgtgggcctttcgtacccgggctacgtcccggggtttaccctaaccgtatttcagtttcggactacggtcggggtctcggggaccttatttccgactctaccacctatccgacgcacgtcctgcgtaggctaggaagtgtggtacggacttaaggtttttacttaccgttggtacctaacgtaccgtaaactacttttaacttacccgttttaccttttccgttaccttaccgttttccggggacggtaaccggggtacccgtaaagggtcggtaagacgttaacccgaaacggtacttaggtcgggtaccncggtaccacccttctacgttcgttcttcgtaccg

SEQ ID NO: 64302 - DNA, 690 bp, Homo sapiens
  misc_feature: GYAE6OF01B65X7.31.78.H01.1.454.CMB.1.raw
  modified_base (231)..(231): a, c, t, g, unknown or other
  misc_feature (231)..(231): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctcgtgggcgagagggccaccatcaactgcaagtccagccagngttgttttattcggccccacaataacaactactagcttgaccagcagaaagtgacagcctacctaactcctagtatttacgtgggtccttcgtacccgggctacggttcccggggttaccctaaccggtatttaccgagtttcggaccgaggtccggggtcgtacggggacccgttaagtttccaaccgttcctaccacctactaccgacgccgaacggcccgtaggccgaggtaccgtaggaaacgtagtcgggtacggtacgttaagttttactacgtcgtacgtacgtactaaactacgtttaacttacctttccgttttacgttaccgttacggttttccgggacgggtaacgggaaccgtaaggggttcgaacgtaacgtaaccgtaaaacggtacgttagggtcgaccgtacggaccctaactacgtttaccgtcgttcccgttaccgtaccg

SEQ ID NO: 64303 - DNA, 745 bp, Homo sapiens
  misc_feature: GYAE6OF01BKZIX.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggccccacaataacaactacttagcttggtaccagcagaaagtaggacagccctacctaaactcctagatttacgtcgggtcctttccgtaccccgggtctacgttcccgggggttaccctaaccggtatttcgtagtttcggcacggtccggggttccgtgggggtaaccccgtagttttccaaccgttcctaccaaacctactaccgacgtaccacggtcccttaggaccgtacgggactaggaaagtacgttggtcggacttaaggttttaacttaacgttcgtaccaaggtacctaaaccgttaagttttaacttaaccttttccgttttaccggttacccttaccggttttaccggggaccgggtaacgggtaacccgtaaaggggttcgggtaaacgtaacgttaaccgaaaacggttaaccgttacgggttaccgggaccgttcggaccccttaaacccgttacgttcccgttacggtttccctttcgttaaccccg

SEQ ID NO: 64304 - DNA, 667 bp, Homo sapiens
  misc_feature: GYAE6OF01APOQE.31.78.H01.1.454.CMB.1.raw
  modified_base (392)..(392): a, c, t, g, unknown or other
  misc_feature (392)..(392): n is a, c, g, or t
  modified_base (425)..(425): a, c, t, g, unknown or other
  misc_feature (425)..(425): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctcgtggtcgccgtacgggacatcgtgatgacgcctagttccagcctccgtgctgtcgtcgtcgtgggcgaggcggccactatacaacgtgacacgtccgacgctagtgtttgtttacgtccgaaccccaacgtaactaacctaacttacgttacgtcgtacgtacagacgaagtaagtacggactaccgtaccctaacgtaactctagtacttcggcggtaccgtacccgaccggtctacggttacccggttaccacgtnttctagtcgcgtcggtcggtcgcgtactcttcncgtcacgacagcacgcgactccgtagcgtacgtactagagtcgtgtacgtacgtttattacgtcgtacgatactaataacgtttacttcgtttaccttcgttccgtaacggttaccggttacgggaccggtaaggtaccgtaagggtacgaaacgttaaccgtacgggtaaaccgttggtacggtccgtaccgtaccgtacccgttaactcgtttacgtcccttacgtacccgttaccccgg

SEQ ID NO: 64305 - DNA, 902 bp, Homo sapiens
  misc_feature: GYAE6OF01C6ZJH.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagttccagactccctggctgtgtctcgtgggcgaggacggccacatcaactgaccaagtccagcctagtacgttgttttatcggaccccacaataacactacttagcttgtaccagcaagaaagtaggacagacctacctaaaacttcctgtactttaacgtcgggccttaccgtacccgggctaacggtacccggggttaccctaaaccggttacttcgaactttcgggacctaacggtcgggggtaccttcgggggaacccgttaatttcccgtaacctccgttaacccgaacctacgttacaaccgggttccaacggcccgttacggacgtaacgggaccttagggtaaacgtaacggtttagggttcgggtaccctttaaagggtttttaaccgtttaccgttacgtccggtttaaaacggacccgtaaaacgttttaaacgttttaaacctttaacccgttttttttaccccgtttacgggttttaacccgttaacccgggttttttaacccgggggaaccccggggttaacggggggtaaaacccccgttaaaagggggggttttaccggaaaacggtaaacccggtttaaaacccggtaaaaaccggggttaaaacgtttccccgggggtttacgggtacccgggttaaacccttaccccggttaaaccccggtttaaacttacccccgggttttaccggtttaaacccgtttttcccctaaaaacccggg

SEQ ID NO: 64306 - DNA, 868 bp, Homo sapiens
  misc_feature: GYAE6OF01CMLI5.31.78.H01.1.454.CMB.1.raw
  modified_base (657)..(657): a, c, t, g, unknown or other
  misc_feature (657)..(657): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgacgcctagttccagacctcccgtgctgtgtctcgtgggcgagacggccaccatacaactgacaacgtccagccgagtagtttgttttacgttccggacccctaaccaaaacttaaacctaaaccttacgttaacgtaccgtttacggtaacccaaggaccgtaaaggtaaaacggtacggaaccacggtaccccttaacccgttaaaacctccgttaggtaacttttaccgtcggggtacctttacccggtaaccccgggaccttacgggttacccccggggttaccctaaaccggtactttaccgtacggtttcggaccggtaacggggtccgggggttaccgtacgggggtaacccgttaacgttttcccaccgttacccttaccaacccttacgtaccgaacggcccgaaccgtcccgttacggaccggtagggtaccgtaaggtaacggtaacgttgggtacgggtacctttaagtttttaacttaaccggtnttaaccgaacggttaccaaaacgtttactttaaacccgttttattttacccggttttaccgtaacccggtttcgggtttacccggggacggggttaaccgggtaaccgtaaaggggtcggaaagttacctaaaacgggaaaccgttaggtcggggttacgcgtaccgaaccgtaaaccttcggttagtttacccgttcttcccgtaacccg

SEQ ID NO: 64307 - DNA, 802 bp, Homo sapiens
  misc_feature: GYAE6OF01EMXIR.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttctatttctctgttgctcgtggtatctcgtggtcgccgtacggggacagtcgtgatgagtcctagtttccagacctccctggctgtgtctcgtgggacgaggacggccaccatcaactgacaacgtccacgccagtagttgttttacgtcgaccccaactaataacctaacttactagtacgttacgtaccagacgaagaagtacgacacgtacctacctaactctagtacttacgtcgggtcctaccggtacccggtcgtaccggttcccgggtttaacctaaccgttactttaccgagttcggacgacggggtccggttacggtaccggggtacccttactttccgaccttcctacctaacctagtccaaggcctaccgtcccgtacggacgtacgggtaccgtaaggtaacgtaggttacgggttacggtacgtttaacgttttacggttaccgttacgttaccgtaacgtaaccttaaacgtttaacttttaccttaaccgtttttacccggtttacggttacccgtttaccgggtttacgggggaacccggttacgggtaaaaccggtaggggttaacgggtacctaaacggttaacggtaaaaaccggttacggtacgggttcggacccgtacgaaccccgttaacgttacgttacccgtttccggtttaaccttcccggttacccg

SEQ ID NO: 64308 - DNA, 758 bp, Homo sapiens
  misc_feature: GYAE6OF01A1SZL.31.78.H01.1.454.CMB.1.raw
  modified_base (409)..(409): a, c, t, g, unknown or other
  misc_feature (409)..(409): n is a, c, g, or t
  modified_base (580)..(580): a, c, t, g, unknown or other
  misc_feature (580)..(580): n is a, c, g, or t
tcagcagtagacgtcacgaccggtgctcgatttagtgtgagtagtttgggtttgggggagctacaaacaggcaggcaggggcagcaagatggtgttgcagacccaggtcttcatttctctgttgctctggatctctggtcgccgtacggggacatcgtgatgagcctagtttccagtacctcccgtggcttgtgtctcgtggggcgaggacgggcccaccagtaccaaactcggaccaacggtcccgacggacctaaggtagtttggtttttacgttccgggaaccccctaaaccaaattaaaccgtaaaccttacgttacgtccgttagtacccagaccgaagtaaagacggacacgtacctaacctaaactctagtactttacgtcgggtccttccggtacccggtntaccggttacccgggttacctaaccggtacttcgtagttcgacgagcggggtcgtacgggtacctactttaccgactcccgtacacctgtacgtcgaccgtacgcccgtaggaccgtacggtaccgtaagaaggtacgtgggtcgtactttagtttaactcgtcgtactanaccgttaattactttaattaccttttccgttacggttaccgtacggtttacggggaccggtaacggtaacggtaagggttacgaacgtaccgttaaaccgaaaggttacgtagggttccgaacctacgggtcccctaaacctttcgttaccgttcgtttaaacccgttccgtaacccg

SEQ ID NO: 64309 - DNA, 686 bp, Homo sapiens
  misc_feature: GYAE6OF01CEZ87.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagacctccctggctgtgtctcgtgggcgaggacggccaccatacaactgacaacgtccagaccagtagtttgttttacgttccggaccccaacctaaataacctaacttacgttacgtcgttacggtaccagacaaaggtaaaggtacggactacgacccttaacctaaacctcctagtactttacggtcggtccttccgacccgggctacggttccccgggttacctaaccgtacttcgtaagttcggcgtacggtcgggtcgtacgggtaacctcgtttaccacctcctaccacctacgtcgacgcacgtcctcgtacgacgtcaggtaagagttggtacgtacgttagtttactacgtacgtactaacgactaacgtatttacttacctttcgtttacgttcgttaccggtttacgggacgggtacggtaaccggtaagggtcggtaacgaacgttaaccgaaacgtgtacggtacgcgtacgactaactctcgttccttctacgttacccg

SEQ ID NO: 64310 - DNA, 760 bp, Homo sapiens
  misc_feature: GYAE6OF01D0HJK.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagaactcccgtggctgtgtctcgtgggcgaggcgggccacgactacactgacaacgtccagccagtagtttgttttacgttccggaccccctaacaaataacctaacttacttagtaccgttacggtaccagacaagaaacgtaggaccacgtacctacctaacctccgttagtactttacggtcggtccttaccggtacccgggtactaccggttaccccggggttaccctaaccgtacttacgtacgttcggaccgtacgggtccgggtacgtacggggtaacccgttactttcccgaccttcctaccgacccgtatccgaacgccacgtcccgtagccgaggtcgtaagtaacggtagtcggtacggttactttaacggttttacttacgttcgtaacgacggtaacttaacgtttaacgttttactttaccgtttaccgttttaccgtaaccgtttacccgggttaccggggaacgggttaaccgggtaaccggtaagggtacggacgtaacgtaaccgtaaacggtacgttgggtccgactcgaaccccgtctaacgttccgttacttccttaccgttacccg

SEQ ID NO: 64311 - DNA, 802 bp, Homo sapiens
  misc_feature: GYAE6OF01D0RPX.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctcttgttgctcgtggatctctcggtgccgtacggggacagtcgtgagtgacgcctagttccagacctcccgtggtctagtgtcgtcgtgggacgaggacggtaccacctataccgtaacgtgaccaacgtcccgaagccgtaaggtacggtttagttttacgtttacccggacccctaacgtaaacgtaaacctaacgttaacgttacgtacgtttaccgggtaacctaacggaacaaaggtaaacggtaacggaacctaccgtaccgttaaccgttaaaccttaccgttaacgtttacgtacgggttaccgttaccgtaccgggtactaccggtttcccggggtttacctaaccggttacgttcgaacggtcggacgtacgggtcggggtaccgttaccggggactttacgttacctacccgttccgacgaacctactaccgtaggtacccacgggtccctacggcggtacggtacgtaacggaagtacgttaggtacgtagtttaacgtttactacgtacgtacgtaacgtacgttaacttacgttactttacgttaccgtttacgtacccgttacgggttaacggcggtaacggtacgagggttacgaaacgtactaaccgtaacggtcgttagcggtacgtccgtactacgtacgttacgttacgttctctaccggttcccg

SEQ ID NO: 64312 - DNA, 930 bp, Homo sapiens
  misc_feature: GYAE6OF01CHHZ2.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacagtcgtgatagacgcctagtttaccagtacctcccgtggctgtcgtctcgtgggcgaggacggaccaaccagtcaacgtgacaagtccagccagtagtttagttttacgtccggacccctaaacaaacttaaacctaacttacttaacggtacctttacggtaaccaaggacgtaaaggtaaaacgtacggaacctacgtacccttaacctaaccgttccgtaagttacgttttaccgcggtcctttaccggacccgggtctacggttacccgggtaaccctaaacgtcttacgtagtcggtacgacggggtacgggtacgtacgggtaaccttagtttaccacgtccttaaccgaactacgtacgacgctaccggtcctaggaccgtacggtaacgtaacggtaaacgtaggttacggttacgggtaacctttaaggtttttacgtaacccgttacggttaaccgtaaaccgttaacgttaaaaacccgtttattttttaaacccgtttaaccgttttttacccggtttacccgttaacccggttttaaacccggggtttaaccccgggggtaaaccggggttaacccggggttaaaccgggttaaaacgggggtttaacggggttaaaacccgtaaaccggtttaaaaccggtaaaacccggggttaacggttacggggtttacccgggttaaaccggttaccggtaacccccttaaaacgggttacccttttaccgggtttaaaccgtttaccccgtttaaccggttaaacccccg

SEQ ID NO: 64313 - DNA, 802 bp, Homo sapiens
  misc_feature: GYAE6OF01B9EK4.31.78.H01.1.454.CMB.1.raw
tcagcagtagacgtcacgaccggtgctcgatttagtgtgagtagtttgggttgggggagctacaacaggcaggcaggggcagcaagatggtgtgcagacccaggtcttcatttctctgttcgctctggatcgtcgtggtcgccgtacggggacagtcgtgatgacgcctagttccagtacctcccgtggctgtcgtctcggtgggacggaggacggccaacctataccaactcgacaaacgtccgacgaccgtaaggtacgttttacgttttacgttcccggacccctaaactaaacttaaacctaaaccttaacgttacggtcgttacggtaaccacgaaccgtaaaggtaaacggtacggacctacggtaccctaaaccgtaacctccgttagttaacgtttaccggtacggtacccgttcccgggtaacccgggtaccgttaccgggttacccggggtttaaccctaaccgggttcttaccggttaacgtacgggcgtaacggggtcgggtacgtaccgggtacgttacgttactccgtactacctactacgacgacgcctacgcgtcggacgtacggtacgtaagtaaggtgttacggtacgtaacgtttagttaaccgtacgtacgtaaccgtacgtaacttaaccgtattttacccgtactttccgttacgtacccggttacggttacgggaccggtaaggaacgtacgggtactaacggtaacctacggtaaacgtaggtacggtccgaacgttacccgacgtacctacgttactccgttaccgttactaccccg

SEQ ID NO: 64314 - DNA, 678 bp, Homo sapiens
  misc_feature: GYAE6OF01D0883.31.78.H01.1.454.CMB.1.raw
  modified_base (248)..(248): a, c, t, g, unknown or other
  misc_feature (248)..(248): n is a, c, g, or t
  modified_base (386)..(386): a, c, t, g, unknown or other
  misc_feature (386)..(386): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagtttccagacctcccgtggctgtgtctcgtgggacgaggacgggcccacctatccaaactgacaacgtccagaccagtagttnttttattcggaccccaactaaataactaacttactagcgttacggtaaccagacaaggaaagtaggacacgtacctacctaaactcctagtactttacgcggtcttccgaccggctacgttccgggttacctaacgtnttcgacttggactacggtcggtcgtacgggtacgtactttccgacttcctaccaccgtactacgacgccgacgtcctacgacgtaggacgtaggaaacgagttggtacggtacttaaggttttactacgttacggtacacgtaactaacgttaatttaactttacctttccgtttacgttaccgttaccggttttcgggaacggggtaccggtaacgaagggtacggaagtaacgtacgaaacgtacgtggtcggtcgtacaccgtacttactacgttcgttcttcgtaccc

SEQ ID NO: 64315 - DNA, 559 bp, Homo sapiens
  misc_feature: GYAE6OF01CG9ZN.31.78.H01.1.454.CMB.1.raw
  modified_base (312)..(312): a, c, t, g, unknown or other
  misc_feature (312)..(312): n is a, c, g, or t
  modified_base (412)..(412): a, c, t, g, unknown or other
  misc_feature (412)..(412): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacaactacttagcttggtaccagcagaaagtaggacagcctcctaaactcctgatttacngggcttctacccgggcagtccgggttacctaaccgattcattggcagcgggtctgggaccgtatttcactctacaccatcagcagcctgcaggctgaagntgtggctagtttatactgtcagcaatattatactttctttcgtactacgtttcggacggtaggaacccgaagggtcggaagtaacgtacgaaaacggtattaggtcggactggaccaacccgtattcccgttggttccttcgtaacc

SEQ ID NO: 64316 - DNA, 621 bp, Homo sapiens
  misc_feature: GYAE6OF01BW3MO.31.78.H01.1.454.CMB.1.raw
  modified_base (398)..(398): a, c, t, g, unknown or other
  misc_feature (398)..(398): n is a, c, g, or t
  modified_base (438)..(438): a, c, t, g, unknown or other
  misc_feature (438)..(438): n is a, c, g, or t
  modified_base (443)..(443): a, c, t, g, unknown or other
  misc_feature (443)..(443): n is a, c, g, or t
  modified_base (472)..(472): a, c, t, g, unknown or other
  misc_feature (472)..(472): n is a, c, g, or t
  modified_base (569)..(569): a, c, t, g, unknown or other
  misc_feature (569)..(569): n is a, c, g, or t
  modified_base (602)..(602): a, c, t, g, unknown or other
  misc_feature (602)..(602): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagacctccctggctgtgtctcgtgggcgaggacgggcccaaccagtaccaactcgacaacgtccaaggcccaggtagttgtttttacgttccggaccccctaacaaataaccaactacttagtcgttacggtaccagaccaagaaagtaggaccagtaccctacctaaactcctagtactttacgtcgggtcttccgaccgggctacgttccgggttacctaacgtntcgtagtgcgagcggtcgtcggacctgttcactctacacngtacngcacgtccagcgagctagagtgtgtcgtntagtttatacgtatcgacgtactaacttactttaacgttctttaccgtttctacgtaccgttacgggacggtacgggacgtaagggtacgacgtaanaccgtaaacgtcgtggtcgactcgaccttacgnttaccgtcgtctactcccg

SEQ ID NO: 64317 - DNA, 939 bp, Homo sapiens
  misc_feature: GYAE6OF01EH3UR.31.78.H01.1.454.CMB.1.raw
  modified_base (194)..(194): a, c, t, g, unknown or other
  misc_feature (194)..(194): n is a, c, g, or t
  modified_base (911)..(911): a, c, t, g, unknown or other
  misc_feature (911)..(911): n is a, c, g, or t
tcagcagtagacgtcacgaccggtgctcgatttagtgtgagtagtttgggtttgggggagctacaacaggcaggcaggggcagcaagatggtgttgcagacccaggtcttcattttctctgttgctctggatctcgtggtcgccgtacggggacatcgtgatgacgcctagtttccagtacctccgtggctgtntctcgtggcgagcggccacatacaactgaccaagtccacgaccagttacggtttgtttttacgttcccggaaccccctaactaaacttaaacctaaccttaacgtttacggtaccgtttaacggtaacccgaacgtacgaaaaggtaaaacggttacggaacctaacgttacccccttaaacccgttaaaccgtttacccgtaacggtttaaccgttttaccgggttacgggttacccgttttaccccgggtaacccccggggtactttaccccgggttttaccccgggggggtttaaaccccttaaaacccgggtttcgttaaccgttaacggggttccgggtaccgtaacggggggttcccggggttaaccgggttaccggggtaacccgttttacgttttacccacccgttttaccccgaccgtaaaccctaacggtttcccaaacgggcctaacccggtacccgttacgggtacgtaacgggtaccgtaaagggtaaagttcgggttacgggttaacggtacgttttaaacggttttagttaaccgttcggtaacctaacgttaacgttaaacctttaattttaacccgtttactttttaccgttaccggtttaccttacggggtttacgggaacggggtacgggtaaccggtaaaggtcgtaaagaaacgttaacggtaaacggtcgttagccggtctacccagttaacccngtttacgtacctttactcccgtaacccg

SEQ ID NO: 64318 - DNA, 755 bp, Homo sapiens
  misc_feature: GYAE6OF01D69SJ.31.78.H01.1.454.CMB.1.raw
  modified_base (377)..(377): a, c, t, g, unknown or other
  misc_feature (377)..(377): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagtttccagacctccctggctgtgtctcgtgggcgaggacgggccaccagtcaactgacaagtccagccagtagttgttttattccggaccccaactaaataacaaaccttacgttagccgtttacggtacccaggacaaaggaaagtacggaactacgtccctaacctaaacgtcctagtactttacgtcgggtacctttccggacccgggntaacggttccccggggttacctaaccggtattccgtagttacggcacgggtcgggttccgtaggggaacccttagtttccactttcctaccgaacctatcgaacgtcgaaccgtcccgtagaccgacggtactaggaacgtagttggtacggtacttagtttaacttacgtgtaccagtaacctaaattacgtttaacttaccgtttccgtttacgtaccgttaccggtttaccggggacgggtaaaccggggtaacgttaacggggttacgggtaacgttaaccgaaacggtaaaaccgttaaggttcgggtacggtacccgttcggaaccccgtaaccttacgttaacccgttcggtttcccgtaaccttaccccg

SEQ ID NO: 64319 - DNA, 739 bp, Homo sapiens
  misc_feature: GYAE6OF01CQV8S.31.78.H01.1.454.CMB.1.raw
  modified_base (403)..(403): a, c, t, g, unknown or other
  misc_feature (403)..(403): n is a, c, g, or t
  modified_base (510)..(510): a, c, t, g, unknown or other
  misc_feature (510)..(510): n is a, c, g, or t
tcagcagtagacgtcacgaccggtgctcgatttagtgtgagtagtttgggttgggggagctacaacaggcaggcaggggcagcaagatggtgttgcagacccaggtcttctatttctctgttgctcgtggatctcgtgggtcgccggtacggggactatcgtgatgacgcctagttccagtacctccgtggtctgtgtctcgtgggcgaggcggaccacctatacaactgacaacgtccagtactaggttagtttcgttttacgtaccgaccccaaaccgtaaataaacctaaccttaacgttacgtccgttacggtaccagaacgtaacggaaagtacgaacacgtaccctaccttaaacctcgtagttacttacggtcggtaccttaccggtaccccggtnttaccggttacccgggttaccctaacgtacgttcgtacgttcggacgtacgggtccgggtcgtaccgggtaacttcgtttccaccgttacctaccgtactacgtacncggtacacggtccgtggaccgtaggtcgtaaggaacgttgtacgggtacgtagtttacgtttaactacgtagtacgtaagtaacctaacttactttaactttaccgttttccgttacgttaccgtaccggtacgggttacgggaacggtaacggtacggtagtaacgaagttaaccgaacgtcgttacggcgtactacgactacgtattccttagtcccgttactaccg

SEQ ID NO: 64320 - DNA, 667 bp, Homo sapiens
  misc_feature: GYAE6OF01D2RQE.31.78.H01.1.454.CMB.1.raw
  modified_base (371)..(371): a, c, t, g, unknown or other
  misc_feature (371)..(371): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagtttccagacctcccgtggctgtgtctcgtgggcgagacggcccacatcaactgacaacgtccagccgagtagttgttttagttccggaccccctaacaaactaaacctaaccttaacttagtccgttacggtaaccagactaaaggaaagtagaccacgtccctacctaaactctagtactttacgtgggtccttccgacccggntaccggttcccgggtacctaaccgtattactagttcggacgtacgggtcgggtacgtacggggtaccgttatttccgactcgtactactagtcgagcacgtcctgacgaggtctaggaacgtgtggtcgtactttaagtttacttacgtcgtacacgtactaactactttcttaacgtttcttacggtacttacggttccgggacggtacggaaccgtagggtacgacgtaagtaaccggaaacgttatcgggtcgtacctcgtaccgtaccttagttccgttcttcctctacccg

SEQ ID NO: 64321 - DNA, 637 bp, Homo sapiens
  misc_feature: GYAE6OF01A5ODB.31.78.H01.1.454.CMB.1.raw
  modified_base (216)..(216): a, c, t, g, unknown or other
  misc_feature (216)..(216): n is a, c, g, or t
  modified_base (234)..(234): a, c, t, g, unknown or other
  misc_feature (234)..(234): n is a, c, g, or t
  modified_base (246)..(246): a, c, t, g, unknown or other
  misc_feature (246)..(246): n is a, c, g, or t
  modified_base (258)..(258): a, c, t, g, unknown or other
  misc_feature (258)..(258): n is a, c, g, or t
  modified_base (337)..(337): a, c, t, g, unknown or other
  misc_feature (337)..(337): n is a, c, g, or t
tcagcagtagacgtcacgaccggtgctcgatttagtgtgagtagtttgggtttggggagctacaacaggcaggcaggggcagcaagatggtgttgcagacccaggtcttcatttctctgttgctctggatctctggtgccgtacggggacatcgtgatgagcctattccagacctccctggctgtgtctcgtgggcgaggacggccacatcaactncaacgtcagccagtgttntttatcgcccanaatacacttatnctaggaccagcaagtaaagtcggacacgtaccctacctaactccgtagtactttcgtcgggtctttaccggacccgggntaccggtccgggttaccctaacgtcttcagtggcgacggtcggtagcgggtaacctttaccgctaccgcaacgtgtaccaagccgtacgtccgtagcgtagcgtaagaagtgtacgtcggacttaggtttactacggtctacgatacgtaattaacttacgttacttctttaccgtacgttaccgttacgggacggtaacgggtacgacgggttacgaaggtaacccgtagtaaaacccggtgtacgggtcggtacctacggtacctacccagtttaccgttcgtaccgttcgtacccgg

SEQ ID NO: 64322 - DNA, 640 bp, Homo sapiens
  misc_feature: GYAE6OF01C00FL.31.78.H01.1.454.CMB.1.raw
  modified_base (143)..(143): a, c, t, g, unknown or other
  misc_feature (143)..(143): n is a, c, g, or t
  modified_base (340)..(340): a, c, t, g, unknown or other
  misc_feature (340)..(340): n is a, c, g, or t
  modified_base (385)..(385): a, c, t, g, unknown or other
  misc_feature (385)..(385): n is a, c, g, or t
  modified_base (452)..(452): a, c, t, g, unknown or other
  misc_feature (452)..(452): n is a, c, g, or t
  modified_base (580)..(580): a, c, t, g, unknown or other
  misc_feature (580)..(580): n is a, c, g, or t
tcagcagtagacgtcacgaccggtgctcgatttagtgtgagtagtttgggtttgggggagctacaacaggcaggcaggggcagcaagatgggtgttgcagacccaggtcttcatttctctgttgctctggatctcgtgggtcnccgtacggggacatcgtgatggacgcctagtttccagacctccctggctgtgtctcgtgggcgaggcggccaccatcaactgacaacgtccagccaggtacgttgttttacgtacggccccaactaaataaacctaacttaacgttacgccgttacggtaaccagacgaagaaagtagacacgcctacctaactctntattacgcggtcttcgaccggctacgtccgggttacctaacggtnttcacgtcggacacggtcgggtctacggggactagttaccacgtctaccaccatcacgtcacgtccngaccgtagcgtagaacgtagttacggtcggtattaacgtttacttacgtcgtacagacctaattacttacttacctttcttacgtcttacggttccggacgggtacggacgtaagggtagacgttaanaacccgaaacggtctcgggtagccgtacgcttaaccgattccggtacttcgttcctaccg

SEQ ID NO: 64323 - DNA, 789 bp, Homo sapiens
  misc_feature: GYAE6OF01AH255.31.78.H01.1.454.CMB.1.raw
  modified_base (179)..(179): a, c, t, g, unknown or other
  misc_feature (179)..(179): n is a, c, g, or t
tcagcagtagacgtcacgaccggtgctcgatttagtgtgagtagtttgggtttgggggagctacaacaggcaggcaggggcagcaagatggtgttgcagacccaggtcttcattctctgttgctctggatctctggtcgccgtacggggacatcgtgatgagccagtttccagactccnggctgtgtctcgtgggcgaggacgggaccaaccatacaactcggacctaacgtacccagacccaggtagtttcgtttttacgttccggacccccaacaaataacaaacttacttacgtcttacggtaaccagacgaagtaaaaggtacggaccacgtacccttacctaaaaccgtccttagtaactttaccgtcgggtaccttacccggacccgggtcgtaccgggtttcccggggttacccttaacccggtaacttcgtaacgttggaccgacgggtccgggttcggtacggggacccttacgtttccgaaccttccgtaccacctactccgacgccgtaccgcccgtggaccgtacgggaccttaggaaacggttggttacgggttacggtaccgtttaggttttaattaacccgtgtaaccctagtaacctaactttaacttaactttaccttttcgttaccggttaccttacccgggttcggtacggggtaccgggtaaccggtaggggttacgaaacggttacgtaaaccgtaaacggttaacgtgggtaacccgggtctaaccggacctaacctacgttcccgtacgtttcccttacgtacccg

SEQ ID NO: 64324 - DNA, 862 bp, Homo sapiens
  misc_feature: GYAE6OF01EHMOC.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacgggacatcgtgatgagcctagttccagacctcccgtggctgtgtctcgtgggcgaggagggccaccatcaactgacaagtccagccaggtagttgttttattcggaccccaactaaactaaccaaacttacttacgtcgttacggtaaccagacaagtaaaggtacggaacacgtaccctacctaaacctcctagtactttacggtcggtccttaccgtacccgggtctacggttcccggggttaaccctaccgtacttaccgtagttcggacaacggggtcgggttacgtacgggtacccgttacgtttaccaccgttacctaccgaaccctacgtaccacggaccgtacgtcccgttacgaccggtaacgggtacccgttaagggaaacgtacgggttacggtacggggttaacccgttttaaaggtttttaaccgtttaaccgttcggttaacccgtaacggttaaccctaaaaccgtttaaacttttaacccgttttaacccgtttttacccgttttaccgttaccgtttaacccggggtttaccggggtaacccgggggttaacggggtaaaccccggtaaaggggttaccgggtaaacggtaaccgttaaaaccggtaaaaacccgggttacggttacggggttaccggtaccggttaacgacccgtaaacccgttattacccgttacggtttaccttaccggttaaccccg

SEQ ID NO: 64325 - DNA, 709 bp, Homo sapiens
  misc_feature: GYAE6OF01D8M83.31.78.H01.1.454.CMB.1.raw
  modified_base (368)..(368): a, c, t, g, unknown or other
  misc_feature (368)..(368): n is a, c, g, or t
tcagcagtagacgtcacgaccggtgctcgatttagtgtgagtagtttgggtttgggggaggctacaacaggcaggcaggggcagcaagatggtgttgcaggacccaggtcttcatttctctgttgctctggatctctggtgcctacggggcatcgtgatgagtccagtttccagactccctggctgtgtctcgtgggcgagacgggccaccatcaactggactaacgtccagcctaggtagttgtttttattccggacccctaactaataaacgaacttacttacgtcttacggtaacccagacaaggtaaacgtggacacgtacctacctaaacttcctagtacttacgtcggtcttccgtaccggntacggtccgggttacctacgtatcacgttggctacggcggtctacggggaccttatttccacgttccacgacctaagtcgacgtactacgtccgtcgaccgtggaccttaaggaatacgtggtacgtaccgttaagttttacttactgtaaccgagtaacctaaactaatttacgttaccctttcgtttaccgttaccgttacgggtttcgggacgggacggtaaccggtagggttaccggaaagttaccgttaaacgaaaaccggttacgttacggggtcgtacccggttacgaccccgtaaacggttcttaccgttccggttccgttaccttaccccgg

SEQ ID NO: 64326 - DNA, 591 bp, Homo sapiens
  misc_feature: GYAE6OF01BLEN3.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttacttcggccccaacaataacaactacttagcttggtaccagcagaaagtaggacagccctacctaaactcctgtatttacgtgggtccttccgtacccgggctacgttcccggggtttacctaaccgtattccgattcggcaggtcgggtcgtggggacctatttccacttctcactactcagcacgcctgcaggctagaagtatggtggcgtagtttactacgtgtacagactaactattacttaacttccgttttcgtacttacgtttccgggcggtacgggtaccgaagggtggacgtaataccgaaacgtacgtggtcgactcgactacgtactcctgttccttcgtaccg

SEQ ID NO: 64327 - DNA, 695 bp, Homo sapiens
  misc_feature: GYAE6OF01BYVLK.31.78.H01.1.454.CMB.1.raw
  modified_base (367)..(367): a, c, t, g, unknown or other
  misc_feature (367)..(367): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtcgccgtacggggacatcgtgatgagcctagtttccagactcccgtggctgtgtctcgtgggcgaggacggccaccagtacaactcgactaacgtccacgccgaagtagtttgttttacttcggaccccaacaaacttaacaacttactagtcgttacgtaccagacaagaaagtacgactacgccctaactaactcctagtacttacgtcggtaccttccgtacccggnaccggttccgggttacctaacgtactcgtagtcggacgtaggcggtagtacgggaccttatttccgacttctacacctagtcgagtcacgtcctaggcgacggtctaagaagtcgtgtacggtacttagtttacctatcgtacgaactacgaactttaattaccgtttaccttttacgtttccgtaaccgtttacggttacgggtaccggtaacgggtaaccgtaaggggtaccggaagtaaccgtaaacggaaaccgttaacggttcggtacggaccgtacgtacccgttaaacgtcttacggtttccttaacgtttcctaaccccg

SEQ ID NO: 64328 - DNA, 665 bp, Homo sapiens
  misc_feature: GYAE6OF01CCZTN.31.78.H01.1.454.CMB.1.raw
  modified_base (649)..(649): a, c, t, g, unknown or other
  misc_feature (649)..(649): n is a, c, g, or t
tcagcagtagacgtcacgaccggtgctcgatttagtgtgagtagtttgggtttgggggatctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgacaacgtccagccaggtagttgtttttacgttcggaccccaacctaaataacctaaccgttacttagtctttacggtaaccagacgaagaaagtacgacacgcctacctaaactctagtactttcgtggtaccttcgtacccgggctacggttcccggggttacctaacccgtattcgtagttacggctacgggcgggtcgttcgggaccgttatttcctacctctaccacctactcgacgtccagtcccgtacgcgtacggtcgtaggaacgtagtacggtggacgttagtttacttacgtcgtacacgactacgtaattacttactttcttcgtacctacggtttacgggacgggtacgggaacgtagggtagtacgtaacgtaccgaaacgtaacgtggtcggacctaggaccctaactacttacggttnttccgtacgtaacccg

SEQ ID NO: 64329 - DNA, 890 bp, Homo sapiens
  misc_feature: GYAE6OF01D35EA.31.78.H01.1.454.CMB.1.raw
tcagcagtagacgtcacgaccggtgctcgatttagtgtgagtagtttgggtttgggggagctacaacaggcaggcaggggcagcaagatggtgttgcacgacccaggtcttctatttctctgttcgctctggtattctcgtggtcgccggtacgggacatcgtgatgacgcctagttccagtacctccgtggtctgtcgtcgtcggtcgggacgacggacggcccaacctactacctaacgtcgaaccgtaaaccgtccgaaccgtaccgtaaggttagttttacggtttttacgtaccccggaaccccctaaaactaaaacctaaaccgtaaacttacggttaacgtaccgtttacggaaccaagtacgaaaaggtaagtacgactaccgtaccctaacctaactcgttaacgttacgtttcgccggttccttaccggacccgggtacgttaccgggttaccccgggttaacctaaccgttacttacgtacggttacggacggtacgggtacgggttaccggtacgggttaccttacgtttcccgaaccttaccaccgtacgtactacggactaccgtacggtacctacggtaaccggtacggtacttaaagggtaacgttaggttccgggttaacggttactttttaaggtttaccttcgttaacccgtacgtaacccgtaattaacctttaacgtttaccgttttaaccccgttttctttaccgggttaaccggtttaccgggttacggggaaccggggttaacggaacccggtttaagggtacgtaaaccgtaacgtaaaccggtaacgtacgggttgtaccgggtacccgttacgaacccctttacttacgttaccctttaccggttccttacccggttaacccg

SEQ ID NO: 64330 - DNA, 627 bp, Homo sapiens
  misc_feature: GYAE6OF01ETVV8.31.78.H01.1.454.CMB.1.raw
  modified_base (206)..(206): a, c, t, g, unknown or other
  misc_feature (206)..(206): n is a, c, g, or t
  modified_base (462)..(462): a, c, t, g, unknown or other
  misc_feature (462)..(462): n is a, c, g, or t
  modified_base (549)..(549): a, c, t, g, unknown or other
  misc_feature (549)..(549): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcagagggccacntcaactgcaagtccagccagagttgttttacttcggaccccacaataacaactactagcttggtaccagacagaaagtaggacagcctacctaaactcctagactttacgtgggccttccgtacccgggctaacgttcccggggttacctaaaccgtacttaccagtttcggacctaggccggggttacacgggtacccgtatttccaacttccgtactaacccattcacgctacgcctcgacgaggctagaagtntggtagtctagtttactactgtacagactaactacttacttaccttacgttcgtctacgtttcggacggtaggacctaggtacgganaacgttacgaaaccgtacgttcggtacggtaccgtacggacctaaccgtactaccgttacgttccttccgttaacccg

SEQ ID NO: 64331 - DNA, 676 bp, Homo sapiens
  misc_feature: GYAE6OF01ELJMG.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagtttccagactccctggctgtgtctcgtgggcgagagggccaccatcaactgacaagtccagccagtagttgttttattcggaccccaacaaataacaactacttagcttaggtaccagcaagaaagtacggacacgcctactaaactcctagtactttacgtgggtccttaccgtaccccgggctacggttacccggggtttacctaaaccggtatttacaagttcggcacgggtcgggtcgtcggggacctagtttcactcctacaccactacacgtacacgtcctcgacacggacgtagaaagagtggtacggtactaagttttaactacgttgtacaacgacctaaactaatttaacttacctttctttaccggttacttaccgttttacgggaccgggtaacgggaaccgtaaggggtaggtaaacgtaacgttaaccgaaaacggtaacgttacggttaggaccgtacgacctaacctacgttacgttcgttacgttccgtaacc

SEQ ID NO: 64332 - DNA, 991 bp, Homo sapiens
  misc_feature: GYAE6OF01CN10B.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgacgcctagtttccacgtacctcccgtggctgtcgtctcgtgggcgagacggccaccatcaactcgacaacgtccacgaccagtagttgttttacgttccggaccccctaaccaaactaaaccgtaaaccttacttacggtacttacggtaacctaaggacctaaaggaaacggttaacggacaccgtaccctaaccgttaaacctccgttacgtaacgttttaccggtacgggtaccctttaccggtacccccgggtccgtaacgggtttaccccggggtttacccgtaaacccggttacgttacgtacggtttccggacgtacggggtccgggttcgggtaacggggtaacccgttactttacccgtacccgttcctacctaacccgtaactaccgaccgtaccgaacgtccccggtcggaacccgggacgggttacgtaacggtaaaggtacggttacgggttacggtactttaaacggtttttaacctttaaccgttacggttaccgtaaacgtaacccttaaacgttaacttttttaaccgtttaacccgttttttaccgttttaccggttaccccgttttaaccggggtttaccggggttaacccgggggtacggggttaaaaaccccggggttaaaggggttaacccgggtaaaacccgggttaaaacggtaaacccggttaaaaaccgggttacccgggtttaaacggggttccgggttaaaccccggtttaacccggaaaccccgtttaaaccccggtttaaccggttttacccggttttacccggttttaaacccccggttttacctttaaacccccccggg

SEQ ID NO: 64333 - DNA, 742 bp, Homo sapiens
  misc_feature: GYAE6OF01BDBEX.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagactccctggctgtgtctcgtgggcgagagggccaccatcaactgcaagtccagccagtagttgttttactttcggacccccaacaaactaacaacttacttagtcgttacggtaccagacaagaaagtaggacacgccctactaaacttctagtactttacgtgggtaccttccgtacccgggctacgttcccggggttaccctaaaccggtacttccgtaagtttcggacgtacgggtcggggttcgtacggggacccgttactttacaccttccgtaccgaaccctattaccgacgtcccaacgtcccgttggaccgtaacgggtccttaacggaaagtacgttacgggtacggtacgtttaaggtttttaacttacgtagttaccgaagtaacctaaagttaactttacgtttaaccttttccgtttaccgtaccgtttaccggtttcgggaccgggtacgggtaaccgtaacgggtcggtaacgtaacgtaaccggtaaacggttacgtacgggttcggacccgtagaccctacctacgttccgttacgttcccttacgtacccg

SEQ ID NO: 64334 - DNA, 707 bp, Homo sapiens
  misc_feature: GYAE6OF01EF05R.31.78.H01.1.454.CMB.1.raw
  modified_base (359)..(359): a, c, t, g, unknown or other
  misc_feature (359)..(359): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagtttccagactcccgtggctgtgtctcgtgggcgaggacgggcccaccatcaacgtgacaacgtccagccaggtagtttgtttttacttccggacccccaactaaactaaacctaacctacttagtccttacggtaacccagacaagaaaggtacgaacacgtaccctacctaaacctccgtagtactttacgnggtcttccgtaccggctacgttcccgggtacctaccgtattccagttcggacaggtccgggtcgtcgggtaccgtatttccacttccgcctacatcgacgaccacgtcctcgtcgacggtctaggaagtagtcggtaggtacgtttagtttaacttacgtcgtaaccgtacgtaacctaacttaagtttaccttttaccgtttcccgttttaccgttaccgttaccgggttttccgggaccggggtaaccggggtaaccgtaagggtggaacgtacgtaaaccgtaaaccggtacgtggttcgggccgtactaccgtaaccttacttccgtacgtttcctccggtacc

SEQ ID NO: 64335 - DNA, 755 bp, Homo sapiens
  misc_feature: GYAE6OF01CWSYC.31.78.H01.1.454.CMB.1.raw
  modified_base (344)..(344): a, c, t, g, unknown or other
  misc_feature (344)..(344): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcccgtacggggacatcgtgatgagcctagtttccagacctcccgtggctgtgtctcgtgggcgaggacggccaccatacaactgactaacgtccacgccaggtagtttgttttactccggacccctaacaaataaccaactacttagtcgttacgtaccagacaagaagtaggactacgcctacctaaactcgtagtacttacgnggtaccttcgacccgggtactacggttcccgggttacctaaaccggtacttctacggttcggaccgtacgggtccggggtcgtacgggggtaccttacgtttaccgtaaccttccgtaccaacctatcgacgccgtaacgccgttcgcgacggtactaggtaagtagttaggtcggtacttaagtttacttacgtgtacctaacgaccgtaaacttagtttaacctttaccgttttaccttttaccggttaccgtttacgggtttcccgggtaacggggtaccggtaaccgggtaagggtacggtaacgtaaccgttaaaccggtaaacggtaaccggttgggtacggtcccgttaaccggacccgtaacccggtcgtttaacccgtttcggtacctttccgttaaccccg

SEQ ID NO: 64336 - DNA, 613 bp, Homo sapiens
  misc_feature: GYAE6OF01AOG3S.31.78.H01.1.454.CMB.1.raw
  modified_base (325)..(325): a, c, t, g, unknown or other
  misc_feature (325)..(325): n is a, c, g, or t
  modified_base (608)..(608): a, c, t, g, unknown or other
  misc_feature (608)..(608): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgacaacgtccagccagtagttgttttattcggccccaacaataacaactacttagcttcggtaccagcaagaaagtaggacagccctacctaaactcctagtactttacgngggtcttccgtaccccgggcacgttccccggggttacctaaccgtattaccagttcggacgacggtcggggttcgtaggggtacccgtatttccgacttcctaccaccatcgagccacgcctggcctaggtctagaagtacgtgtacggctaagtttactacgtgtacacgacaactattactacttcttacgtaccttacgttccggacgggacggtaaccgtagggtacgacgtactaacgaaacgtacgtggtcggactgacctacactacctgttcctntaccg

SEQ ID NO: 64337 - DNA, 875 bp, Homo sapiens
  misc_feature: GYAE6OF01DHW6K.31.78.H01.1.454.CMB.1.raw
tcagcagtagacgtcacgaccggtgctcgatttagtgtgagtagtttgggttgggggagctacaacaggcaggcaggggcagcaagatggtgttgcagacccaggtcttcatttctctgttgctcgtggatctcgtggtcgccgtacggggactacgtcggtgagtcgacgtccgtagtttccagtcctccgtggtctggtcgtctcggtggacgacggacggccaacatcaactgactaacgcgacgtccgagtgttttacgtttacgtaccggaccccctaaataaaacttaacctaacctttacgtacgtacggtttaacggtaacccgagtaaccggtaaaggaaacggttacggaaccgtacgtaccccttaaaccgtttaaacctccggtttacgttaaacgttttacccgggtcgggttacccgtttaccccgggtaccccggggtaactttaccggggtttacccccgggggtttaaacccttaaaccggtacgttttcggtaaccggtcggtaaccggtacgggggtccgggttccggttacgggggtaacccttacttaccgtctacctacccgtaacacggtaccacgtccgtaacggtcctacgggaccgtagggtaccgtaagtaaggtcgtcgggtacggttaactttacggttactacgtcggtaccaagttacgtaaacttatttaccgtttactttacccgttaccgttacgttacccgggttacgggaacgggtaccgggttaactacgggggttacaaacgtttaaccgaaacggttaaccgtagggtcggttacggaccgttaaccgtacccgtaacctgtttaacccggtcgtttaacccgttcggttaacccc

SEQ ID NO: 64338 - DNA, 601 bp, Homo sapiens
  misc_feature: GYAE6OF01EZIPS.31.78.H01.1.454.CMB.1.raw
  modified_base (184)..(184): a, c, t, g, unknown or other
  misc_feature (184)..(184): n is a, c, g, or t
tcagcagtagacgtcacgaccggtgctcgatttagtgtgagtagtttgggtttggggagctacaacaggcaggcagggcagcaagatggtgtgcagacccaggtcttcatttctctgttgctctggatctctggtgcctacggggacatcgtgatgagcctagtttccagactccctggctgtntctcgtgggcgagacgggccaccatcaactgcaagtccagccagtagtgttttattcggaccccacaataacaactacttagcttggtaccagacaagaaagtaggacagtccctacctaaactcctagtactttacgtgggccttccgtacccgggtcacggttcccggggttacctaaccggtattcgagttggactacggtcggggttcgtcggggaccgtatttcacgttcctacgaccatcgacgcacgcctagcgaggctagaacgtatggtcgacttagtttactacgtagtacagacaatattattacttcctttacgtacttacgtttcgggacggtacgggaacctagggtgaagtactaacgaacgtaagtggtcgactcgactacctatacgttcttcgtctacg

SEQ ID NO: 64339 - DNA, 680 bp, Homo sapiens
  misc_feature: GYAE6OF01EPB8I.31.78.H01.1.454.CMB.1.raw
  modified_base (161)..(161): a, c, t, g, unknown or other
  misc_feature (161)..(161): n is a, c, g, or t
  modified_base (650)..(650): a, c, t, g, unknown or other
  misc_feature (650)..(650): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacgggacatcgtgatgancctagttccagacctcccgtggctgtgtctcgtgggacgagacggccaccatacaactgacaacgtccagccgagtacgtttgttttactttccggacccccaactaaactaacctaactacttagtcgttacgtaccagacaagtaacgtacgacacgtacctacctaactccgtagtactttacgtcgggtacctaccggtacccggtatacggttcccggggttacctaacgtcttcgagttcggcacgggtcggttaccgtgggacccgttattccgaccttaccgacctaaccgtctaccgtaacgccgtacgtcccgttacggaccgacggtctaaggaagtcgttaggtggttacttaagttttactacgttcgtactaacgtactaactagtttaacttaccgtttacttcgttactaccgggtttacggacgggtacggacgtagggtaccgagtactaacgaacgttacggtggtccgntagaccttacgtattctacgttctccgtac

SEQ ID NO: 64340 - DNA, 666 bp, Homo sapiens
  misc_feature: GYAE6OF01C12FZ.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagtacctcccgtggcctgtgtcctcgtgggcgaggacgggccaccatcaacgtgactaacgtccagccagtagttgtttttactccggaccccaacaaactaaacctaacttacttagtcgttacgtacctagacaagtaaagtacggacacgcctaacctaacctcgtagtacttacgtcggtccttcgtacccgggtataccggttcccgggtacctaaccgtacttcgagttcggacgacggtccgggtcgtacgggtacctacgtttccgactcctacgaacctgtaccagcaacgtcctggactaggactagaagtgtcgtaggtacttagtttagtactggtaccaagtactaacgttatttacgtacctttcgtttacgtcctaggttcgggaacggtagggtaacctagggtaggataaccgtaacgaaaccggtgttggtccgacgtacgtactaacctagttccgttactcccgtttatacccg

SEQ ID NO: 64341 - DNA, 920 bp, Homo sapiens
  misc_feature: GYAE6OF01AY2GO.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgacgcctagtttccagtacctcccgtggctgtgtctcgtgggcgaggcggccacatcaactgactaacgtccagccagtagtttcgtttttacgttccggaccccctaactaaactaaacctaaaccttacgttacggtaccgtttacggtaaccacggacaaaggtaaaacggtacggaaccaccgtaccctaaccgttaaaacctccgttaggttacttttaaccggtccgggttacccttacccgggtacccgggtacgtaaccgggtttaccccgggggtttaaccctaaccggtacgtttaccgtacggtttaccgggaccgtaccggggtcccggggttaccggtaccgggggtaacccgtttaacgtttacccgacccgttcccttaacctaaccccgtagttacccgaaacggttacccgtaacccggtcccggttaaccgggtaccggtaacgggttaacccgttaaagggtaaacgggtacggtttacggggttaacgggtaccgttttaaacgggtttttactaaccgggtttacggtaaccgaaccgggttaaccttaaacggtttaacttttaaccgtttaccgtttttacccgtttaccggttacgtttacccgggtttacccggggtacgggtaaccggtaaccgggtaagggttacggtaaacgtaaccggttaaaccgaaaccgggttacgttaggtccgagtacccgacttaaccgtctacgtttcgttacctcgttaacccg

SEQ ID NO: 64342 - DNA, 854 bp, Homo sapiens
  misc_feature: GYAE6OF01BWUU8.31.78.H01.1.454.CMB.1.raw
  modified_base (152)..(152): a, c, t, g, unknown or other
  misc_feature (152)..(152): n is a, c, g, or t
  modified_base (160)..(160): a, c, t, g, unknown or other
  misc_feature (160)..(160): n is a, c, g, or t
  modified_base (799)..(799): a, c, t, g, unknown or other
  misc_feature (799)..(799): n is a, c, g, or t
tcagcagtagacgtcacgaccggtgctcgatttagtgtgagtagtttgggtttgggggagctacaacaggcaggcaggggcagcaagatggtgttgcagacccaggtcttctatttctctgttgctctggatctcgtggtgccgtacggganactcgtgntgacgtcctacgtttccagcctccgtggtccttggtcgttcgtcgtcggacggaggcggaccctaaccacgttaccgaaactcggacgtaaccggtccgaagtacccgtaaaggttcgttttacggtttttaacgtcccggaacccctaaactaaacgttaaacccttaacttaacgttaacgtacgttaacggtaaccaacggtactaaacggtaaaggttacggacctacgtaccctaaccttaaccgttccttagttactttaccggtcggtaccgttaccggtaccggtcgttaccggttccgggttaacctaccggtcttacgtacgttcggcgtaacggttccgggtaccgtaggtacccgttagttccgtactacctaccgtacgtaacctcgtacgggtacctaccggtcgtacgacgtacggggtactaacggtacgtacggttcgtaacggttacgtttaatttacgtaccttagttaacacgtaactaacgttactttaaccgtttactttaccgttccgttacgttaaccggggtttaccggtacgggtacggtaaaccgggttacgggtaaacggttacgaaacccggttaacgtaaacccgggttaggttaggtaccccgggttntaaacccgtcgttaaccgttacgttagttttacccggtcgtttcccttaaccggg

SEQ ID NO: 64343 - DNA, 697 bp, Homo sapiens
  misc_feature: GYAE6OF01ERVQ8.31.78.H01.1.454.CMB.1.raw
  modified_base (379)..(379): a, c, t, g, unknown or other
  misc_feature (379)..(379): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagacctccctggctgtgtctcgtgggcgagacggccaccatcaactgacaacgtccagccagtgttgttttattcggaccccaacaactaacaactacttagcttggtaccagcaagaaagtaggacacgtcctacctaaactccttagtactttactgggtactttccgtacccgggtcacgttcccgggggttccctaaaccggtnttcattcggcacggcgggttcgtcggggacccgtatttccacttccgtcgtaacccatcaacggcctaacggtcccttcggacgtaacgggccgttaggtaaacggtcgttagggtcggtacgttaacgtttttacgttacttacggtactaacggtacctaaacgtaacttttacgttaactttccgttttaccgtacttaccgttttacggggacgggtacgggtaccgtaagggtacggtaacgtaacgtacgaaaaccggtacgttcggtcgtcgtacgtccctaaacgtccgttattcgttccttcgtacccg

SEQ ID NO: 64344 - DNA, 802 bp, Homo sapiens
  misc_feature: GYAE6OF01DF8W2.31.78.H01.1.454.CMB.1.raw
tcagcagtagacgtcacgaccggtgctcgatttagtgtgagtagtttgggtttgggggatctacaacaggcaggcaggggcagcaagatggtgttgcagacccaggtcttctatttctctgttgctctggatctcgtggtcgccgtacgggacatcgtgatgacgcctacgttccacgacctcccgtggtctgtcgtcgtcggtcgggacgaggacgggccaaccgactaccaacgtcgacgaacgtccgacgaccgtagtagtttcgttttacgttaccggaccccaactaaactaacctaacttacttacgacgttacggaaccgagacgaaaggaaacgtacggacacgtccctaacctaactcgtagttacgttacggtcggtacctacccggtacccggactaccgggttcccgggtacctaacgtacttcgtacgtcggcgtacgggtcgggtacgtccgggtaaccgttcttaccgtacttaccgtaccaaccgtactacgacgtaccgtacggtcccgtaggccgtacggtaccgtaaggaacggttaggtcgggttagtaccgtttagtttaacctacgtacgtacgaacgtaacttaacttacggttttacttaacccgttttcgttaccgggttaccttaacgggtttccgggaaaggggtacccgggtaaacggtacggggttaacggaaacccgttaacgtaaaaccggtaaacggttaggttacgggtccgtaacctcgaccccgttaacttacgttacccgttccggtttccctaacggttcccccg

SEQ ID NO: 64345 - DNA, 606 bp, Homo sapiens
  misc_feature: GYAE6OF01A788M.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctacctaaactcctagatttacgtgggtcttccgtaacccgggctacgttcccggggtttaccctaaaccggtatttccagtttggcctaggccggggtctggggtacccgacttttcgaaccttctacaccctatccgagccagcctggccagggctaggaaagatggtggactagttttaacttacgtgtaccagactaaactattaattactttactttcgtactacgtttcggcggacgggtaccaagggtcggaagtataccgaaaacggtaactaggtcggactgacctaaccattctcgttctcgtacc

SEQ ID NO: 64346 - DNA, 630 bp, Homo sapiens
  misc_feature: GYAE6OF01BOJA7.31.78.H01.1.454.CMB.1.raw
  modified_base (326)..(326): a, c, t, g, unknown or other
  misc_feature (326)..(326): n is a, c, g, or t
  modified_base (343)..(343): a, c, t, g, unknown or other
  misc_feature (343)..(343): n is a, c, g, or t
  modified_base (505)..(505): a, c, t, g, unknown or other
  misc_feature (505)..(505): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagttccagacctccctggctgtgtctcgtgggcgaggacgggccaccatcaactgcaagtccagccagtagttgttttagttcggaccccacaataacaactacttagcttaggtaccagcaagaaagtaggacacgcctacctaaactcctagtatttacgnggtccttcgtacccggntacgtcccggggttacctaacgtattctagttggctaggccgggtcgtacgggaccgtatttccacttccgtccaacctataccgacgcacggtcctggccgaggtactaggaagtcgtggtacggtacttaaggttttattacgtgtactagacctaaatntttaacttacctttcgtttcgtacgttacgttcgggacggaacggtaacgaagggtgaagtaagtaccgtaaaacggtatacgggtcgacctacgacctaaccgttataccgtcttcttacctcg

SEQ ID NO: 64347 - DNA, 938 bp, Homo sapiens
  misc_feature: GYAE6OF01CE5VQ.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctcgtggtcgccgtacggggacatcgtgatgacgcctagtttccagtacctcccgtggctggtcgtctcggtcgggacgaggacgggacccaaccgaactaccaacgtcgacctaacgtaccacgacccgtaaggttacggttttagtttttaccgttacccggacccccctaaacctaaaacttaaaacctaaaaccttaaccgtttacggtaccgtttacggtaacccgaaggaccgaaaggtaaaacgggtacggaacgaacccgtaccctttaaccccgttaaaaccgtcccgttaggttaaactttttaaccgggccgggtttacccgtttacccggtaccccggggtacttaaccccggggtttccccggggggtttaaccccctaaaccggtttacttaccggttaacgtttcgggaccggtaacggggttcccggggtacgggttaccggggtaacccgtttaaccttttaccacccgtttaccctaacccgaaccttacgtaccgaacggtcgtaaccgccgttacggaccgtacggtaccgtaaggtaaacggtcggttaggtacgggttacgtttaacggttttaacttaccggttacggtacgtaacgaccgtaaacttttacgtttaccgttttacctttcccgtttaccggtttaccgttaccgggttcggggtaaccgggggtacggtaacccggtaaagggtaccggtaaggtaaacctaaaccggtaaacgtacgtacgggtacgtccgtacgtacccgtacttacgttacgttcctcgtttcctacccg

SEQ ID NO: 64348 - DNA, 770 bp, Homo sapiens
  misc_feature: GYAE6OF01CDYKU.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacgggggactagtcggttgatggacgtcctagtttccagtacctcccgtggctaggtgtctcgtgggacgaggacggccacctatcaactgacacgtcacgccagtagttgtttacgtccggaccccaacgtaataacctaacttacgttagtccgttaggaccagaccaaggtaaagtacgaactacggacccttaacctaaaccgtcgttagttaaccgtttaccggcgggttacccttacccgggtacccgggtacgttaccggttcccggggtttaccctaaccggtatttccgaacgtttcggacggtacgggtccggggttacgtaccggggtaaccctttactttccgaacctttccgtaccaaccgtacgtaccgaacgggtccctaaggtcccgtaggtaaccggtacggtacgtaagggtaaacggtacgttgggtacgttaccgtttaagttttaccttacgtacgtaccgacgtacttaacttagtttaccttacgtttcgttacgttacgtaccggttcggacggacggtaccgtagggtacgaaacgtactaaccggaacgttacggcggtacggctacggaccgtactactacggtcttaccgtcgttcccg

SEQ ID NO: 64349 - DNA, 874 bp, Homo sapiens
  misc_feature: GYAE6OF01DRO14.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagtacctccctggctgtgtctcgtgggcgaggcggccaccatccaactgacaacgtccagcccaaggtacgtttgtttttacttccggaccccctaacgtaaacttaaacctaaacctttaacgtttacggtaccgtttacgggtaacccctaagtaccgaaaggtaaaacggtaacggacctaacggtaccccttaacccgttaaaaccctttccgtaggttaaacctttttaaccggtcgggttaccctttacccggtaaccccgggggtcttaacccgggttaccccgggggttttaaccctaaacccggttagttttaccgtacggtttcgggaccgtaaccggggtccgggttaccgttacgggggtaaccccgttacttttacccgaacctttcccgaacccgtacccgtaacgttccaacggtacctacgtccccgtagacctaacgtgtaccgttaaggaacgtacgttggtaccgggtatttaacgggttttaattacgttcggttaccaaggtaccctaaattacgtttaactttccgttttaccttttcccggttacgttcccggtttaccggggtaccgggtaaccgggttaccggtaaggggtaggtaaccgtaacgtaaacccggtaaaccggtaacgttgggaccgtacgttcggacctaaaccgttgtccgttgttacccttaccg

SEQ ID NO: 64350 - DNA, 708 bp, Homo sapiens
  misc_feature: GYAE6OF01EA8IM.31.78.H01.1.454.CMB.1.raw
  modified_base (699)..(699): a, c, t, g, unknown or other
  misc_feature (699)..(699): n is a, c, g, or t
tcagcagtagacgtcacgaccggtgctcgatttagtgtgagtagtttgggtttgggggagctacaacaggcaggcaggggcagcaagatggtgtgcagacccaggtcttctatttctctgttgctcgtggatctcgtggtgccgtacggggacagtcgtgagtgacgtcctagttaccagtacctcccgtggtcttcggtgtcgtcggtgggcgacggacggaccaaccactacgtaacgtcgaaccaagtccacgaccgtagtacgtttgttttacgttccggacccctaacaaataacctaacttaacgttaacgtcgttacggtaaccgacgtaagaaggaaaaggtacggacctaacggtaccttaacccgtaaacgttccgtaattacgttacggtcggttaccgttaccggtacccggtactaccggttacccgggtacctacgtactacgtacggttggccgtacggtccggtcgtaccgggtacttacgttaccgacttaccgccgtaaccagtaccggacgtacgtacggtcccgtaggaccgttacgggataggtaacgtcgtacggtcgtaattagttacgtactgtacagtactaactattacgtcttcttactacgttacgtcggagggtacgaccgtaggtacgaagtgtaaacacgtacgtgcgtcacgcctagtcctagttcncgtctaccg

SEQ ID NO: 64351 - DNA, 685 bp, Homo sapiens
  misc_feature: GYAE6OF01BXQ2V.31.78.H01.1.454.CMB.1.raw
  modified_base (199)..(199): a, c, t, g, unknown or other
  misc_feature (199)..(199): n is a, c, g, or t
  modified_base (373)..(373): a, c, t, g, unknown or other
  misc_feature (373)..(373): n is a, c, g, or t
tcagcagtagacgtcacgaccggtgctcgatttagtgtgagtagtttgggtttgggggagctacaacaggcaggcaggggcagcaagagtggtgttgcgagacccaggtcttcatttctctgttgctctggatctctggtgccgtacggggacagtcgtgatgacgcctagttccaagtctccgtggctgtcgtactgngggacagacggtccaacatccaatgacaagtccagccaagtagtttcgttttaacgtccggacccctaacaaagtactaacgttacttacgcgttcggtaaccagacgaagtaaaacgtaggtacacggtcctaacgtaaactctagtactttacgcggtaccttcggaccggngtacgtaccgggttacctaacgattcgagttgcaggtcggtacgacggtacgtaacttcacgtcacgacctagtcaggtccacgccgttcgacgtacggtactaggaagagttcggtacgtacgttaagtttaacgttacgtacgtacgtaacgtactaaaccttattaacttacgttttaccttcgtaaccgttaccggttacgggaccgggtacggtaaccggttaacggtacggaacgtaaccgttaacgtaaaaccgtcgtacgggtcgacgtcgaacctacgtacttacggtaccttctacgtaccc

SEQ ID NO: 64352 - DNA, 848 bp, Homo sapiens
  misc_feature: GYAE6OF01CGHCQ.31.78.H01.1.454.CMB.1.raw
  modified_base (798)..(798): a, c, t, g, unknown or other
  misc_feature (798)..(798): n is a, c, g, or t
tcagcagtagacgtcacgaccggtgctcgatttagtgtgagtagtttgggtttgggggagctacgaacagggcaggcaggggcagcaagatggtgttgcagacccaggtcttcatttctctgttgctctggatctcgtgggtgtccgtacggggacagtcgtgtatgagcctagtttccagctcccgtggctgtgtctcgtgggcgaggacgggtccaccgagtccaaacgttgactaacggtcccaggaccctaggtagtttcgtttttacgttcccggaccccctaacgtaaaacttaaaccgtaacctttacgtttaacggtccgttttaacggggtaaccctaaggtacgtaaaggtaaaacgggttaggaaccacggtaccccttaacccgttaaaaccgtcccgttacggttaagttttacccgggcgggggttacccgttttcccggtaacccggggaccgttaaccgggtttacccccggggttaacctaaaccggttacttccggtaaggttacggacgtacggggtccggggttacggtacgggtaacccttatttcccgaacgttccgtaccaccgtagtaccgagtccgacgtcctacgcgacggtaccgtaggaaacgtacgtacggtacggttaacgttagttttaacgttacgtacgtaccgtaagtaaccgtaactaacgttttacgttacccgtttcttacccggtttcgtaaccgtttaccggggacgggtacggtaccggtaagggttacggaccgtaaagtaccggtaaacggtacgnggttacggcttacggacccgtacgttgtacgtttcgtcgtccgttacccg

SEQ ID NO: 64353 - DNA, 699 bp, Homo sapiens
  misc_feature: GYAE6OF01BR2MO.31.78.H01.1.454.CMB.1.raw
tcagcagtagacgtcacgaccggtgctcgatttagtgtgagtagtttgggttgggggagctacaacaggcaggcaggggcagcaagatggtgttgcagaccaggtcttcatttctctgttgctctggatctcgtggtgccgtacggggactatccgtgactggacgtacctagtttccagacctcccgtcgggctgtcgtctcgtggggcgaggacgggcccaaccgtatccaacgtgacgaacgtccagccgagtaggttgttttagttcggacccctaacaaactaacctaactacttagtccgttggtaccagacgaagaaaagtaggtacacgtccctacctaaacgtcctagtactttacgtgggtccttccgtacccggtctacgttcccgggttacctaaccgtattcgacttcggacagggtcgggtcgtacgggtaccgtatttccacgttctaccactacgtacacgtctacgtcctcgacgtacggtctagaacgtagtcggtacgtcgttagtttacgtacgttcgtcgaagtactaactttaacgttacttaacttttcgttaccggttccgtaacgtttccggggaacgggtacgggtaaccgttaggggtagtacgtacgtaaacgaaacgttacgaggttcggacgtccgaaccgttacacgttcttcggtcttccgtacccg

SEQ ID NO: 64354 - DNA, 756 bp, Homo sapiens
  misc_feature: GYAE6OF01EIIB3.31.78.H01.1.454.CMB.1.raw
  modified_base (232)..(232): a, c, t, g, unknown or other
  misc_feature (232)..(232): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagcctccctggctgtgtctcgtgggcaggcgggccaaccatcaactgacaagtccagaccngtagttcgttttaagtttcggacccccaactaaactaaacaaacttacttacgcttacggtaccagcaagaaagtacgacaagccctactaaactcctagtacttttacgtcgggtccttactacccggggtctaaccgttccggggtttaaccctaaccgtacgttactacgttcggtcgtacggtaccgggtaccggtacgggtaccgtactttaccgtaccgtacctacctaaccctactaccgacgtacgtaccgtaccgtacgacgtacggtacgtacgtaacggtagttacggtacgtacgttaacgtttaacgttacgttacgtacgtacgtaacgtaacttaactttaactttaccgtttaccgttttaccgttaccgttaccggtttaccgggtaccgggtaaccgggtaaccggtaacgggtacggtaaacgtaacgtaacgtaaacggtaacggttacggtacggtacgtacgtaaccgtaaccgttaacgttacgttaccgttccgttaccg

SEQ ID NO: 64355 - DNA, 797 bp, Homo sapiens
  misc_feature: GYAE6OF01DX3NN.31.78.H01.1.454.CMB.1.raw
  modified_base (437)..(437): a, c, t, g, unknown or other
  misc_feature (437)..(437): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctcgtggtgccgtacggggacatcggtgatgacgcctagtttccagtacctcccgtggctggtgtctcgtgggcgaggacggcccaccatccaacgtgaccaagtcccgagccgaagtaggtttgtttttacgttccggacccctaactaaataaacctaacttacgttacgtccgttacggtaacccaggtacaaggtaaacggtacggaccacgtcccttacctaaacctccgtagttactttacggtcggtaccttaccggaccccgggtataccggttaccccggggttaccctaaccggtnttacgagttcggaccgtagggtccggtacgtacgggtaacccttacgtttccaaccgttcctacctaccgtatccgtacgaccgtaccgtccgtaggacccgtagggtactaggtaaacggtgttcggtacggtacgtttaacggttttacgtaccgttcgtaacgtaaccgtacgtaaacttaacgttttacgtttaaccctttccgtttacccgttaaccggtttaccggttacccggggaaccgggtaacggtaaccggtaggggtacgaaacggttaacgtaaccgaaaacggttacggtcggttacgaccgttacggaccctaccgtattacccttacggttctcccgttacccg

SEQ ID NO: 64356 - DNA, 714 bp, Homo sapiens
  misc_feature: GYAE6OF01DA4QW.31.78.H01.1.454.CMB.1.raw
  modified_base (140)..(140): a, c, t, g, unknown or other
  misc_feature (140)..(140): n is a, c, g, or t
  modified_base (503)..(503): a, c, t, g, unknown or other
  misc_feature (503)..(503): n is a, c, g, or t
  modified_base (679)..(679): a, c, t, g, unknown or other
  misc_feature (679)..(679): n is a, c, g, or t
  modified_base (687)..(687): a, c, t, g, unknown or other
  misc_feature (687)..(687): n is a, c, g, or t
  modified_base (707)..(707): a, c, t, g, unknown or other
  misc_feature (707)..(707): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctcgtggtnaccgtaggggcatcgtgtagtgacgcctagttccagactccgtgctgtcgtctcgtgggacgagacggcctacatccaacgtgaccaacggtccacgtaccgtaggtacgtttgtttttacgtaccggacccctaacaaataaacctaacttacgtacgtcgtttacggaacctaggactaaggaaacgtaggactaccgtcctaaccctaactctaggttacttacggtcggacctttacggacccggtacgtacggttcccgggttacccaaacgttcttcgtacgtcggacgtacgggtccgggtacgtacggggacttatccgtaacttccaccgtaccagttcacgaccgtacgcccncggacgacgtcgtaacggtataggttcggtcggtaagtttacgtttaactcctaggtaccgagttaacctaagttactttaacgttccgttttcgttaacctcggtttaaccgttggggaacccgtaagggtaacctaggggtacgaactacggtaactaaaccggtagtcggtancggtaacncgtactagttcttcgacttnttacccg

SEQ ID NO: 64357 - DNA, 601 bp, Homo sapiens
  misc_feature: GYAE6OF01BBXYQ.31.78.H01.1.454.CMB.1.raw
  modified_base (441)..(441): a, c, t, g, unknown or other
  misc_feature (441)..(441): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagacgggccaccatcaactgccaagtccagccagagttgttttatcggaccccacaataacaactacttagcttggtaccagcagaaagtaggacagccctacctaaactcctagtactttacgcgggtcctttccgtaccccggggctaccggttcccggggttaccctaaaccggtattccgtagttcggctagggtccggggtctggggaccctattccactctcacatcagcagcctgcngcagaagtatggtgactagtttatacgtgtcagactaactatttaacttacttcgttccgttactaccgtttcgggaccgggtaacggaccgtaagggtcggaatacgtaccgaaacgtagtcggtggtcctagaccacctatacgtcttcgttctaccg

SEQ ID NO: 64358 - DNA, 796 bp, Homo sapiens
  misc_feature: GYAE6OF01BSG5Q.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagactcccgtggctgtgtctcgtgggcgaggacggccaccatcaactgacaagtccagccgagtagttgttttacttcggaccccaacaaataaccaacttacttagcttacggtaccagacaagaaagtggaacagcctacctaaactcctagtacttacgtcgggtcttaccgtacccgggctacggttcccggggttacctaaccgtattcgtagttcggactacgggtccgggttacgtacgggtaacccgtactttccgaccgttactacccaaccgttatacccgaagtcccgttaaggtcccgtttaggaccggtacgggtaccgttaaggtaaacggtaacggtttcgggtacggtaaccttttagggtttttaacctttaaccgggttacggtaaccgtaaacggtaacccgttaaaacctttacgtttttaaactttacccgtttttcccgttttaccgggttacctttaaccggggttttccgggaaccggggttaacgggtaacccggttaagggtacgtaacgtaaacgtaaccgtaaaacggttacggtagggttccgacgttaccgaccgttacctagttaccgtttcgttacccgtttcgtaaccccg

SEQ ID NO: 64359 - DNA, 931 bp, Homo sapiens
  misc_feature: GYAE6OF01A2H0R.31.78.H01.1.454.CMB.1.raw
  modified_base (142)..(142): a, c, t, g, unknown or other
  misc_feature (142)..(142): n is a, c, g, or t
tcagcagtagacgtcacgaccggtgctcgatttagtgtgagtagtttgggtttgggggagctacaacaggcaggcaggggcagcaagatggtgttgcagacccaggtcttctatttctctgttgctctggatctcgtggtcnccgtacgggacagtcgtgatcgacgcctacgtttccacgtaccttcccgtggcttggtcgttctcggtcgggacgacggaccgggcccaaccactacctaaaccgtcggacgtaaccgtccaacggaccgtaggttaacggttttgtttttaccgttccggaaccccctaaactaaactaaaccgttaaccttacgtttacggtccttacggtaccaagacgtaaaggaaacggtacgaactaccggtaccctaaccctaaaacttccctaaggttacgtttaccggtcggttacccttacccggtacccgggtctaccgggtttaccccgggtaaccttaaaccgtacgtttctaacggttcggaccgtaacggggtccggggtaccggtacgggtaaccggttaacctttccgtaacgtttacccgtacctaacccggtattcccgaacgggtacccgttaaccgtccgggttaccggaaccgggtaacgggttaacgtaaccggggtaaacgttaggggttacccgggttaaggtttaacggtttttaacttttaaccggtacgttacgttaccaaccgggtttaactaacggtttaaactttttccgttaaccccttttcgggttaaccgttaacccggttttcggttaaccgggggacgggtaaaccggtaggttaacggggtacgttaaacgttaaccgtaaaccggtaaacgttcgggttcgggaacgttcggtaccctacgttaacccgttgtttccgaccttttaccgtcgtttaccccg

SEQ ID NO: 64360 - DNA, 818 bp, Homo sapiens
  misc_feature: GYAE6OF01DBBN0.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttctatttctctgttgctcgtggatctgtggtcgccgtacggggacatcgtgatgacgctagttccagtcctccgtggctgtcgtcgtcgtgggacgaggacgggcccaacatacaacgtcgacaacgtccacgacgagtagtttgtttacgtccgaccccaaactaaactaaactaacttactacgtacgttacgtaccagacgaaagaaaggtacgacaacgtccctaactaacctctagtacttacgcggtcttacgacccggctaccggtccggttaccaacgtactacgtagtcggagacggtcgggtcgtacgggtacctacgtttaccaccttacctacaacctacgtacgaccgtaccgtaccggtcccgtaggtccgtaacgggtaccttaaagggaaacgtacggttcgggttacgtaaccgttttaaggtttaactttaccggtagtaccgtaaacgtaacttaaaacctttaattaacccgtttttaccgttttccggtttaacccggttacgtttaccggggttaaccgggggaccgggtaaacgggggttaaacccggttaaaggggtaacgggtaaaccgtaaagttaaaacccgggtaaaaaccggttaggttccgggtacggttacccgtacccgggtaaacccctaacgttacgttaccggttaccctttaccgttaaccggtttaaccccg

SEQ ID NO: 64361 - DNA, 884 bp, Homo sapiens
  misc_feature: GYAE6OF01CB1WM.31.78.H01.1.454.CMB.1.raw
  modified_base (830)..(830): a, c, t, g, unknown or other
  misc_feature (830)..(830): n is a, c, g, or t
tcagcagtagacgtcacgaccggtgctcgatttagtgtgagtagtttggggtttgggggagctacaacaggcaggcaggggcagcaagatggtgttgcagacccaggtcttcatttctctgttgctctggatctcgtggtcgccgtacggggacatcggtgagtagacgcctagtttccagtacctccgtggcttggtcgtctcgagggacgaggacggcccaaccatacaacgtgacaagtaccacgaccgtagtagttagttttacgtcggacccccaaataaactaaacctaaccttaacgttacgtacgtttacggaaccaagaacgaaaggaaaacggtacggaacaaccggtacccttaaccgttaaaacctcgttaacgttaacgttttaccggtacggggttacctttaacccgggtaaccccgggtacgttaaacccggggtttaccccgggggtttaacccttaaaaccggttacgtttaccggtaacggtttaccgggaccggaaccggggtcccgggggtttaacggtaccggggttaacccgtttaactttcccgaacccggtttaccgaaccctaacccggtaacttaccggaacgtccgtaacgttccgtacgaccggaacggttcgaaagtaaaggtactccgggttagtaaccgtttaagtttacctacgtaggaacctaacggtaactaaactttaactttactttaccttttacccgttccgttaaacggttccggttaccggggaacggtaacggtacgtaaccggggtaagaacgttaaaccaaacgggttaaacctagggttcccggnaccggttaccaaccggttacccttaggtccgttaccctttgacccttaaccccg

SEQ ID NO: 64362 - DNA, 745 bp, Homo sapiens
  misc_feature: GYAE6OF01DZR56.31.78.H01.1.454.CMB.1.raw
tcagcagtagacgtcacgaccggtgctcgatttagtgtgagtagtttgggtttgggggagctacaacaggcaggcaggggcagcaagatggtgttgtagacccaggtcttcatttctctgttgctctggatctctggtgcctacgggacatcgtgatgagccagttccagacctccctgctgtgtctcgtgggcgagacgggccaccatcaactgacaacgtccagccagagttgtttacttcggccccacaataacaaccttacttaagcgttggacctagacagaaagtacggacagcccttaccgtaaactcctagtactttacgtcggtcttaccgtacccgggctacgttcccggggttaccctaaccgtatttccgtagtttcgggacgtacgggtaccgggttcgtacggggtaccgtagtttaccgacgttccttaccaacccgtacgttaccgaacggtaccgacgtcccttaggccggtaacggtccgtaaggaaagttaggtcggttagggtacctttaaggttttactttacgtcggttacacggtaactaacgtagtttaacttaccttttcgttaccggttacgttacggtttaccgggacgggtaacgggtaccgtaagggtacgggtaagtaacgttaacccgaaaacggttaccgttagggtacggtaccttacggacccctaacgttaccttacgttaccgtttccttaccgtaccgtttaccccgg

SEQ ID NO: 64363 - DNA, 856 bp, Homo sapiens
  misc_feature: GYAE6OF01CHODI.31.78.H01.1.454.CMB.1.raw
  modified_base (139)..(139): a, c, t, g, unknown or other
  misc_feature (139)..(139): n is a, c, g, or t
  modified_base (186)..(186): a, c, t, g, unknown or other
  misc_feature (186)..(186): n is a, c, g, or t
  modified_base (844)..(844): a, c, t, g, unknown or other
  misc_feature (844)..(844): n is a, c, g, or t
tcagcagtagacgtcacgaccggtgctcgatttagtgtgagtagtttgggttgggggagctacaacaggcaggcaggggcagcaagatggtgttgcagacccaggtcttcatttctcttgttgctctggatctgtggtnccgtacggggacagttcgtgatgacgtacctgttccagtcctcccgnggctgtcgtctcggtgggacgaggacggacctaacactacgtaacgtgactaacgtccacgaccgaggttacgtttcggtttttaccgtaccggtaccccaaactaaacttaaacctaaacctacgttacgttacgttacggtaaccgacgaacgtaaaggtaaacggtacggaaccaccgttcccgttaaaccgtaaccggttacgttacggttaacgtttacggtccgggttaccttttacccgggacccggtacgttaaccggggtttaccccggggttaacctaaaccggttagtttccgtaaacggtttcggaccggttacgggtccggggtttaccgggtaaccggggtaccgttaacgtttacccggacccttaccgtaccgtaaaccctcgtaccgacgtaccgtaccggtaccctacggacgtacggaacgtaacggtaaagtcggttacggtacggtaacgtttaacgtttacgttacgtactaacgtaactacttaaagttacgtttaaccttacgttttacccgtaacgttccgtttacggttacgggtaaccggggacggttaaacgaacgggttacgaacgtaacgtaaccggaaacgtcggtacggttaccgcgtacctccgtaaccttggtaccttccgttnttcccgtaaccg

SEQ ID NO: 64364 - DNA, 785 bp, Homo sapiens
  misc_feature: GYAE6OF01CM07A.31.78.H01.1.454.CMB.1.raw
  modified_base (372)..(372): a, c, t, g, unknown or other
  misc_feature (372)..(372): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacgggacatcgtgatgagcctagtttccagacctccctggctgtcgtctacgtgggcgaggacgggccaaccatacaacgtgacaacgtccagaccagtagtttgttttacgtccggaccccaactaaataactaaccttacttacgtcttacggtaccagacaagaaagtacggacacgtacctacctaaactccgtagtactttacgcgggtccttacgacccggtntaccggttacccgggtaccctaaaccgtattacgtacgttcggacgtacgggtccgggttacggtacggggtaacccgttagtttccaaccgtttacctaaccgtaaccgtaacgttaccgaacggtcccgtaaccggtcccgtacggaaccggtaacggtccgttaaaggaaacgtacggttacgggtacgggtacctttaaaggttttaaccttaacgtcggttaaccaacggtaccctaaagtttaagtttaacttacccgttttacgtttaccggttacgttaccgggtttacgggacgggtaaccggaaacggttaagggtacggaaagtacgtaaaccgtaaaacggtcgttacgggtcgtaccgtacgacccgtaacttacttacgtacgttccttacgttaaccc

SEQ ID NO: 64365 - DNA, 939 bp, Homo sapiens
  misc_feature: GYAE6OF01CYPP4.31.78.H01.1.454.CMB.1.raw
tcagcagtagacgtcacgaccggtgctcgatttagtgtgagtagtttgggtttggggagctacaacaggcaggcaggggcagcaagatggtgttgcacgacccaggtcttctatttctctgttgctcgtggatctcgtggtcgaccgtacgggactagtcgtagagtgacgtaccgtacgtttaccacgtaccctccgtggcttcggtcgttcgtcggtagggacgaaggaccggacccaactataccgaaacgtcgaccgaaccgtaccgacgaccgttaaggttacgttttagtttttaaccgtacccgaccccctaaaactaaacttaaaccgtaaacgtttaccgttaacgtacgtttaaccggtaaccgaacggaaacgtaaaggtaaaacggtacggaccgtaaccgtaacccctttaaccgtaaaaccttccgttagtttaacctttaccggtccggttaccgttacccggtaacccggtccgttacccgggttaccccgggtttaacccctaacgttacgttactacggtacggaccggtaccggtacggggtccggtaccgggttaaccttacgttacccgacttccgtactaacccgtatacccggacgtaccgtaccgaccgtacggacgtaacgtcggaaaggttaacggtaacggtttacgggtaaccggtttacgttttaaagttttaccgtaacggtacgtaacgtaaacgaacctttaaaccgttattttaaccccgtttcgtttttaccgttaccggttccgttaaccgggttaccgggtaaccggggtacgggtaaacgggttaacgggtacgggtaaactaacccggttaaaacgaaccgggttacgttacgggtcgtaaccgttaacccgtccgttaaacgttcgttaggttccccttaacgttacgtttaccccccgg

SEQ ID NO: 64366 - DNA, 765 bp, Homo sapiens
  misc_feature: GYAE6OF01EMIJJ.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagtttccagactccctggctgtgtctcgtgggcgaggacgggccaccatacgaactgacaacgtccagccagtagttgttttacttcggaccccaacaataacaacttacgttagtcttaggtaccagacaaggaaagtaggactacgtaccctacctaaactccgtagtactttacggtcggtaccgttcccgtacccgggactaacggtttccccgggggttaaccctaaccgtactttaccgagtttcgggacctagggtccggggttaccgtacgggggtaacccttagtttcccaaccgttcctacccgtaacctacgtaccacgggacccgtaccgtccgttaccggacgtacgggtccgttaaggaaacggtacttcggggtacgttacgttaacgttttaacgttaccgtcgttaccaagtaacctaacttaatttacttaccgttacgtttacctacgttacccgttagggaccgggtaacggtaacggaaggtcgggtaaacgacgttaaacccgaaagggttacgtaggtccggtaccgtacgaaccggtcccttaggtacccgtttacgttacccttcgttaaaccccg

SEQ ID NO: 64367 - DNA, 712 bp, Homo sapiens
  misc_feature: GYAE6OF01DB7GA.31.78.H01.1.454.CMB.1.raw
  modified_base (221)..(221): a, c, t, g, unknown or other
  misc_feature (221)..(221): n is a, c, g, or t
  modified_base (388)..(388): a, c, t, g, unknown or other
  misc_feature (388)..(388): n is a, c, g, or t
  modified_base (462)..(462): a, c, t, g, unknown or other
  misc_feature (462)..(462): n is a, c, g, or t
  modified_base (492)..(492): a, c, t, g, unknown or other
  misc_feature (492)..(492): n is a, c, g, or t
tcagcagtagacgtcacgaccggtgctcgatttagtgtgagtagtttgggtttgggggagctacaacaggcaggcgaggggcagcaagatggtgtgcagacccaggtcttcatttctctgttgctctggatcctgtggtcgaccgtagggacagtcgagatgagcctagttcccagcctccctggctgtgctcgagggcgaaggcggccacatacaacgtnacgaacgtcagcgagtagttgtttacctccggacccaacaaataacaacgtactaggtcttaggacagacaaggaagtagactagacccttaacctaaactcctagtaacttcgtacgggaccttaccggacccgggacttaacggttccccgggtaacctaaaacncgttaaccgtagttcgggacgtaacgggtccggtacgtacggaaccgttacttacgaactcttaaccaaacgtntaccaggtctacgtacgtagccgaggttanaggtaatgtagtacgggatttaagtttactaacgtgtaacacgtaactactaacgtttacttcctttacttacgtccgttaacggttcgggacggttaacggaacccgtagggaagaaccgtaaacgttaaaccggaaaacgttaacgtacgggtacgttacccgaaagtacccggtaaacccttagttaccgtaaccgttttcccgaacccgtttaacc

SEQ ID NO: 64368 - DNA, 748 bp, Homo sapiens
  misc_feature: GYAE6OF01CQEKP.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagtttccagacctccctggctgtgtctcgtgggcgagagggccaccatcaactcgcaagtccagccagtagttgttttatcggcccacaataacaactacttagcttaggtaccagacagaaagtaggacacgccctacctaaactcctagtaactttacgtcgggtacctttaccgtaccccgggactaccggttcccggggttaccctaaccgtacttacgtagtttcggcaacggtcgggttacggtacgggtacccgttactttcgtacctccctacgtaaccctaacgtacgaacgccgtacggtcccttacggaccgacgggcgttaaggaagtacgttcggtacggtacgttaagttttacttaacgtgttaccgagtaaccctaaacttaacgtttactttacgtttaccgttttaccggttacttaaccggttttccgggacggggtaccgggtaaaccggtagggttaacggtaagtaccgtaaaccggtaaacggtaaccgtttaggggtcggaccgttaccggtaccctaacccgttacttccgtttacggttccctttaccgttaaccccg

SEQ ID NO: 64369 - DNA, 836 bp, Homo sapiens
  misc_feature: GYAE6OF01AN9LZ.31.78.H01.1.454.CMB.1.raw
  modified_base (534)..(534): a, c, t, g, unknown or other
  misc_feature (534)..(534): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctgatctcgtggtcgaccgtacggggactacgttcgtagatggacgtaccctagtttccacgtaccctcccgtggcttgttcgtcctcggtcgggcggacggaccggcccaaccctatacaacgtcgacctaacgtcccgacgaccgtaaggttagtttcgtttttaccggttccgaaccccctaacgtaaactaaacctaaccgtacgttacgtacgttaccggtaaccaggtaacgagtaaacggtacgactaccgtacccttaacctaaccgtcttacgtaacgtttacggtcggtacctttacccggacccggttcgttacccggttacccccgggttaacctaaccgttacttacgttacggtaccgcggtacgggtcccgggttaccgacggtaaccccgttntttaccgaccttccgtaccaaccgtagtcccgaacggtttacccgcccgttacgtaccggacccggtaggttaacccgtagggtaacgtaacggtttccggggtaacgtcccgttttaaaggtttacgttaccgtcggtaacctacgtacccgtaaatttaccgttacttttacctttcccgtttcgttaccgttaccggttacggacggtacggtaacgtagggtacgaacctaacgaaccgtacggtagttcggaccgttcgacctacctaacttctaccggttccttcgttacctcccg

SEQ ID NO: 64370 - DNA, 826 bp, Homo sapiens
  misc_feature: GYAE6OF01AJXG8.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccacatcaactgcaagtccagccagagttgttttattcggccccacaataacaactacttagcttggtaccagcagaaagtaggacagccctacctaaactcctagtactttacgtgggtacctttccgtaccccggggtctacggttccccgggggtttaccctaaacccggtactttccgagtttcgggaccgtaacggggtcccgggggttcgttacgggggtaacccgttactttttcccgaaccctttcccgtacctaacccctacgtcccggaacggtacccgtaacggtccccgtggaccgtacggggtacccttagggaaaacggttacgttcgggttacggggtaccttttaacgggtttttaacctttaacggttcggttaaccgtaacggtaacccttaaaccgttaacttttaaccgtttaaccgtttttaccgtttttcccgtttacccgttaacccgggtttttccggggaaccggggttaaccggggtaaacccggttaaaggggttacgggtaaacgtaacgtaaccggtaaaaccggtaccgttacgggtcgggtaccgtacgtacccgtaacctacgttaccgttacgttccgttacgttaacccg

SEQ ID NO: 64371 - DNA, 993 bp, Homo sapiens
  misc_feature: GYAE6OF01CQHFA.31.78.H01.1.454.CMB.1.raw
tcagcagtagacgtcacgaccggtgctcgatttagtgtgagtagtttgggttgggggagctacaacaggcaggcaggggcagcaagatggtgttgcagacccaggtcttcatttctctgttgctctggatctctgggtgccgtacggggacatcgtgatgacgtcctagttccagtacctccctggctgtgtcctcggtgggcgaggtacgggcccaacctataccaacgtgacgtaaacgtcccgaacgaccaaggtaggttttcgtttttacgttccgggaccccccaaactaaaattaaacctaaaccttaacgtttaacgtccgtttaacgggtaaccaacggtaacgtaaaacggtaaaacggttacgggaacctaacgtaccccgttaaacctaaaacccgtttccgttaggttaaacgttttaccggaccgggttaccctttacccggggtaacccccgggacgtttaaacccggggtttcccccgggggttttaaaccctaaaaccggttacgtttaccgtaccggtttacggggtaaccccgtagggggttccccgggggttaaccggttacggggggaaaccccttttaacgtttaacccgtaccccggttacccgtttaccaacccggttaaacttaccccgggaagttccgaacccggttaacccgtcgggtaaccggtacgggttacgtaaaggttaaaccggtaggttacgggtccggtttacgttaaaggtttttaccttaccggttcgtacccgttaaacgaacttaaaccgtttacgttttaaaccttacccttttaccggtttaaccgttccggtttaaccgggttttacgggggaacccggggtaacgggtaaccccggttaaaggggttaccggaacgtaaccgtttaaacccgggaaaacggttaccgtacgggttcgaccgtaccgttaccggtacctacgtttaccctacggttccttaaaccgttcccg

SEQ ID NO: 64372 - DNA, 759 bp, Homo sapiens
  misc_feature: GYAE6OF01DEX3A.31.78.H01.1.454.CMB.1.raw
  modified_base (437)..(437): a, c, t, g, unknown or other
  misc_feature (437)..(437): n is a, c, g, or t
  modified_base (731)..(731): a, c, t, g, unknown or other
  misc_feature (731)..(731): n is a, c, g, or t
tcagcagtagacgtcacgaccggtgctcgatttagtgtgagtagtttggggtttgggggagctacaacaggcaggcaggggcagcaagatggtgttgcacgacccaggtcttctatttctctgttgctcgtggatctcgtggtcgccgtacgggactagtcgtagatgacgtccgtagttccagtacctccgtggtctgtgtctcggtcgggcgacggcggacccactactccaacgcgactacgtccacgaccgagttagtttcgttttacgtcccgaacctaactaaataacctaacttacgtacgtacgttacgactaacgagtaacggtaagtacgacgtaccgtaacccttacgtaacctcgtagttacttacgggtcggtaccttcccggaccggtccttacgggttcccgggttaacctacgtcttacgngttcccggagtccgggtcgggtcggttaccggtaacgttacttccgaccttacaccgtaactacgtaccgacgacgtccgtaccgaccgtacggacgtacgtaaggaacgttacggtcggtacgttaacgtttaggttactacgtacaacgtactaacgtaacttacgttacttccgtttacgttaccgttacgtacgggttacggacgggtacggaacgggttaacggacgtaaacgtaaccgtaaacgtaaacggttgttacggtcggtaaccgtcgtaaccgaaccgtttntaccgtttcccgttaagtcccttaccgg

SEQ ID NO: 64373 - DNA, 705 bp, Homo sapiens
  misc_feature: GYAE6OF01CKIJ4.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctcgtggtcgccgtacggggactatcgtgatgacgcctacgttccagtacctccgtggcttgtcgtctcggtgggacgaggacgggaccaccatacctaacgtcgactaacgtccacgacctaggttagtttcgttttacgtcccggacccctaactaaactaacctaacttacgttacgtccgttacggtaccagacgaaaggtaaaggtacgacgtaccgtaccctaacctaaacctcgtagttaacttcggtcggtccttaccggtacccgggtacgtacgggttacccgggttacctaacgtacttcgagttcggacgtcggtcgggtcgtacggtaccttcttacgactcctacacctatcgacgccgcgtcgtcgcgtacgtataggaacgtagtcggtggtacttagttacgttacgtagtaccgtaacgtaacttaacttacgtttactttacgtttccgttaccgttaccgttaccggttacgggacgggtacggtaccggtaggtacggtagtaccgtaacgaacgtagtcggtcgcgtacactactcttatcttctcgtaccc

SEQ ID NO: 64374 - DNA, 741 bp, Homo sapiens
  misc_feature: GYAE6OF01A2SC5.31.78.H01.1.454.CMB.1.raw
  modified_base (189)..(189): a, c, t, g, unknown or other
  misc_feature (189)..(189): n is a, c, g, or t
  modified_base (694)..(694): a, c, t, g, unknown or other
  misc_feature (694)..(694): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctaacggggacatcgtgatgagcctagtttccagacctccctggctgtntctcgtgggcgagacggccaccgatcaactgacaagtccagccagagtttcgttttattcggaccccaacaataactaactacgttacgacttggtaaccagaccaaggaaagtacggacacgacccttacctaaactcctagtacttttacgtcgggtaccttaccggtaccccggccttacggttaccccggggttacccctaaccggtagtttaccgtaacgttcggaccgtacgggcgggggttaccgttacgggggaaccccttaggttttacccacccgtttccctacccaacccgtacgtactacggaccgacgtcctcggacgacggtacgtaagtacgtagttaccggtggtaaccttaggttttaacttaccgtggtaaccaacgtactaaacttgtttaacctacttttccggttaacccgtctttaccgggttacgggaccgggtaacgggtaaccgtaaagggtcgtaaacgaacgttacgaaacgttacgnggttcgactgacccgtactacggttacctctttacccgtcgttaccc

SEQ ID NO: 64375 - DNA, 766 bp, Homo sapiens
  misc_feature: GYAE6OF01CIAR5.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtcgccgtacggggacatcgtgatgagcctagttccagctccctggctgtgtctcgtgggcgagacgggccaccatcaactgacaagtccagccaggtagttgttttacttcggaccccaaccaataaccaacttacttagcttaggtaccagtacaagaaagtaggacagaccctacctaaactcctagtactttacgtacgggtccttaccggtaccccggtatacgttccccgggggtttacctaaacccggtatttccgtaacgtttcggaccgtacggggtccgggggttaccgttacggggggtaacccttacgttttaccaccttaccttacccaacccgtaacttaccgaacggtcctaaccggtcccttacggaccgtaacggtaccgtaaggtaaacgtgttagggtcggtacgttaacgttttaacttacgttcgtacgtaacgaccttaaaactcttttaaccttacttttcccgttttaacgttccgttaaccggttttccggggaccgggttaagggtaacccgaagggttacgaacgtactaaaccgtaaacggtaacgttgggtcggacctacgaccgtacttaacgttcgtttacggtccttccgttaacccg

SEQ ID NO: 64376 - DNA, 736 bp, Homo sapiens
  misc_feature: GYAE6OF01DB5ZV.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggacgaggacgggcccaccatacaactgacaacgtccacgccagtagtttgttttacttcggacccctaacaaataaacctaactaacttagtcttcggtaccagacaagaaagtaggacacgacccttacctaaacctcctagtagtttacgtcggtccttccgtacccggtacgtaccgttcccggggttaccctaaccggtacttctagttcggacgtacgggtccgggtcggttacggggaccgttaacttttccgaacccttccgtacctaaccgtacttccgaacgcgaacggtcccgtacggaccgtagggtacctaaggtaacggtaagttcgggtacggtacttaacggtttttaactaacgttcgtaaccgtacgtactaaactttaatttacgtttacccttttccgttttaccgttcgttaccgtttcggggaccggtaacgggtaaccgtaagggttaggagtactaacgaaacggtaacgttggtacggtcgtacgaccctaactacgttcttcgtccgtttcctaccg

SEQ ID NO: 64377 - DNA, 792 bp, Homo sapiens
  misc_feature: GYAE6OF01EMU79.31.78.H01.1.454.CMB.1.raw
  modified_base (370)..(370): a, c, t, g, unknown or other
  misc_feature (370)..(370): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagacctccctggctgtcgtctcgtgggcgaggagggccaccgatcaactgacaacgtccagacctaggtagttgttttatttccggaccccaactaaataaccaacttacttacgtcttaggtaccagcaaggaaagtacgacacgtcctacctaactcctagtactttacggtcgggtaccttccggtacccgggtntaccggttcccggggtttaccctaaccgttattcctaggtttcggaccgtaggggtcccggggttacgtcgggggtaaccccgttattttccgaaccttaccgacccctaacctaccgttccaacggtacccgtacggtccctcggaccgtaacggcgttaacggaaacgtgtacgggttaccggtacgtttaacggttttacttaacggttcgtaccgtacgtaacctaacttaacgtttacttttaacccgttttccgttttaccgttaccggttaacccggttttccggggaaccggggtaacgggtaaaccggtaagggttagggtaaacgtacgttaaaccggtaaacgtaaggtcggttacgggtacccttagggtaacccctactaccgttcgttcgttcccgttccgtaacccg

SEQ ID NO: 64378 - DNA, 676 bp, Homo sapiens
  misc_feature: GYAE6OF01A8YMF.31.78.H01.1.454.CMB.1.raw
  modified_base (333)..(333): a, c, t, g, unknown or other
  misc_feature (333)..(333): n is a, c, g, or t
  modified_base (350)..(350): a, c, t, g, unknown or other
  misc_feature (350)..(350): n is a, c, g, or t
  modified_base (405)..(405): a, c, t, g, unknown or other
  misc_feature (405)..(405): n is a, c, g, or t
  modified_base (431)..(431): a, c, t, g, unknown or other
  misc_feature (431)..(431): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacgggggacatcgtgatgagcctagtttccagactccctggctgtgtctcgtgggcgaggagggccaccatcaactgcaagtccagccagagttgtttttagttcggaccccaaccgtaaataactaactacttagcttacggaccagacaagaaagtaggacacgcctacctaaactcctgtatttacgngggtcttccgaccgggntacgtccgggttacctaaccgtattcgagttcggcagggtcggtcgtgggacctnttcactcacgaccatcagccagtccngcgacggctaggaaacgtgtcgtggtacttagttttattacgtgtacatactaacgttaatttacttaccttttccgtttacgttaccgttacggttttacccgggacgggtaacggggtaaccggttaaggggtacgggtaaccgtaagttaacccgtaaaaccggttacgttacgggttacggtaccggttaccaccggtaacccctacgttaccgtttacgtttcccgttaccgtttaaccc

SEQ ID NO: 64379 - DNA, 745 bp, Homo sapiens
  misc_feature: GYAE6OF01BEQ3O.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctgtgggcgagcgggccaccatcaactgcaagtccagccagtgttgttttattcggaccccaccaataaccaacttacttagcttggtaccagctaagaaagtacggacacgcccttacctaaacctccgtagtactttacgtgggtcctttaccgtaccccgggtctaccggttcccggggttaccctaaaccggtatttacgtacgttcggccgacgggtccggggttcgtacggggtaccgtacgttttccgaccttcctccaaccctagttccacgcctacgtcccttagaccgtacgggtctaaggaacgtagttcggttacggtacgtttaagttttaacttaccgttgtaaccgacggtacctaaacttactttaactttaccgttttccgtttacccgtacgtttacccgggtttccgggaaccggggtaccggtaaccggtaaggggtaggaaaccgtaacgttaacccggaaaaccggttacgtcgggtccgtacgtacccgaccgttacccgtacgttaccgttcgtttacccttccgttaccccg

SEQ ID NO: 64380 - DNA, 891 bp, Homo sapiens
  misc_feature: GYAE6OF01CIJ60.31.78.H01.1.454.CMB.1.raw
tcagcagtagacgtcacgaccggtgctcgatttagtgtgagtagtttgggtttgggggagctacaacaggcaggcgaggggcagcaagatggtgttgcagacccaggtcttcatttctcttgttgctcgtggatctcgtggtcgccgtacggggacagtcggtgatggacgccgtacgtttcccgactcccgtggcgttgtgtccgtcgtcgggacgacggacggaccaccgataccaacgtcgactaacgtccgacgccgtaaggtagtttcgtttttaacgttccggacccctaaacgtaaacgtaaacctaaaccttaccgttaacggtaccgtttacggtaaacccgaagaaccgtaaaggtaaaaggttaccggaaccgtaccgtaacccccgttaaacctttaaaacccgtccgttagttaaccgttttaccggtacgggtccctttaaccggtacccgggacttaccgggttaccccggggtttaacctaaccgttacgtttacgtaacgtttccggggcgtaacggggtaccgggttacggttaccggggtaaccctttacgtttaccgaacctttcccgaacccgtaactaacggtaccgtacggaacctcggtaccctcggacgtaacggtcgttaaggaacggtagttacgggtacgtacgtttacgttttaacgtacgttcgtacgtaacgtaacgtaaacgttactttacgtttacccgttttcgtttaccgttaccgttacggtttacccggggacggtaacggtaaccggtaacgggtacgtaacgtaaaccggttaaccgaaacggttacggttggtaacgttccgaacgtaccaacgttcgtacgtttaccgtacttaccctaccggttacccg

SEQ ID NO: 64381 - DNA, 734 bp, Homo sapiens
  misc_feature: GYAE6OF01BRHQM.31.78.H01.1.454.CMB.1.raw
  modified_base (197)..(197): a, c, t, g, unknown or other
  misc_feature (197)..(197): n is a, c, g, or t
  modified_base (240)..(240): a, c, t, g, unknown or other
  misc_feature (240)..(240): n is a, c, g, or t
  modified_base (331)..(331): a, c, t, g, unknown or other
  misc_feature (331)..(331): n is a, c, g, or t
tcagcagtagacgtcacgaccggtgctcgatttagtgtgagtagtttgggtttgggggagctacaacaggcaggcaggggcagcaagatggtgtgcagacccaggtcttcatttctctgttgctctggatctcgtggtgccgtacggggacatcgtagatgacgcctagttccagacctccgtggctgtcgtctcgngggacgaggacggccaacatcaactgacaacgtccagccagtnttgtttactcgacccaacaataacaactactagcttaggacagacaagaagtacggacacgtaccctaacctaaactcttagtacttacgnggttccttaccggacccgggtactaaccggttcccgggttaaccctaaacggtattaccagttacggacgtacgggtcgggtcgtaacggggtaccttacttaccgtacctaccgtaccgaaccttagaccgacggtaccgacgtcctaggaccgaggtaccgtaaggaacgtaggtcggtacggtactttaagtttaactacgttacgtaacgaactaactaaactttaactttaacgtttaacctttccgtttaccgttaaccgttaccggtttacggggaaccgggtaacgggtaaccgtaagggtaacggtaacgtaaaccgtaaaccgtaaaaccggtaggttacggtacggtacccgtacgtacctaccgtcttaccggtcttaccgtacttacccg

SEQ ID NO: 64382 - DNA, 790 bp, Homo sapiens
  misc_feature: GYAE6OF01DRF0A.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagacctccctggctgtgtctcgtgggcgaggacgggcccaccatacaactgaccaacgtccagccagtagttgttttattccggccccaactaataaccgtaactacgttagcttacggtaccagacaaggaaagtacggacacgtacccttaccgtaaaccttccgtaggtacttttaccgtcggggtccctttacggtaccccgggtctaccgggttccccggggttacccctaaccgtagttccagttcggcgtaacggtccgggtcgtacggggaacccttacgtttcaaccctcgtacccacctagtcaaggtccgacgtaccctggacccgagggtactaggtaagtacgtgggttacgacgttaggtttttactacggttcgaccgtaacgaaccttaacgtttaaatttcctttaacccgttttccgtttaccggttaccgtttaaccgggtttccgggaacggggtaccgggtaaccggttaaagggtcgggtaaacgttaaccgtaaccggtaaaaaccgttaccgggtttggtaaccgggtaccgtaccgtaacccggtaacccttaacggttccccgtttaagttccccgttaattaacccccccgg

SEQ ID NO: 64383 - DNA, 880 bp, Homo sapiens
  misc_feature: GYAE6OF01BII7Z.31.78.H01.1.454.CMB.1.raw
  modified_base (857)..(857): a, c, t, g, unknown or other
  misc_feature (857)..(857): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagtttccagacctccctggctgtgtctcgtgggcgagacggccacatcaactgacaagtccagccagtagttcgttttattccggacccaactaagtaacctaacttacttaggtcttacggtaccagaccgtaaaggaaacggtacggaccaacgtcccttacctaaacgtcctagtacgttttacgcgggttaccttaccggtacccgggtattacggttccccggggtttaaccctaaaccggttatttacccggagtttaccgggaccgtaaggggtcccggggttacggtacggggtaacccgtttactttcccggtaaccgttacccgtaccgaacccttagttacccgaacggtcctacggtacccgttacgggaccgtaacgggtacccgttaagggaaaaccttcgggttacgggttacggtaaccggttttaaggttttttaacccgttaccggttacggttaacccgaacggttaaacctaaaccgttaaatttttaccgtaaacccgttttccttttacccgggtaaccgtttaacccgggttttcggggaaccggtaacggggtaaccgtaaaggggttaccggtaaacgttaaacccggtaaccggttaaaaccggtacggttaggtttaccggggaccctttacgggaacccttaacccgttgttaaaccccggtttnttaacccgttaacccgttacccc

SEQ ID NO: 64384 - DNA, 765 bp, Homo sapiens
  misc_feature: GYAE6OF01BXJNY.31.78.H01.1.454.CMB.1.raw
  modified_base (191)..(191): a, c, t, g, unknown or other
  misc_feature (191)..(191): n is a, c, g, or t
  modified_base (348)..(348): a, c, t, g, unknown or other
  misc_feature (348)..(348): n is a, c, g, or t
tcagcagtagacgtcacgaccggtgctcgatttagtgtgagtagtttgggtttgggggagctacaacaggcaggcaggggcagcaagatggtgttgcagacccaggtcttctatttctctgttgctctggatctcgtggtgccgtacggggacagtcgtgatgagctagtttccagacctccctggctgtntcgtcgtgggcgaggacgggccacactacaactgactaacgtccagaccaggtagttagtttttacgttccggaccccaactaaactaaccaacttactagtcttaggtacagacaagaagagaccacgaccttacctaactcgtagtactttacgnggtcttaccgtaccgcgtacgttcccgggtacctaacgtattcgtagttcgagtacggcgggtacgtcgggtaccgtaatttccgactttccgacaccgtataccgacgactaccgccgttacgaccgtacggtccgtaagtaacggtaagtcgggttaggtaccgtttaagttttaactaccggtttacgtacgaacggttaacgtaaactttattttaaacttacccgttttccgttttaccgttaacccggtttaaccggtttaccggggaccggggtaacggggtaacccggttaaggggtaaccggtaaggtaaaccgtaaaccggtaaaaccgttacgggttacgggttccggaccgtaccgggtaaccctaaccttacgtccggtttaccgtttccttcgttaacccccg

SEQ ID NO: 64385 - DNA, 861 bp, Homo sapiens
  misc_feature: GYAE6OF01D3G24.31.78.H01.1.454.CMB.1.raw
tcagcagtagacgtcacgaccggtgctcgatttagtgtgagtagtttgggttgggggagctacaacaggcaggcaggggcagcaagatggtgttgcagacccaggtcttcatttctctgtgctctggatctcgtggtgccgtacgggacatcgtgatgacgcctagttccagtacctccgtggctgtgtctcgtgggcgaggcggccaacatacaacgtgaccaagtccagccaaggtagtttgtttttacttccggacccctaactaaaactaaacctaacgttaacgttacggtaccgtttaggtaacccaaggacaaaggtaaaaggttaacggaccacggtacccttaaccgtaaaactcccgttaaggttaactttacccggtggggttaccctttaccggtaaccccgggtacgttaaccgggtttaacccccgggggtttaaccctaaaacccgggtactttacggtaacggtttcgggaccgtacggggtcccggggtaaccgttacggggaaacccctttagtttacccaacgtcccgtaacccgaaactacgtccaaggtcaaccggtcccgtacggacgaggtaccgtaacggtaagttaagtggtacggtagttaacgttttaactacgttacgtaacgtaacgtaaccttaaacttaatttaaccgttaaccgttttccgtttaaccgttaccgttaccggttacggggacccggggtaaacggttaccgggtaacggtaggaaacgttaacccgtaaacgggtaaaaacccgtttagggtaggtaccggtacccgtagtaacccttaaaccgtctttaaccggtacgtttaccgtaacgttaccccg

SEQ ID NO: 64386 - DNA, 613 bp, Homo sapiens
  misc_feature: GYAE6OF01CWL9Q.31.78.H01.1.454.CMB.1.raw
  modified_base (398)..(398): a, c, t, g, unknown or other
  misc_feature (398)..(398): n is a, c, g, or t
  modified_base (423)..(423): a, c, t, g, unknown or other
  misc_feature (423)..(423): n is a, c, g, or t
  modified_base (435)..(435): a, c, t, g, unknown or other
  misc_feature (435)..(435): n is a, c, g, or t
  modified_base (439)..(439): a, c, t, g, unknown or other
  misc_feature (439)..(439): n is a, c, g, or t
  modified_base (446)..(446): a, c, t, g, unknown or other
  misc_feature (446)..(446): n is a, c, g, or t
  modified_base (486)..(486): a, c, t, g, unknown or other
  misc_feature (486)..(486): n is a, c, g, or t
  modified_base (572)..(572): a, c, t, g, unknown or other
  misc_feature (572)..(572): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagctcccgtggctgtgttctcgtgggcgaggacgggcccaccatacaactgacaacgtccacgaccaggtagtttgtttttacgttccggaccccaactaaataaacctaacttaacgttacgtctttacggaccagacaaggaaacgtacggacacgaccttactaaaccttctagtactttcgcggtccttaccgtaccgggctacggttccggtcctaacgtntcagtggcaggtcggtctgggactnttcactctcacntacncgcgacnctgcgaggctagaagtgtcggtcgcttagtttactacgtntcagactacttagtttactcctttcgtttcgtacgttacgttcggacgggtaggtaaccgagggtacgacgtaactacgtaaacgngttgggtacgctacgctacgttatcttacgtcttctacccg

SEQ ID NO: 64387 - DNA, 735 bp, Homo sapiens
  misc_feature: GYAE6OF01CERV7.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgacgcctagtttccagacctcccgtggctgtgtctcgtgggcgaggacggccacatcaactgacaagtccagaccagtagttgttttacttcggccccaacaaataaactaacttacttagtcttaggtaaccagacaagaaaagtcggaacacgccctaactaaacctcgtagtactttacgcgggtccttaccgacccgggtctacggttacccggggtaccttaaaccgactttcgtaacggtttcggacgagggtccgggtacgttacggggaacctattttaccgaccttccgtacaaccctataccgacgtaccgacgtccgtagaccgaacggtcgtaaggaaacgtagttacggtggtacttaacggtttaacttacgtacgtacgtaacgtaacgtaaccttaatttacgttacttttacccgtttacgttaccgtacgtttaccgggacgggtacgggtaaacggtaacgggtaggtaacgtaaacgtaaccgtaaaacggtaacgttacgggtcggtacgtcggaccctaccgtacgttacctttacgtcccgtttactaacccg

SEQ ID NO: 64388 - DNA, 736 bp, Homo sapiens
  misc_feature: GYAE6OF01BWB4O.31.78.H01.1.454.CMB.1.raw
  modified_base (573)..(573): a, c, t, g, unknown or other
  misc_feature (573)..(573): n is a, c, g, or t
  modified_base (590)..(590): a, c, t, g, unknown or other
  misc_feature (590)..(590): n is a, c, g, or t
  modified_base (721)..(721): a, c, t, g, unknown or other
  misc_feature (721)..(721): n is a, c, g, or t
tcagcagtagacgtcacgaccggtgctcgatttagtgtgagtagtttggggtttgggggagctacaacaggcaggcaggggcagcaagatggtgttgcacgacccaggtcttcatttctctgttgctcgtggatctgtggtcgccgtacggggactagtcgtagatgacgcctagttccagtacctcccgtggctgtcttcgcgtgggacgacggacggccacctagtacaactcgactaagtcccagccgtaagtcgtttacgttttactacccggacccctaaactaaaagttaaccaaacttacgttacgaccgttaaggtacccaggaacctaaaaggtaaacggtaacggaacctaccggtacccttaacctaaaacgtccttaagtaacgtttaccgtgggtacccttaccggaccccggtcgttaaccggttacccgggttacccaaacgtattaccgtaggttacgacgtacgggtaccgggttacgttaccgggactttaacgtttcccaacgttccctaccgtaaactactaccgagtcccgaacgtccgtacgacgacggtntacgaagtcgtaacggngtactagttcgttacgatcagtaactactagtttaacttcttacgttccgtacgttacggtcggacgggtacgaagggtaccgtagacgaacctaacggaacgtagttggcgactcgaacactacgtttanctttacgtctacccg

SEQ ID NO: 64389 - DNA, 735 bp, Homo sapiens
  misc_feature: GYAE6OF01C17E2.31.78.H01.1.454.CMB.1.raw
  modified_base (532)..(532): a, c, t, g, unknown or other
  misc_feature (532)..(532): n is a, c, g, or t
tcagcagtagacgtcacgaccggtgctcgatttagtgtgagtagtttggggtttgggggagctacaacaggcaggcaggggcagcaagatggtgttgcagacccaggtcttcatttctctgttgctctggatctcgtggtcgccgtacgggacatcgtgatgacgcctagtttccagacctcccgtggctgtgtcctcgtgggacgacggacgggtcccaactacgtccaaacgtgaccgaaagtcccaggaccagtagtttcgttttagtccggacccccaaataaactaacaacttacgttacgcgttaacggtacacgaacgaagaaaaggtagacctacgccctaacctaaacttctaacgttattaccggtgggtacctttaccgacccgggtactacggttacccggggttactaaccggtattaccgtagttcggacgtacgggtacggtacgtcgggaactattccaacgtctacgacatcgaagctacgcctggaccagggtacagagtacgtaggtaccggntaagtttatacgtgtaaccgacgtacaaacgttactttaacttacccgttacgtttttaccgacgtttaaccgggtttacggacgggtaaaccgggtacccgttaaggggtagtaaacgtaacggtaaaccggaaacccgttagtaccggttgtaccgacgacccttaacggcttacccgttacgttccgtaagtaacccccg

SEQ ID NO: 64390 - DNA, 678 bp, Homo sapiens
  misc_feature: GYAE6OF01CBKI9.31.78.H01.1.454.CMB.1.raw
  modified_base (399)..(399): a, c, t, g, unknown or other
  misc_feature (399)..(399): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctcgtggtgccgtacggggacatcgtgatgagcctagtttccagacctccctggctgtgtctcgtgggcgaggacggccaccatcaactgacaacgtccagccaggtagtttgtttttacgttccggacccctaacaaactaacctaacttacttagccttacggacccagacgaaggaaacgtacggaccacgccctacctaaacctcctagtactttacgtggtaccttccggacccggctacggttcccgggttacctaaccgtnttcgagttcggacgtacggtcgggtcgtacgggacctactttcactctaccacagtaccgagccacgtccgtagacgtacggtactagaagtgtcggtacggtactttaagtttactaccggtgtaccgagtaaccgtaattagtttaacttccgtttaccgtttcgtacgtaccgtttacgggacggtacggtaaccgtagggtcgtacgtaactaacggtaacgtagtgggtccgacgtacgacccgtactagttccgtacgttccttaccgtcccg

SEQ ID NO: 64391 - DNA, 867 bp, Homo sapiens
  misc_feature: GYAE6OF01CD1VE.31.78.H01.1.454.CMB.1.raw
  modified_base (125)..(125): a, c, t, g, unknown or other
  misc_feature (125)..(125): n is a, c, g, or t
  modified_base (133)..(133): a, c, t, g, unknown or other
  misc_feature (133)..(133): n is a, c, g, or t
  modified_base (199)..(199): a, c, t, g, unknown or other
  misc_feature (199)..(199): n is a, c, g, or t
  modified_base (218)..(218): a, c, t, g, unknown or other
  misc_feature (218)..(218): n is a, c, g, or t
  modified_base (289)..(289): a, c, t, g, unknown or other
  misc_feature (289)..(289): n is a, c, g, or t
tcagcagtagacgtcacgaccggtgctcgatttagtgtgagtagtttgggtttgggggagctacaacaggcaggcaggggcagcaagatggtgtgcagacccaggtcttcatttctctgttgctntggatctntggtcgccgtacggggacagtcgtgatggagcctagtttccagacctcccgtggctgtcgtctggngggcgaggacggccaacanacaacgtgacaacgcaagccagtagttagtttagttccggaccccaactaaataaccaaacgttacgttancgttacggtaaccagaacgaaggaaaaggtacggaacacgtacctaacctaaactcctagtaactttacgcggtactttaccgacccgggtctacggttacccggggttacctaaacccgtagttacctagtttacggaccgtacgggaccggggttacgtacgggggaaccgtacgtttacctaacccttccgtaaccaacgtaactaacccgaggtaccgaacggtccccgtagacccgtaaggggtaacctaagggaaagtaaccggtgggtttacgggtaacgttaaaccggttttaactttacccggtagttaacccggaaataaccgttaaaaaccgttaacgttttaaaccgttttaacctttacccgtttttaccggtaccgttttaacccggggtttaccggggaacggggggttaacccggggaaaaaccgtagggggtttaaaccggaaaggttaacgaaaacccggtaaaaccggttaaaacccggtggttacgggtaacccgttacggaacccgtaaacctaacggttacccgtttacggttttaacccttccgttaaaccccgg

SEQ ID NO: 64392 - DNA, 758 bp, Homo sapiens
  misc_feature: GYAE6OF01D8305.31.78.H01.1.454.CMB.1.raw
tcagcagtagacgtcacgaccggtgctcgatttagtgtgagtagtttgggttgggggagctacaacaggcaggcaggggcagcaagatggtgttgcagacccaggtcttcatttctctgttgctctggatctctggtgccgtacggggacatcgtgatgagccagtttccagactccctggctgtgtctcgtgggcgaggacgggccaccatcaactgcaagtccagccagtagtgttttattcggaccccaacaaataacctaactacttagtcttcggtaccagacaagaaagtaggacacgccctacctaaactcctagtactttaacgtggggtccttccggtacccgggactacggttcccggggttacctaaccggtattcgacgttcggcgtacggcgggttcgtcggggtaacccgtatttccgtaacttctaccgtaacctaagtcctaacggccgtaacggtccccgttaggccgtaaggtaccgttaggtaaacggtagtcgggttacggtaccgttaaggttttaacttaaaccgttgggttaaccctaagggtaaccctaaagttaaccgttttaaacttttaacccgtttacgttttacccggttacgttaacccggttttcggggaacgggtacgggggtaaacctaaaggggtaggtaacgtacgttaaccgtaaaacggtacgttgggtacgggaccttacggaccgtaaacctattccgtacggttccttacgtaacccg

SEQ ID NO: 64393 - DNA, 873 bp, Homo sapiens
  misc_feature: GYAE6OF01BVYG3.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctcgtgggcgaggacgggcccaccataccaactgaccaagtccaagcccaaggtagttgtttttacttccggacccccaacctaaataaaccaacttaactttagccgttggtaaccagacaaggtaaaacgtacgggaacacggaccctacctaaaacctccgttagtaactttacgtcgggtcctttacccggtaccccggggactaccggttccccgggggttacccttaaacccggtatttccgtaacggtttcgggaccgtaacggggtccgggggtttacccggtacgggggtaaccccgtttaagtttttaccctaacccgtttcccgttaacccgtaaacccctacgtacccgtaacggacccgtaaccgtcccgttaccggaccggtaacgggtacccgttaagggtaaacggtacggttacgggttacgggttaccgtttaagggtttttaacttaccggtttacggttacgtaaacgtacctaaacgtttacttttaaccgtttaaccgttttaccgttttccgttacccgtttaccggttttacccgggggacggggtaccggggtaacccgtaaggggttacgaaggtaacgtaaccgtaaaacggtacgttacgggtacggtccgtacgaccctaaccgtattacccggtttcgttcgttccgttaacccg

SEQ ID NO: 64394 - DNA, 774 bp, Homo sapiens
  misc_feature: GYAE6OF01AP80W.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagacctcccgtggctgtgtctcgtgggcgaggacgggccaccataccaacctgacaacgtccacgccagtagtttgttttacgttccggaccccaaccaaactaacctaaccgttacttaggtccgttacggtaccagacgaagaaacggtaggactacgccctaacctaaacctctacgtacgttacgtcggtaccttccggtacccgggcgtaccggttcccggggttaaccctaaccgtcttacgtagttccggacgtacggcggttacggtacgggtaccgttcttacaccgtcctaccgtacctacgtactacgcgtacgccgtagcgtacgtcgtaagaacgtaggtcggtacggtacgttaagtttacgttacgtcgtacctataacccgttaacttaacgtttaacctttaccgttttaccggtttacccgtttaccgtttacgggtttaccccgggtaacggggtaacgggtaacccggtaagggtacggaaacgtaaccgtaacccggtaaaacgtccgggttaggtcccggtagtaccggtacccttaaccgttactttaccgttacgtttacccttccggttaaccccgg

SEQ ID NO: 64395 - DNA, 615 bp, Homo sapiens
  misc_feature: GYAE6OF01BCVIV.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagactccctggctgtgtctcgtgggcgaggacgggccaccatcaactgcaagtccagccaggagttgttttattcggaccccaacaataacaactacttagcttggtaccagacaagaaagtggacacgccctacctaaactcctgtatttacgtggtccttccgtacccgggctacggttcccgggttaccctaaaccggtattccgtagttcggacacggtcggggtctggggaaccctatttcgactcctacaaccatcacgcacgcctagcgacggtcgtagaagtcgtagtcggtacgtacgttttattacgttcgtactacgactaactacttacttactttctttccgtacttacgttacggacggtacggaccgtaagggtggtaacgataacgaaacgtacgtggtcgacgtcgacacctatctcgtctctaccg

SEQ ID NO: 64396 - DNA, 815 bp, Homo sapiens
  misc_feature: GYAE6OF01BKIJO.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcattttctcttgttgctctggatctcgtggtgccgtacggggacatcgtgatgagcctagtttccagtactcccgtggccttgtcgtctcgtgggcgaggacggccacatcaacgtgacaacgtccacgaccagtagttgttttacttcggaccccaacaaataacctaacttacttagtcgttacggtaccagacaaggaaagtaggaccacgtccctacctaactcctagtactttacggtcggtccttaccgtacccgggacgtacggttacccgggttaccctaaccggtattccgtagttcggacgtaacgggtccgggtaccgttaccggggaaccttacgttttcccgacctttaccgtacgtaaccctagttacccgaacggtaccacggtcccgttacgacggtacggtacccgttaaggaaacgttagtcgggtacgggttactttaaaggttttaacttaccgttagttcgaaacgttaccgtaaactttacttaacctttaccttttaccgtttacccggtttaacccgtttccgggtttaaccggggtaccgggtaaaccggggtaaacccggttaaaggggtaccggtaaacgttaaacgttaaaccgaaaccgggttaaacgttcgggttagaccccgtttagaaacccgtacgttaaccttaccggttacttccgttacgtacccccgg

SEQ ID NO: 64397 - DNA, 598 bp, Homo sapiens
  misc_feature: GYAE6OF01CA2IZ.31.78.H01.1.454.CMB.1.raw
  modified_base (319)..(319): a, c, t, g, unknown or other
  misc_feature (319)..(319): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagcagcagagtgtttattggccacaataacaactactagctggtacagcagaaagtggacagcctactaaactcctgatttactgggcttccacccgggtnacgtcccggggttacctaaccggattcgtattcggcaaggtcggggtactcgggactagtttccacttccgtacacctagtcaagccacggccttagcaggtctagaaagagtcggtggacctaagttttagttactagttaccaggttacaaacctaattacgttaacttctttaccgtctaaccgtttccgggacgggtacgggaaccctagggtacggacgtataacgaaacggtaactgtcggactcggctaacagtacctcgttcctcgtaccg

SEQ ID NO: 64398 - DNA, 767 bp, Homo sapiens
  misc_feature: GYAE6OF01C08ZD.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctcgtggtgccgtacggggacagtcgtgatgacgccagtttccagacctccctggctgtgtctcgtgggcgagacgggccaccatcaactgacaacgtcacgcagtacgttgtttactcggaccacaataacactactagcttacgacagacaagtaagtaggacacgtacctacctaaacctccgtagaacttttaccgcgggttccttaccggtaccccgggtactaccggttccccggggttacccctaaacggtactttccgaacgtttcggaccgtacggtccggggttccgtacgggtacccgttacgttttccaaccgtttcctacccgacctactccgacgacctacggtccctcgtaccgaagggtaccttaggaagtacgttagggtcggtacgtttaagttttaacgtacgttgtaccgtaaacgtacctaactttaagttttacccgtttaactttttcccgttaaccgttaccggttaacccgtttaccggggtaacggggtaaccgggtaaccggtaaagggttaccggaaacgttaaccgttaaccggaaaacccggttagtcgggttacggaccgttaggaccctacctaggtttccgtaccgttgttccccttaacccg

SEQ ID NO: 64399 - DNA, 819 bp, Homo sapiens
  misc_feature: GYAE6OF01DS58Z.31.78.H01.1.454.CMB.1.raw
  modified_base (134)..(134): a, c, t, g, unknown or other
  misc_feature (134)..(134): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctntggtgcctacggggacatcgtgatgagccagtttccagactccctggctgtgtctctgggcgagaggccaccatcaactgacaagtccagccagagttgttttattcggccccaacaaataaacaacttacttagcttggtaaccagacaagaaaagtggaacagccctacctaaaactcctagtaatttaacgtgggtacttcgtaacccgggctaacgttcccggggttacctaaaccggtactttcgaacgtttcggacgtaagggtccggggttacgttacggggaacccgtattttaccgaaccttcctaccaacccgtaataccgacggaccaacgtcccttaggacccaaggggtccttaaaggtaaaacgtaggttcggttacgggaacgttaaacggttttttaattaacccgttggttaactaacggaacctaaaaccttaacttttaaacttaacccgttttcccgtttttaccgttacctttaaaccggtttttccgggggaaccggggtaaacgggggtaaccccgttaaaaggggttcgggaaaacgtaaacggttaaacccgtaaaaaaaacccggttaacgtttacggggtaacgggtaacccgttaacggaacccctaaacccgtaaagtttcccgttaacggtttacccgtttaccgtaaaccccgg

SEQ ID NO: 64400 - DNA, 784 bp, Homo sapiens
  misc_feature: GYAE6OF01DDBX0.31.78.H01.1.454.CMB.1.raw
tcagcagtagacgtcacgaccggtgctcgatttagtgtgagtagtttgggtttgggggagctacaacaggcgggggaggcagggggcagcaagatggtgttgcagacccaggtcttcatttctctgttgctctggatctctggtgccgtacggggacatcgtgatgacgcctagttccagacctccctggctgtgtctcgtcgggcgaggacgggacccacctataccaactcgacaacggtccagccaaggtagttgttttacgttaccggacccccaactaaactaaacctaacgttaaccttagacgttacgtaaccgagaactaaaggaaagtaacggacaaccgtacctacctaaacctcctagttacttcgtcggtcctttaccgcccggacgtacggtacccggggtacctaaccggtattcgtaacgttcgacgacgggtcgggtacgtacgggaccgttacttccgactccctacgtacctaatccgagacgtaccggtaccgtcggacgtaacggcgttaacggaaaggtcgggttaggttacggtaacggtttaattttaccgtacgttaccgttaagaacgtacccttaaaaccttattttaaacgttcccggtttttacctttcggtaacccgtttacggtttaccggggggaacggaccggggtaaacgtaacggggttagaaaccggttactaaaaccggaaaccgtagtagggttccaccttacggaccttaacccgttacttacgttactaaccgtttctaaccccg

SEQ ID NO: 64401 - DNA, 587 bp, Homo sapiens
  misc_feature: GYAE6OF01A9T6L.31.78.H01.1.454.CMB.1.raw
  modified_base (314)..(314): a, c, t, g, unknown or other
  misc_feature (314)..(314): n is a, c, g, or t
  modified_base (423)..(423): a, c, t, g, unknown or other
  misc_feature (423)..(423): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccaacaataacaactacttagcttggtaccagcagaaagtaggacagcctacctaactcctgactttacngggtcttcctacccgggctacgtccggggttacctaaccgattcattggcagcgggtcgtgggaccgtattcacgtcctcaccatcacgtcacgcctgcaggctagaantggtgctagtttactacgtgtacagcaactagttacttacctttactttaccgttctacgtttccgggacggacgggtaacctaggggtagtaacgacgtaacgaaaaccggtaagtcggtggtacctagcccgtaaacagttaccttcgttccgtttctaccg

SEQ ID NO: 64402 - DNA, 647 bp, Homo sapiens
  misc_feature: GYAE6OF01D1Y9N.31.78.H01.1.454.CMB.1.raw
  modified_base (162)..(162): a, c, t, g, unknown or other
  misc_feature (162)..(162): n is a, c, g, or t
  modified_base (187)..(187): a, c, t, g, unknown or other
  misc_feature (187)..(187): n is a, c, g, or t
  modified_base (341)..(341): a, c, t, g, unknown or other
  misc_feature (341)..(341): n is a, c, g, or t
  modified_base (359)..(359): a, c, t, g, unknown or other
  misc_feature (359)..(359): n is a, c, g, or t
  modified_base (400)..(400): a, c, t, g, unknown or other
  misc_feature (400)..(400): n is a, c, g, or t
  modified_base (452)..(452): a, c, t, g, unknown or other
  misc_feature (452)..(452): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtcgccgtacggggacatcgtgatgngcctagttccagtctcctggctgtntctcgtcgggcgagacggcccaccatcaactgacaagtccagccagtgtttgttttacttccggaccccactaataacaactacttagcgttacgtaccagcaagtaaagtcgacacgtcctactaactctagtattcgtggtcttcgaccggntacgtccgggtacacgtntactagtcgcgagtcgtgcggacctattccactcacacgtntcgagcacgcctcgacgagtcgtagaaagtcgtaggtcgtactttaagtttnttaccgtgttaccgaacgtaccgtaacttactttaaccgtttacgttttcccgtttacggttacccgtttaggtttcccgggaaccgggtagggtaaccgtaagggttacggaacgttaacggtaaaccgtaaaaccggttagttccgggtagtccgtagaccctacgtactttacgttccgtcgttcctacccg

SEQ ID NO: 64403 - DNA, 636 bp, Homo sapiens
  misc_feature: GYAE6OF01AQBS3.31.78.H01.1.454.CMB.1.raw
  modified_base (283)..(283): a, c, t, g, unknown or other
  misc_feature (283)..(283): n is a, c, g, or t
  modified_base (363)..(363): a, c, t, g, unknown or other
  misc_feature (363)..(363): n is a, c, g, or t
tcagcagtagacgtcacgaccggtgctcgatttagtgtgagtagtttgggtttgggggagcctacaacaggcaggcaggggcagcaagatggtgttgcagacccaggtcttcatttctctgttgctactggatctctggtgccgttacggggacatcgtgatgagccagtttccagactcccgtggctgtgtctcgtggcagacggccacatccaactgcaagtccagccagtagttgttttattcggccccaaccaataacaactacttagcttcggtaccngacagaagtcggacagccctactaaactcctagtatttacgtggcttcgtacccggctacgtcccgggttaccaaccgtnttcagttcggctacgggtcggtccgtacgggacctatttccacctctccaacctatcgagcacgccgtagcaggactgaacgatcggtacgacgtagtttacgtactcgtacacgactaaccgtattacgttaacctttcgtttaccgttacgtaccgtttacgggaccggtagggaacccgtaagggtagaccgtaacgtaaccgtaaacggtacgtggtccggtacttccgggaaccctaccgtacttccttaccgtcccttcgtaacccg

SEQ ID NO: 64404 - DNA, 648 bp, Homo sapiens
  misc_feature: GYAE6OF01C4L0L.31.78.H01.1.454.CMB.1.raw
  modified_base (462)..(462): a, c, t, g, unknown or other
  misc_feature (462)..(462): n is a, c, g, or t
  modified_base (507)..(507): a, c, t, g, unknown or other
  misc_feature (507)..(507): n is a, c, g, or t
tcagcagtagacgtcacgaccggtgctcgatttagtgtgagtagtttggggtttgggggagctacaacaggcaggcaggggcagcaagatggtgttgcagacccaggtcttctatttctcttgttgctctggatctctgggtcgccgtacggggacatcgtgatgagcctagtttccagacctcctggctgtgtctcgtgggcgagacggcccaccatcaactgacaacgtccacgccagtagtttgttttacgttccggccccaacaataaacctaactacttagtccgttgtaaccagacaaggaaaagtaggaccacgtaccctaaccctaaactccgtagttactttacgcgggtcttccgtacccgggctacggttccgggttacctaaccgtcttctagtggaccgacggtccgggtcgtaggggtacctattcacgttctaccaccgatcacgcncgcctggacaggactagagtgtgtaggtctttaagttacttacgngtacacgacttaaactattttacgttacctttcttttcgtaccgttacgggtttcgggacgggacggtaacggagggtaggacgtactaacgaaacgtacgtgtcggctacgccgtaacctattgttctaccttccgtacg

SEQ ID NO: 64405 - DNA, 679 bp, Homo sapiens
  misc_feature: GYAE6OF01BQOVO.31.78.H01.1.454.CMB.1.raw
  modified_base (641)..(641): a, c, t, g, unknown or other
  misc_feature (641)..(641): n is a, c, g, or t
  modified_base (651)..(651): a, c, t, g, unknown or other
  misc_feature (651)..(651): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagtacctccgtggctgtgtctgtgggcgaggacggccacatccaactgacaagtccgagcctaggtagtttgtttttacgttccggaccccctaacgtaaactaacctaaacttacttacggtccttacggtacctacgacgaaggaaagtacggacgacgtacctacctaacctcgtcgttaactttacggtcggtaccgttaccgtacccggccgttaaccgtcccggggtttaccctaacggtacttccgagttacggcgtacgggtcggtacgtcgggaccgttacttacgccgtcctcgacctatccgacgcacgccttcggacgacggtctaggacgtagtcggttacgtagttacgtttacgtactcgtacacgactaactttactacgtttactttccgtacgttccttacgttcgggacggtacggtacggaggtcgtaatagacccgtaagtactcggngtcacgtacncttatacgttcttaccgtacgttacccg

SEQ ID NO: 64406 - DNA, 708 bp, Homo sapiens
  misc_feature: GYAE6OF01D7FOD.31.78.H01.1.454.CMB.1.raw
  modified_base (220)..(220): a, c, t, g, unknown or other
  misc_feature (220)..(220): n is a, c, g, or t
tcagcagtagacgtcacgaccggtgctcgatttagtgtgagtagtttgggtttgggggatctacaacaggcaggcaggggcagcaagatggtgttgcagacccaggtcttcatttctctgttgctctggatctctggtgccgtacggggacatcgtgatgagcctagtttccagacctcccgtggctgtgtctcgtgggcgaggacggccaccatcaacngacaagtccacgccagtagttgttttacttccggaccccaactaaactaaactaaccttacttagtcgttacgtaaccagacaagtaaaggtagacacgcctacctaactcgtatacgtttacgtcggtccttccgtacccggactaccggttcccgggttacccttaaccgtcttacgtagttcggcgtacgggtccggggttacgtaccggggtaccttacgtttcccacgttaccctccgaaccctattaccgaacgcgtaccgaccgttacggaccgtacggtactaggaacggtagttcgggtacggtactttaagttttactaccgttgtaaccagtacctaacttactttaacgttactttccgtttaccgttacgttaccggtttcgggacgggacggtacggtaacggtgaacgtacgtaacggtaaacgtcgttaggtcgacgaccgacgtaacctagtacgttcttccttctacccg

SEQ ID NO: 64407 - DNA, 856 bp, Homo sapiens
  misc_feature: GYAE6OF01E01N6.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtcgccgtacggggacatcgtgactgagcctagtttccagactcctggctgtgtctcgtgggacgaggagggccacatacaactgacaacgtccagccagtagttgttttacttcggaccccctaataaactaaacgaacttacttaacgcttaggtaaccagcaagaaagtaggacacgtcctacctaaactcctagtactttacgtgggtaccttccgtaacccgggtctaacggttacccggggtttacctaaaaccgtatttaccgtaagttcggacctaaggggtcccggggttacgtagggggtaaaccccttacgttttaccgaaccttacctaccgtaaaccctaacgtaccgaacggtaccgaaccgcccgttaggaccggtaaacgggtccttaaacgggaaaggttaacgttcgggttaacgggttacctttaaagggtttttaacttaacccggtaccgggttaacaaaccggtaaccgttaaaaccttaaccgtttttaacgtttaacccgttttaccccggtttttaacggttaccccgtttaaacccgggtttttaccggggaacccgggggttaaacgggaaccccgggttaaaggggtacgggtaaacggtaaacctaacccggtaaaaacgtaacggttcgggttaacgacccgtaggtaacccctaacgtacgttaccttcggttaccttacgttaacccg

SEQ ID NO: 64408 - DNA, 792 bp, Homo sapiens
  misc_feature: GYAE6OF01AF3GL.31.78.H01.1.454.CMB.1.raw
  modified_base (199)..(199): a, c, t, g, unknown or other
  misc_feature (199)..(199): n is a, c, g, or t
  modified_base (203)..(203): a, c, t, g, unknown or other
  misc_feature (203)..(203): n is a, c, g, or t
  modified_base (242)..(242): a, c, t, g, unknown or other
  misc_feature (242)..(242): n is a, c, g, or t
  modified_base (536)..(536): a, c, t, g, unknown or other
  misc_feature (536)..(536): n is a, c, g, or t
  modified_base (544)..(544): a, c, t, g, unknown or other
  misc_feature (544)..(544): n is a, c, g, or t
tcagcagtagacgtcacgaccggtgctcgatttagtgtgagtagtttgggtttgggggagctacaacaggcaggcaggggcagcaagatggtgttgcagacccgaggtcttcatttctctgttgctctggtattctctggtcgccgtacggggactattcgtgactggacgcctagtttccagtacctccgtggctgtnttcncgtagggcgagacggccaccatacactgacctaagccanccaggtacttgttttacgtccggaccccaacgtaaactaactaacctacgttacgtcgtttacgtaaccgacgtacgaaacggttaaaaggacggtaaccacggttacccccttaacgttaaaacccgttccttagttaacggttttaccggtcgggtttaccttacccggtaaccccgggacgtttacccggttaccccgggggttaaccccttaaccggtaaccttttcggaacgttcgggactaccgggcgggttacgtaccgggtacttaaccgtttcaccggtttaccncgtaaccncgtactacggcacgttccacgtcgtacggtacgtacggactaggttacgtagtacgttaagtttacgttacgtagttacgtaactaccgttataagtttacttaactttacgttacctcgttacgttaccggacggtaacgggtcgaacggttagggtaccttaacgtaaccgttaacggtaagttacgggtacgtaccgtacgggttacctacgttacgttaccggttcttccgttaaccttacccg

SEQ ID NO: 64409 - DNA, 745 bp, Homo sapiens
  misc_feature: GYAE6OF01CAYFJ.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagactccctggctgtgtctcgtgggcgagacggccaccagtcaactgacaagtccagccaagtgtttgttttacttcggaccccaactaataacaacttacgttagccgttacggtaccagacaagtaaacgtagacacgaccctaccgtaaactccgtagtactttacgcgggtccttaccgtacccgggtctacggttcccgggttacctaaccgtacttcagttcggcgtacggtcgggtcgttacggggaccgttactttccgaacttccgttaacctaccgtacgttacctacgggtccgtaaccggtacccgtcggtaccggtaacgggtccgttaaacgggaaggttacggttcgggtaacggttacttaacggtttttaacgttacgttacgttacgtacgtaacgtaacctttaacgttacctttaaccgttttccgtttaccgtaccgttaccggttccgggacgggtacgggtaaccgtaggggtacgtaacggtactaaccgaaaccgtaggtcggtcggtacgtaccgaccgtacacgttctaacgttcctacgttacccg

SEQ ID NO: 64410 - DNA, 953 bp, Homo sapiens
  misc_feature: GYAE6OF01AZH3H.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctcgtggtcgccgtacggggacagtcggtgatggacgcctagtttccacgtacctcccgtggcttggtcgtctcgtgggcggaggcggcccaccataccaactgaccaacgtccagaccgagtacgtttagttttacgttccggacccccaactaaataacctaacgttaccttacgtccgtttacggtaaccacggtacgaaaggtaaacggtacggaactaccggtaccccttaaccctaaccgtccgtacgttaacgttttaccggttcgggtacccgtttacccgggtaccccgggtacgttacccgggtttaccccgggggttaacccttaaaccggttacgtttaccgttaacggtttaccgggacggttaaccgggttccggggttacccggttacgggggtaaccccttacgtttaccctaccgttacccgtacccggtaaccacgttccgaacggcccgttaaccgggcccgttacggaccggttacgggtacgtaaacggtaacggttacggttcgggttaaccggttcgtttaaacggtttttaaccgtaccggttacggtaccgttaacgtaacctaaaccgttttactttaaccgttttacccgttttacccgtttacggttacccggtttaaccggggtttaccggggaaccggggtttaacggtacccgggttaaagggttacgggaaaccgttaaccggttaaaccgtaaaccgggttacggttaccggggttcttaacccggacgttaacccctaaccgttttacgttaccgggttacccctttccgtttaccccgtaaccccgg

SEQ ID NO: 64411 - DNA, 715 bp, Homo sapiens
  misc_feature: GYAE6OF01EJSEJ.31.78.H01.1.454.CMB.1.raw
  modified_base (690)..(690): a, c, t, g, unknown or other
  misc_feature (690)..(690): n is a, c, g, or t
tcagcagtagacgtcacgaccggtgctcgatttagtgtgagtagtttgggtttgggggagctacaacaggcaggcaggggcagcaaggatggtgttgcagacccaggtcttcatttctctgttgctctggatctctggtcgcctacgggacatcgtgatgagcctagttccagactcccgtgctgtgtctcgtgggcaggcgggcccacatcaactgacaacgtccagcctagtgttgttttattcggacccccaactaactaaacgtaacttacttacggcttacggtaaccagacaaggtaaacgtggaccacgtccctaccttaaacctccgttagtactttacggtggtaccttccgaccccgggtgtaacgttcccggggttacctaaccgtattccagttcggcgtaacggtcgggtctcggggtaacctacgtttccactttaccgcctaaaccgattccgaacggtacctacgtaccgtcggtacgacggtacgttaggaaacgttggtagggtacggtacgtttaacggtttacgttaacgttcgtaccgtaagtaaccgtaattacgtttaactttaaccgtttcgtttaccgttaccgttcggtttaccgggacggtacgggtaaccgacgggtagtacgtaactaccgaacgttagtcggtacggtcctgaccctacncgttacgttcgtccttacgtacccg

SEQ ID NO: 64412 - DNA, 823 bp, Homo sapiens
  misc_feature: GYAE6OF01B1G4N.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgacgcctagtttccagtacctccgtggctgtgtctcgtgggcgaggacggccaccatacaactgacaacgtccacgtaccaggttagtttagttttacgttccggacccctaaccaaacttaaaccaacttacgttacgtcgttacgaccagacgaaagtaaacggtacggactacgtaccctacctaaacctctagtacgtttaccgtcgggtaccttacccggacccggtactacccggttaccgggttaccctaaccgttcttaccgtgttacggcgtacggggtcggtccggttacgggtacccttagttttcccaaccgtcctacccgaactaccgtacgacgtaccgtacgtcccgtacgacggtaccggtacttaaggaacgtaggttaggtacggttacgtttaacgtttacgttacgttcgtaacctacgttaactaaacctttacttacgtttaaccgttttccgtttacggttacccgttaccgggttttaccggggaacgggttaaccggggtaacgggtaacggggttaaacggtacggtaacccggttaaaccggtaaaccggttacggtttaccgggtcgtttaccgggacccgttaccgaacccgtttacgtttaccgttccgttttaccgttacccgttaaccccgg

SEQ ID NO: 64413 - DNA, 716 bp, Homo sapiens
  misc_feature: GYAE6OF01BTYIE.31.78.H01.1.454.CMB.1.raw
tcagcagtagacgtcacgaccggtgctcgatttagtgtgagtagtttgggttgggggagctacaacaggcaggcaggggcagcaagatggtgttgcacgacccaggtcttcatttctctgttcgctcgtggatctcgtggtcgccgtacgggactgtcgtgtatgacgtcctacgttccagtcctccgtggctgtgtcgtcggtgggcgaggacggccacgatacgaactgacaacgtcacgccagtgttagtttacgtccgaccctaactaaataacctaacttactacggtcctacggtaaccagacgaaagaacggtacggactacgtaccctaactaaacgtccgtagtaccgttacgtcgggtctttaccggaccggtcgtaccggttacccgggttacctaacgtcgttacgtacggttcggacgtagggtcgggtcggtacgggtaccttcttaccgactccacacctagcaccggactacgcgttcgacggtacggacttaaggacgtaggttacggtacggtactttacgttacgttacgcgtacgaactaactaacttacgtttaccttacgtttcctttaaccggttcttaccgggttaacgggaccggttaacggtaacggagggtaaggtacgtaacgtaaacgaacgtacggtacggtccgtactcccgtaactacgtcttacgttcttaccgttctacccg

SEQ ID NO: 64414 - DNA, 755 bp, Homo sapiens
  misc_feature: GYAE6OF01BETFS.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctcgtggtcgccgtacggggacatcgtgatgagcctagtttccagacctcccgtggctgtgtctcgtgggcgaggacgggcccaccatcaactgaccaacgtccagcctaaggtcgtttcgttttacgtttccggaccccaactaaactaaccaaacgttacttacgtcgttacggtaccagtacaagaaaggtaggacacgccctaacctaacctctagtatttcgtgggtccttaccggtacccgggtctacggttcccgggttacctaacgtcttactaggttcggacgtacgggtcggggtccgtacggggtacccgttagtttcccacttcctacccaacctactcacgtccgacgtacctggacgtacgggtctaggaagtacgtggtacggtaccgttaaggttttacttcggttcgtacgtaaacggaccttaaacttacgtttaactttaaccgttttccgttttaccggttaccgtttaccggtttcgggggaaccgggtaacgggtaaccgtaaggggttcggaaacgtaacgtaaaccggtaaaacgttacgggtgggttaacgcgtacccggactacccgtactttcgtacctttccgttacgtaaccccg

SEQ ID NO: 64415 - DNA, 834 bp, Homo sapiens
  misc_feature: GYAE6OF01D3WRE.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagtacctcccgtggctggtgtcgtcgtgggcgaggacgggacccaccatacaacgtcgacaagtccagaccagtagtttgttttacttccggaccccctaactaaataaacctaaccttaacttacgtccgttacggtaaccagacaaaggtaaacgtacggactaccgtacccttaacctaaaccgtccgtagttaacgttttaccggtcgggttaccctttacccgggtaaccccgggtcttaaccgggttccccgggggtttaacccttaaaccggtactttaccgtaaggtttcggaccgtacggggtccgggttacgtacggggtaacccgttactttccgaaccttccgtacccgaacccgtacgtaccgaacggacccgtaccggtcccgttacggaccggtaggaccgttaaggaacggtacgttacgggtacggttactttaacggttttaacgtacgttacggtacgaacgtaccttaaacgttactttaacgtttaccgtttcgtttaccggttaccgttacgggtttaccgggacgggtacgggtaaccgtaagggttacgacgtaacttaaccggaaaacggttacgttcgggtacgtcccgttacgaacccgttacttacgttaccgttcgttacccttcgtaccccg

SEQ ID NO: 64416 - DNA, 806 bp, Homo sapiens
  misc_feature: GYAE6OF01B0SW5.31.78.H01.1.454.CMB.1.raw
tcagcagtagacgtcacgaccggtgctcgatttagtgtgagtagtttgggtttgggggagctacaacaggcaggcaggggcagcaagatggtgtgcagacccaggtctcatttctctgttgctctggtatcctgtggtcgaccgtacggggacagtcgtgatgacgcctagttccagtacctcctggctgtcgtctcggtcggcgacggacggaccacatcaacgtcgacaacgtccacgacctaggtacgttttagtttaccgtaccggacccccaaaactaacttaaaccctaaaccgttacgtttacgtaccgtttacggtaaccctaaggaactaaacgggaaacggttcggaaaccaaccggttaccccttaaccttaaaccgtccgttaaggttacctttacgggtaccggtaccctttacccggacccgggtacttacccgggtccccgggtttaacctaacgtagttcgtacgtggaccgaggtccgggtacgtcgggtactacgttccgactccgtaaccaccgtactcgacgaccgtacgtccgtacgacgtacggactacggaaagtccggttaggtaccgttacttacgtttacttacggtacgtacctaaccgtacgttaaaccttgttttaacccgttccgttttaccgtacccggttaccgttacggttaccgggaaccgggtacgtaaccgggtaacgggtcgaaacggtaccgtaacggtaaacggtacgggtacggtcgtacctaccggacttaccgtgtttaccgacttacccgttacctaccccgg

SEQ ID NO: 64417 - DNA, 651 bp, Homo sapiens
  misc_feature: GYAE6OF01E3W7C.31.78.H01.1.454.CMB.1.raw
  modified_base (394)..(394): a, c, t, g, unknown or other
  misc_feature (394)..(394): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgacgcctagtttccagacctccctggctgtgtctcgtgggcgaggacgggcccaaccataccgaactgacaacgtccagccagtagttgttttacttccggaccccaactaaactaaccaacttacttacgtcgttacggtaaccagacaaaggaaagtcgacacgtcctacctaactctagtacttacgtcggtacttccgaccggtactacggttacccgggtacctaacgtntcagtcggcgaggtcggtcgtacggacgtattccactctaccactctacgacgccacgcctgaccgtaggtactaggaaagtgtcggtacgtacttagtttaactacgtgtacgaagtacctaacttatttacttacctttcgttcgtacgttaccggttacgggacggtacggacgtaaggtcggaacacgtaaccgtaacggagttcgggcgtacgtccgacctaaccttgttaccgtctttcgtcccttacccg

SEQ ID NO: 64418 - DNA, 693 bp, Homo sapiens
  misc_feature: GYAE6OF01DTTB3.31.78.H01.1.454.CMB.1.raw
  modified_base (345)..(345): a, c, t, g, unknown or other
  misc_feature (345)..(345): n is a, c, g, or t
  modified_base (372)..(372): a, c, t, g, unknown or other
  misc_feature (372)..(372): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagacctccctggctgtgtctcgtgggcgagcggccaccatcaactgcaacgtccagccagtagttgttttatcggccccaacaataaccaactactagcttaggtaccagacaagaacgtaggacacgacctacctaaactctagtactttacgtcggtccttccgaccgggntacggttcccggggttacctaaccgtnttcagttcggacgagggtccgggtcgtacgggtaccgttactttccgaaccttctacctacctatccgacgtcgaccgccgtcggaccgaggtacgtacgaagtcgtaggtacggtactttaagtttactacgtagtcgaacgtactaacttaactttactttacccgtttcgtttaccgtacgttaccggttacggggtaacgggaccgggtacggtaagggttcggaaacctaggttaaccgtaaaaccggttaggttacgggtcgaccgtacgtaaccgtacccttagttcccgttacgttccctttagttacccccg

SEQ ID NO: 64419 - DNA, 611 bp, Homo sapiens
  misc_feature: GYAE6OF01B2ZHS.31.78.H01.1.454.CMB.1.raw
  modified_base (325)..(325): a, c, t, g, unknown or other
  misc_feature (325)..(325): n is a, c, g, or t
  modified_base (366)..(366): a, c, t, g, unknown or other
  misc_feature (366)..(366): n is a, c, g, or t
  modified_base (396)..(396): a, c, t, g, unknown or other
  misc_feature (396)..(396): n is a, c, g, or t
  modified_base (410)..(410): a, c, t, g, unknown or other
  misc_feature (410)..(410): n is a, c, g, or t
  modified_base (413)..(413): a, c, t, g, unknown or other
  misc_feature (413)..(413): n is a, c, g, or t
  modified_base (418)..(418): a, c, t, g, unknown or other
  misc_feature (418)..(418): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagtttccagacctccctggctgtgtctcgtgggcgagacggccaccatcaactgacaagtccagccagtagttgttttattcggccccaacaataacaactacttagctggtacagacagaaagtaggacacgccctacctaaactcctagtactttacgnggtcctttcgacccgggctacgttccgggttacctaaccgnttacagttcgcaggcggtcgtcgggacctntttccactctcacntcncgtcncgcctgcgaggctagaagtagtggtgaccttagtttacttacgtgtacacgtaactaacgttattacttactttcgtttcgtacgttacgtttcgggacggtacgggaacgtaagggtggaacgtacgtaaccgtaaaccgtacgttacggtggtaccgtacgacctacctacttcttcgttcttacgttacc

SEQ ID NO: 64420 - DNA, 845 bp, Homo sapiens
  misc_feature: GYAE6OF01ERZKB.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcattttctcttgttgctctggatctctggtgcctacggggacatcgtgatgagccagtttccagactccctggctgtgtctcgtgggcgagacggccaaccatcaactgacaacgtccagccagtagttgttttattcggaccccaacaactaacaacttactagtcgttagtaccagacaagaaagtaggacaagcccttacctaaaccgtaccttagtagttacgtcgggactttccgtacccgggctaacggttccggggtttaccctaccggtaacttacgtacgtttacggactacgggtccggggtttaccggttacggggtaaccccggttacgttttacctaaccgtttaccctacccgtaaaccctaacgttacgaacgtccgaaccgtcccgttacggccgtaagggtcccgttaaggaaacggtgttcggtcggtaccgtttaaggttttaacgtttaccgtcggtttaaccgaacggtaaccctaaacgtttaacgttttaacttttaacccgtttttccgttttaaccgttaccttaaccgggtttttaccggggaccgggttaaacggggtaaccccggttaaggggttaacggtaccgtaaacggttaaacccgttaaaacggaaaccgggtttgggtaacccggggttcccgttaaacgggtaccgtaaacccgttacgttaacccgttttacggtttaacccgttccgtttaaccccg

SEQ ID NO: 64421 - DNA, 838 bp, Homo sapiens
  misc_feature: GYAE6OF01AQ31M.31.78.H01.1.454.CMB.1.raw
  modified_base (235)..(235): a, c, t, g, unknown or other
  misc_feature (235)..(235): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagacctcctggctgtgtctcgtgggcgagaggccaccatcaactgcaacgtccagccagagttnttttagttcggccccacaataaccaactacttagcttgtaccagcaagaagtaggacagcctacctaactcctagtactttacgtggtccttccgtacccgggctacgttcccggggttaccctaaccggtatttaccgagtttcggccgtaacgggtccggggttaccgttacggggaacccgtttacgttttaccgaccgtttaccctcccgtaaaccgtacgtaccgaacggtccaacggtcccgttggaccgagggtaccctaagggtaaacggttacggttagggttacgggtaccgtttaaggttttttaaccgttacccgttaggttaaccaacggtacccttaaaaccttttaacgtttttaacgtttaaccctttttaccgtttttacccgggttaccttttaacccgggttttccggggtaaccccggggtaacggggttaaaccccggtaaaggggttaacgggtaaaccgttaaaccgttaaacccgtaaaaccgggtttaaccgtttacggggtaccggttacccgtaaggtaacccctaaccgttacgtttacctttaccggtttaccctttaacccgttaacccccgg

SEQ ID NO: 64422 - DNA, 672 bp, Homo sapiens
  misc_feature: GYAE6OF01AS1QI.31.78.H01.1.454.CMB.1.raw
tcagcagtagacgtcacgaccggtgctcgatttagtgtgagtagtttgggtttggggggagctacaacaggcaggcaggggcagcaagatggtgttgcagacccaggtcttcatttctctgttgctctggatctctggtgcctacggggacatcgtgatgagcctagtttccagacctcccgtggctgtgtctcgtgggcgaggacgggccaccatcaactgcaagtccacgccagagttgttttattcggaccccaacaaataacaactacttagtcttggtaccagcaagaaagtacggacacgccctacctaaactcctgtactttacgtcgggtcttccgacccgggctacggttcccggggtttacctaacgtattctacgttcggacgagggtccgggttcgtacggggaccgtactttcaccgtactccaccatcgaacgctacgtcctgcgacggctaaggaagtagtaggtacggtcgttaagttttataccgttagacacgtaacctaatactttacttacctttcgttctacccgttacgttccggggtaacggacgggtaccgtaagggtacggaacgtaacgtaaccgtaaaccggtagtacggtcggtaccgtacggtaacctacccgtacttaccggtttacttccgttgtaccccg

SEQ ID NO: 64423 - DNA, 715 bp, Homo sapiens
  misc_feature: GYAE6OF01BIBSH.31.78.H01.1.454.CMB.1.raw
  modified_base (335)..(335): a, c, t, g, unknown or other
  misc_feature (335)..(335): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagactccctggctgtgtctcgtgggcgagacgggccaccatcaactgcaagtccagccaggtagttgttttacttcggccccaacaataacaactacttagcttggtaccagacaagaaagtacggacacgtaccctacctaaactcctagtaacttttaccgngggtcctttccgtaccccgggctacggttaccccggggttaccctaaaccgtatttacgaacgtttcggacgtacgggtccggggttcgtacgggggtacccgtacttttccaaccgttccctacctaacccgacttaccggaacgtccctaacggtccccttagggccgtaacgggtcctaaggaaacgtagttcgggtacggtacgttaagttttacttacgtcgttacgaacggtactaaacttaatttacgttaccttttcgtttaccgttcgttaaccggtttcggggaacgggtacggtaccgtaagggtaggaacgtacgtaacgaacgtagtcggtcggtctgacctactactcgttacgtccttatacccg

SEQ ID NO: 64424 - DNA, 608 bp, Homo sapiens
  misc_feature: GYAE6OF01ATRI5.31.78.H01.1.454.CMB.1.raw
  modified_base (319)..(319): a, c, t, g, unknown or other
  misc_feature (319)..(319): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagaggccaccatcaactgcaagtccagccagagttgttttattcggccccacaataacaactacttagcttggtaccagcaagaagtaggacagaccctacctaaactcctagtactttacgngggtccttccgtacccgggtctacggttcccggggttacctaacccgtattctagtttcggaccgaggccggggttccgtggggacccgtatttccaccttccgtaccaacctatcacgcacgtccctgcgaggctagaagatcggtcgacttaggttttattactgtacacgtacaactaacttactttacctttcgtttcgtaccttacgtttacgggaccggaggtaccgagggtgacgtatacgaaacgtactggtcggctgaccactattctcgttcttctacg

SEQ ID NO: 64425 - DNA, 1061 bp, Homo sapiens
  misc_feature: GYAE6OF01EU3IG.31.78.H01.1.454.CMB.1.raw
tcagcagtagacgtcacgaccggtgctcgatttagtgtgagtagtttgggtttggggagctacaacaggcaggcaggggcagcaagatggtgttgcagacccaggtcttcatttctctgttgctctggatctcgtggtcgccgtacgggactatcgtagtagtgacgtaccgtacgtttccgaacgtacccttcccgtcggtcttggttcgttccgtcggtcgggacggaaggaccgggcccaaccgtacgtaccgtaaacgtcgaaccgtaacgtcccgaacggaccgtaggtaggttttacgtttttaacgttaccccggaaccccctaaaactaaaactaaacctaaccttaacgttacgtacgttaccggtaaccgacgtaacgtaaaggtaaacggtaacgaacgaccgtaccctaacctaaaccgttccgttacgttaacgtttacgttaccgggttaccgttacccggtacccggtaccgttaccgggtttaccccgggttaacccgtaaaccgttacgttacgtacggttacggtacctaccgggggggggggggtccttaccgggtaccgggtaacccgttacgtttaccgtaacccgttacccgtacccgtaaaccgtacgtaacccggaccgtaccggtaccggtacccgtaccgggaccggtacgggtaacgtaacggtaaacgttaacggtttacgggtacggtttaaccgttttaaacggttttacgtttaacccgttaaccggttaaccgttaaacgttaaacccgttaaacgtttaacgttttaaaccgttttaccgttttacccggtttttacccgtttaacccggttttacccggggttttaaccgggggtaaaccgggtaaacccggggtttaacggggtaaaccgggttacgggtaaaaaccggttaaccgtaaaaaccgggtaaaaccggttaaccggttacggggttaaccgttacccggttaaccgttaacccgttaaacccgtttacgtttaacccggttttaccgttttaacccgttaaccccgtttaacccccgg

SEQ ID NO: 64426 - DNA, 703 bp, Homo sapiens
  misc_feature: GYAE6OF01BMFEL.31.78.H01.1.454.CMB.1.raw
  modified_base (516)..(516): a, c, t, g, unknown or other
  misc_feature (516)..(516): n is a, c, g, or t
  modified_base (560)..(560): a, c, t, g, unknown or other
  misc_feature (560)..(560): n is a, c, g, or t
  modified_base (667)..(667): a, c, t, g, unknown or other
  misc_feature (667)..(667): n is a, c, g, or t
  modified_base (682)..(682): a, c, t, g, unknown or other
  misc_feature (682)..(682): n is a, c, g, or t
tcagcagtagacgtcacgaccggtgctcgatttagtgtgagtagtttggggtttgggggagctacaacaggcaggcaggggcagcaagatggtgttgcagacccaggtcttcatttctctgttgctctggatctcgtggtcgccgtacggggacattcgttgatgagacctagtttaccagtacctccgtggtctgtcgtcgtcgtgggcgaggaccggaccaccataccaactgacaacgtccacgctagtagtttgttttacgtccgaccccaacgaaacttaacctaactacgttacgtcttacggtacgagacgaaagtaaggacgactaccgtaccctaacccgttaactccgtacgttacgtttacggtcggtaccctttccggtaccccgggtgtaccggttaccccgggttacctaacgtacgttacctggtacggcgtacgggtcggtcgtacgggtacctcgttacgacctcctaccactctaccgacgactcgaccgtgaccggngtacgtaaggaagtctagtacgtactttagtttctacgacgtanacctaagtaacttcttaatttcctttgtaccgtgttaccgggtacgggaacggtacgaaggtaggtaggtaaccaaccgttaaccgagtagttcggggcaccgttanaaccgttctacgttntaacgttcttaccgtaacccg

SEQ ID NO: 64427 - DNA, 813 bp, Homo sapiens
  misc_feature: GYAE6OF01C4D0K.31.78.H01.1.454.CMB.1.raw
tcagcagtagacgtcacgaccggtgctcgatttagtgtgagtagtttggggtttgggggagctacaacaggcaggcaggggcagcaaagatggtgttgcagacccaggtcttcatttctctgttgctctggatctcgtggtcgccgtacggggacagtcgtgatgacgtcctagttccacgtacctcccgtggtctgtcgtctcggtcgggacgaggacggtaccaaccatacaaactgacaacgtccgagacctaggtagtttgttttacgtacccggaccccaacaaaataaccaacttactagtcttacggaacctaagacgaaagaaagtacggacctacgtaccctaacctaactcctagttacctttacggtccggtacctttacccgggtaaccgggtaccgtaccgggtttaccccggggttttaaacccctaaaccgggttatttaacccgtaggttacggaccgtacggggttacccgggggtcggtaacggggtaacccttactttaccgacgtaccttaccaacctagtaccgacgtaccgacgtccctaggccgaacggtacgaagtaaggttcgtggttaggtaccgttaagttttactacgtagacctaaggtaacctaacgttacttttaacttcctttacccggttactttaccgttaacggggttaccggggtaacggggaaaccggtacggttaaacgggtacggaaaggttaaaccgtaaaacggtaaacggttaaggtcggacggtcccgtacggacctaccgttattaccggttcttacgtacccgttccg

SEQ ID NO: 64428 - DNA, 739 bp, Homo sapiens
  misc_feature: GYAE6OF01CZJ93.31.78.H01.1.454.CMB.1.raw
tcagcagtagacgtcacgaccggtgctcgatttagtgtgagtagtttgggttgggggagctacaacaggcaggcaggggcagcaagatggtgtgcagacccaggtcttcatttctctgttgctctggatctctggtgccgtacggggacatcgtgatgagcctagttccagacctcccgtggctgtgtctcgtgggacgaggacggcccacatacaaacgtgacaacgtccagccgagtagttgttttactcgaccccaacaaactaacaactactagacgttacggtaccagaacaagtaaagtacggacacgtaccctaacctaaactcctagtacttacgcggtctacccggtaccggctaccggtacccgggttacctaaccgtagttacgtaggttcggacgtacgggtcgggtacgtacgggtaacctatttcgacctttaccaccgtaacctactacgacgaccgacgtccgtacggacgacggtctaacggtaagtaagtggtacgtaccgttaagtttaactacgtacgtaaccgagtaacctaaacttaacgtttacctttaaccgtttcgtttaacccgggtaccttaaccgggtttacggggaaccgggtaacggggtaaccggtaaaggggtacggaaacgtaacgtaaaccgggaaacgtaacgttgggtcggtaccgtaccggaacctaccgttacgtacgttccttccgttacccttaacccg

SEQ ID NO: 64429 - DNA, 595 bp, Homo sapiens
  misc_feature: GYAE6OF01AEOSF.31.78.H01.1.454.CMB.1.raw
  modified_base (138)..(138): a, c, t, g, unknown or other
  misc_feature (138)..(138): n is a, c, g, or t
  modified_base (193)..(193): a, c, t, g, unknown or other
  misc_feature (193)..(193): n is a, c, g, or t
  modified_base (292)..(292): a, c, t, g, unknown or other
  misc_feature (292)..(292): n is a, c, g, or t
  modified_base (310)..(310): a, c, t, g, unknown or other
  misc_feature (310)..(310): n is a, c, g, or t
  modified_base (379)..(379): a, c, t, g, unknown or other
  misc_feature (379)..(379): n is a, c, g, or t
  modified_base (417)..(417): a, c, t, g, unknown or other
  misc_feature (417)..(417): n is a, c, g, or t
  modified_base (448)..(448): a, c, t, g, unknown or other
  misc_feature (448)..(448): n is a, c, g, or t
  modified_base (471)..(471): a, c, t, g, unknown or other
  misc_feature (471)..(471): n is a, c, g, or t
  modified_base (569)..(569): a, c, t, g, unknown or other
  misc_feature (569)..(569): n is a, c, g, or t
tcagcagtagacgtcacgaccggtgctcgatttagtgtgagtagtttgggtttgggggtaggctacaacaggcaggcaggggcagcaagatggtgttgcagacccaggtcttctatttctcttgttgctctggatctntggtcgccgtacggggacatcggtgatgagcctagtttccagtctcctggctgtntctgtggacgagacggccacgatcaactgacacgtacacgccagtagttgtttttcttacggccccaactaactaacaacttactagtcttacgtaacngacaagaagtagaccacncctactaactctagtctactcggcttaccggaccggcttaccgtccggtacctactatgtacgtgacgnggtcggtcggtcggaacctcttacgtactccaccgtanctacgcacgcgctacgcgaatcgagtactgnggtctaggtactttcgtacttgntacgcttaatacgttttactcctttaacgttcgttacgttaccgtgggtaccggtaggaacgtggtagagtacgtaacgtacgaaggttgacgtcganccgtaactcttgtccttgccttaccg

SEQ ID NO: 64430 - DNA, 868 bp, Homo sapiens
  misc_feature: GYAE6OF01CME1W.31.78.H01.1.454.CMB.1.raw
tcagcagtagacgtcacgaccggtgctcgatttagtgtgagtagtttgggtttgggggagctacaacaggcaggcagggggcaggcaagatgggtgttgcagacccaggtcttcatttctctgttgctcgtggatctctggtgccgtacggggacatcggtgactggagtcctagtttccagactcccgtggcttggtcgtcctgtgggacgaggacgggccctactagtaccaacttgaccgtaaacgtccgaggaccgaaggtagtttacgtttttaacgttccggaccccctaaacgtaaaacttaaaccgtaaaccttaacgttaagtccgttacggtaaccagacaaaggtaaacggtacgacacggtaccctaacctaaacgtccgtagtaacgtttaccgtggggtacctttccggtaacccgggcgttacggttaccccggggtttaccctaaaccggttactttaccgtacggttttacgggccgtagggggtcccggggttacgggttaccggggtaaccgttaactttttccgaaccctttcgaacccgtaaccgtacttaccggaacgtccgaacggtccctacggtacgcgggtaccgtaggtaaacgttacggttgggtaccggttacgtttaaacggttttaacgtttacgtacgttacgtataccgtaaacttacgtttaactttaccgtttacccgtttacggttacccgttaaccgggtttacgggaacccggggtaaggtaaccggtaaaggggtcggtaaacggtataaacccggtaaaacggtacggttacggtacgggtaccgtaccgtaactaccgtacttacgttccggttcttccgttacccg

SEQ ID NO: 64431 - DNA, 748 bp, Homo sapiens
  misc_feature: GYAE6OF01BG6ZA.31.78.H01.1.454.CMB.1.raw
  modified_base (345)..(345): a, c, t, g, unknown or other
  misc_feature (345)..(345): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgaggacgggccaccatcaactgacaagtccagccagagttgttttattcggccccaacaataacaacttactagtcttggtaccagacagaaagtggacagccctcctaaactcctgtactttacgtcgggcctttccgtacccggggntaacgttcccggggttacctaaccgtattaccagtttcggactagggtccggggttacgtcggggaacccgttatttccaacctttccgtacctacccgtaatccaacgggccaaccggtccgttacggaccggtacggtaccttagggaaacgttagttacgggtacggtacgttttaacggtttttaacgtttaccgttacggtactacggtaaccctaaacgttacttttaacctttaacccgttttccgttttacggttaccgtttaaccggttttccggggacgggtaacgggtacccgtaaggggtacggtaacgaacttaaccggaaaacggttaacgttaggttccgggcgtaccgtaccgtaccctacgttacttccggttccttcgtaacccg

SEQ ID NO: 64432 - DNA, 759 bp, Homo sapiens
  misc_feature: GYAE6OF01BV70R.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgctacggggacatcgtgatgagcagtttccagctccgtggctggtgtctcgtgggcgaggacgggaccaccatacaactgacaacgtccacgccaagtgtttacgttttagttccggaccccaactaaataacctaactacgttacgtcgttcgaacctagacgaagaaagtacggacacgccctaactaactctagtacttacgtggtccttcgtacccgggtctacggtcccgggttacctaaccgtacttcgagttcggacgtacgggtcgggttcgtacgggtaccgtacgtttcaccgttctaccaacgtactccgaagcgtacgtcctacggaccggaggtaccgttaaggaacgttggttacgtacgggttagttaaacgttttctttacgtacgtacctaacgacttaaaccgtaacttttacttttaaacccgttttcctttaccggttaaccgtttaaacgggttccggtaccggggtaacgggtaacccggtaaggttaaccggtaacgttaacgtaaaacccggaaaccgttaacgggtacggtccgggttacgacccggtaacctacggttaccttacgttaccggtttcccgtacgtttacccccgg

SEQ ID NO: 64433 - DNA, 723 bp, Homo sapiens
  misc_feature: GYAE6OF01AECF1.31.78.H01.1.454.CMB.1.raw
  modified_base (390)..(390): a, c, t, g, unknown or other
  misc_feature (390)..(390): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagacctccctggctgtgtctcgtgggcgaggacgggccaccatcaactgacaacgtccagccagtagtttcgttttatccggaccccaactaaactaacctaactacttacgtcgttacggtaccagacaaggaaagtacggactacgtcctacctaaactcctagtacttacgtcggtcttaccgtaccggctacgtacccgggttacctaaccgtnttactagtcggcgacggtcggtacgtacgggtaccgtactttccgacttcctacgtaaccctagtaccgtacgaccgtaccgaccgtcgacggtaacggtcgttacggaaggtaacgttcgggttacggtaaccgtttagtttaacgtttaccgacgttacgtaaccggtacctaaaccgtacgttttaacttacccgtttaccgttacgttaccgttaccgtttaccggggaacggtacggtaaccgaagggttacggaaccgtacgtaaccgtaaaggtccgtaggtcgaccgtaggtacctaccgttatcgttacgttcgttcgtaaccg

SEQ ID NO: 64434 - DNA, 764 bp, Homo sapiens
  misc_feature: GYAE6OF01DPCQQ.31.78.H01.1.454.CMB.1.raw
  modified_base (131)..(131): a, c, t, g, unknown or other
  misc_feature (131)..(131): n is a, c, g, or t
  modified_base (411)..(411): a, c, t, g, unknown or other
  misc_feature (411)..(411): n is a, c, g, or t
tcagcagtagacgtccacgaccggtgctcgatttagtgtgagtagtttgggtttgggggagctacaacaggcaggcaggggcagcaagatggtgttgcagacccaggtcttcatttctctgttgctctggntctcgtggtgccgtacgggacatcgtgagtgagcctagtttccagtacctccctggctgtgtctcgtgggcgaggcggccaccatacgaactgacaaacggtccacgaccaagtagtttagtttttacgttccggacccccaactaaaactaaacctaacttaacgttacgtcgttacggtaaccaagtacaaagtaaacggtagacacgtaccctaacctaacctctagtacgttcgtacggtcttaccggaccggctacgtaccgggtactaaccgtnttcagttcgcgaggtcggtcgtacggggtacctacgtttccacgttcctaaccgtaccgtaagtcgaacgccgtaaccgtaccccgttgaaccggaaggtacccgtaaaggtaacggtaacgtttagggtccgttaacgtttaacgtttaagttaacccgttggtaacccaagttaaccctaaactttactttaacgtttctttacgtttaccggtacggtttaccgggtttcggaaccgggtaacgggtaacggtaaacgggttcggaaacgtaacccgtaacggtaaaacggttaccggttaggtccgtaagccgtactacccgttatttcggtacttcttcgttaccccg

SEQ ID NO: 64435 - DNA, 863 bp, Homo sapiens
  misc_feature: GYAE6OF01DCO55.31.78.H01.1.454.CMB.1.raw
  modified_base (223)..(223): a, c, t, g, unknown or other
  misc_feature (223)..(223): n is a, c, g, or t
tcagcagtagacgtcacgaccggtgctcgatttagtgtgagtagtttgggtttgggggagctacaacaggcaggcaggggcagcaagatggtgttgcagacccaggtcttctatttctcttgttgctctggatctctggtcgccgtacggggacagtcgtgatgacgcctagtttccacgacctcccgtggctgtcgtctcgtgggcggaggcggacccaccnctacaacgtcgacaaaccggtccacgaccgaaggttaggtttacgtttttaccggttacccggaccccctaaaccctaaaattaaaaccctaaccttaaccgtttaacggtccggtttacggtaacccgacgggaaccaaagggtaaaacggtacgaaccgtaccttacccttaaaccctaaacctcgttaacggttaacgtttaccggtcgggtacccgtttacccgggaccccgggtagtttacccgggttaccccgggttaccccgtaaccgttaacgttaccggtaagttccggaaccggtacggggtccgggttaccgggtacgggtacccttacgttcctacccgtacgtaccctaacgtaacgtccaacggtccgtaacgtcccgtagaaccgtaggtacgtaaggaacgtagtacgggtcgtaacgtttagttttaaccgtacgttcgggtaactaaccggtacttaaacttacgttttaacctttaaccgttttctttacccggttcttaccgggtttacggaacggtacggggtaaccgtaaggggttacgaaggtacctaaacgggtaaacctagggttcggcgtacgtaccaccgttactaccggtttactcgttcgttcctacccgg

SEQ ID NO: 64436 - DNA, 705 bp, Homo sapiens
  misc_feature: GYAE6OF01C1DJS.31.78.H01.1.454.CMB.1.raw
  modified_base (328)..(328): a, c, t, g, unknown or other
  misc_feature (328)..(328): n is a, c, g, or t
  modified_base (359)..(359): a, c, t, g, unknown or other
  misc_feature (359)..(359): n is a, c, g, or t
tcagcagtagacgtcacgaccggtgctcgatttagtgtgagtagtttgggtttgggggagctacaacaggcaggcaggggcagcaagatggtcgttgcagtacccaggtcttcatttctctgttgctctggatctcgtgggtcgccgtacggggacagtcggtgactgacgtcctagtttccaagtcctcccgtggcgtgtgtctcgtgggcgaggcggccaccagtacaactgactaacgtccagaccagtagtttcttttacgttcggaccccaactaataaacctaacttattacgcttaccggtacagtacagaaagtacgganaccggcctacctaaacctccatactttacgnggtccttcggacccggctaacggttcccgggttaccaaacgtcttcaacgttggcctagggtcgggttacctcggggacccttatttccgtctactaccaactatcgagaccgcgtccgtcgccggacgttacgagtaaggtcgtacggtcgggtactttaacgggtttacttaccgttgttaccgaacggtactaaacttacgtttactttaacgttttcctttacggttccttacgggtccggtaacgggacgggtacctaagggtcgaaaggtacctaaccgtaaaacgtcgtacggttacgcgtacggtacaccgttattccgttaacgtcctttctacccg

SEQ ID NO: 64437 - DNA, 552 bp, Homo sapiens
  misc_feature: GYAE6OF01E36CI.31.78.H01.1.454.CMB.1.raw
  modified_base (438)..(438): a, c, t, g, unknown or other
  misc_feature (438)..(438): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgtttattggccccacaataacaactacttagcttgtaccagcagaaagtaggacagcctcctaaactcctgatttactgggcttctacccgggcacgtcccggggttcctaaccgatttcgattggcagcgggtctgggaccgatttcactctcaccatcagcagctgcagctagaagatgtgctagtttactacgtgtcagacaanattataactctttacgtctaacctttcggacggtagggacctaagggtcggaagaactacgaaacgtaaacgtggtacggctggtaccaccgatacttcggttccttctaaccg

SEQ ID NO: 64438 - DNA, 645 bp, Homo sapiens
  misc_feature: GYAE6OF01BSEAU.31.78.H01.1.454.CMB.1.raw
  modified_base (369)..(369): a, c, t, g, unknown or other
  misc_feature (369)..(369): n is a, c, g, or t
  modified_base (400)..(400): a, c, t, g, unknown or other
  misc_feature (400)..(400): n is a, c, g, or t
  modified_base (462)..(462): a, c, t, g, unknown or other
  misc_feature (462)..(462): n is a, c, g, or t
  modified_base (483)..(483): a, c, t, g, unknown or other
  misc_feature (483)..(483): n is a, c, g, or t
  modified_base (606)..(606): a, c, t, g, unknown or other
  misc_feature (606)..(606): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacagtcgtgatgagcctagtttccagactccctggctgtgtctcgtgggcgaggcggccaccatacaactgacaacgtccagccaaggtagtttcgttttacttccggaccccaacaaactaacctaacttacttagtccgttacggtaaccagacaagaaagtaggacacgtccctacctaaactctagtatttacgcgggtccttccgtaccccgggntaccgggttacccgggttaccctaaaccgtnttcctagtcggaccgacggtcggggtctcgggtacctatttcacctctccacactcgacgcncgctcgcaggacctagaagtntcggtcgtacttattttactacgtagtacacgtaactaacttatttacttactttccgttacgtacttaccggttacggacgggacgtacggtaaggtggtaacgtaactacgtaaacggtanagggttcgactacggcctacgacttactcttcgtcctcc

SEQ ID NO: 64439 - DNA, 755 bp, Homo sapiens
  misc_feature: GYAE6OF01DGJQG.31.78.H01.1.454.CMB.1.raw
  modified_base (335)..(335): a, c, t, g, unknown or other
  misc_feature (335)..(335): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagacctccctggctgtgtctcgtgggcgagacgggccaccatcaactgacaacgtccagccagtagttgttttattcggaccccaaccaaataacctaactacttagcttaggtaccagacaagaaagtaggacacgacctacctaaactcctagtatttacgngggtcctttaccgtaccccgggctacggttcccggggttaccctaaaccgtcttactagtttcggacacgggtccggggttacgtcggggacccgttactttccgaaccgttccttacccgaaccctattccgacgtaccgaacgtcccgtggaccctaaggggccttaaggaaacgtagttcgggtacggtacctttaaggtttttaacttacgttagtacctaacggtacctaaacttaagttttaactttacccgttttaccttttaccgttacccgttacggttttcccggggaacgggtaacgggtacccgtaaaggggttcgaaacggtaactaaccggtaaaaccggtacgtacgggttcggaccgttcgacccgtaaccgtacgttcccgttacgttcctttccgtaccccg

SEQ ID NO: 64440 - DNA, 792 bp, Homo sapiens
  misc_feature: GYAE6OF01C1DIE.31.78.H01.1.454.CMB.1.raw
  modified_base (196)..(196): a, c, t, g, unknown or other
  misc_feature (196)..(196): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctgatctctggtgccgtacggggacatcgtgatgacgcctagttccagactcctggctgtgtctcgtgggngagcggcccaccatacaactgcaacgtccagccaggtagtttgttttacgtcggacccctaacgaaactaaactaaccttacttacggtccttacggtaccaagcgaaggaaacgtacggactacgcctacctaaactcctagtacgtttacgtcggtcctaccggtcccgggtactacggtccccggggttacctaaccgtacgttcgtacgttcggcgtacgggtccggggtcgtacggggtacccgttcttaccgtacctccgttaccaaccgtacgtacccgaacgtcccgtaacgtcccggtacggtaccgagggtaccgtaacgggtaaagtacggttacggtacgggttaccgtttaacggttttaacttaccgttacgtaccgtaacgtaaccttaaacttactttaacgtttacctttttcccgttaccgtttaccgtaccgggtttacggggacccgggtaaacgggttaacccggtaaagggtaccgtaccgtaaagtaacccggtaaaacggtaccgttagggttccggtaccgttacggaacctacccggttattaccggttaccgttccgttccttacccgg

SEQ ID NO: 64441 - DNA, 928 bp, Homo sapiens
  misc_feature: GYAE6OF01BO731.31.78.H01.1.454.CMB.1.raw
  modified_base (630)..(630): a, c, t, g, unknown or other
  misc_feature (630)..(630): n is a, c, g, or t
tcagcagtagacgtcacgaccggtgctcgatttagtgtgagtagtttgggtttgggggagctacaacaggcagggaaggggcagcaagatggtgttgcagacccaggtcttacatttctctgttgctctggactcgtcgtggtcgccgtacggggacagtcgtgatggacgtccgtacgtttccacgtacccttcccgtggtcttggttcgttcgtcgtcggggcggagggaccggacccaccgataccgaaacgttcggaccgtaacgtcccgaacggtaccgtaaggttaacggttttcggtttttaacgtcccggaacccctaaacctaaaacttaaaccttaaaccggtttaaccttacggtccgttttaacggtaacccaaggtaaaccgaaaggtaaaacggtacggaacctaccgtaccccgttaaaccttaaccgtccgttaagtttaaccgtttaccggtcgggttaccctttacccggacccgggtacgtacccgggtttaccccggggttaacctaacccggtacttacgtacggttcgggcgtacggggtccggttcggtacgggtacctttacttaccgtacctaccgtaccgaacgtacgttaccgaacggtaccnccgtacgtcggacgtaggtaccgaggtacgtacggttaggtacggttacgttttaagttttaccgttaacgtttccgtaaaccgtacgttaaacgttaaccgtttaaactttttaaccgtttaccgtttttacccgtttccgttaaccggttttaccggggttaccggggtaacggggttaaccgggtaacggttaagggtaccggtaacgtaaccggttaaacgtaacccggtagttacggacggtccgaccgtacttaaccgtacttacggtcttaccctggttaccccttaccgg

SEQ ID NO: 64442 - DNA, 743 bp, Homo sapiens
  misc_feature: GYAE6OF01DKKY5.31.78.H01.1.454.CMB.1.raw
  modified_base (134)..(134): a, c, t, g, unknown or other
  misc_feature (134)..(134): n is a, c, g, or t
  modified_base (456)..(456): a, c, t, g, unknown or other
  misc_feature (456)..(456): n is a, c, g, or t
  modified_base (705)..(705): a, c, t, g, unknown or other
  misc_feature (705)..(705): n is a, c, g, or t
tcagcagtagacgtcacgaccggtgctcgatttagtgtgagtagtttgggtttgggggagctacaacaggcaggcgaggggcagcaagatggtgttgcacgacccaggtcttctatttctcgtgttgctcgtgntctcgtggtcgaccggtacgggacagtcgtgacgtgacgtaccttacgtttccgacgtaccctcccggtgtcgttggtcgtccgtaggtcgggacgacggaccggaccacctaatacaaccgtgactaacgccacgactagttagtttagtttacgtaccgaccctaactaaactaacctaacttaacgtcgtacttacggaacacgacgaaggtaacgtacgacgtacctccctaaacctaaacgtccgtaagtttccgttaaggtcccggtaccttaccggtaccggtacgttacccggttaccgggttaccaaccgttntacgttagtacggcgtaacgggtccggtagtccgggtaacttcttaccacgtctacctatctacgtaggctaccgtcgtcgacggtacgtcgaagtacggtagtagtaccggtagtttaaacgtttctaacgtcgtaaaccgataacgttaactaacgtttctttaccgtttacgttaccggttagtccgggttacggacggtacgggtaaactaacggtggaaactaacgtaacgtacgtagttacgnggccctagacctgttactacctcgtttcctgttacccg

SEQ ID NO: 64443 - DNA, 680 bp, Homo sapiens
  misc_feature: GYAE6OF01CT99C.31.78.H01.1.454.CMB.1.raw
  modified_base (343)..(343): a, c, t, g, unknown or other
  misc_feature (343)..(343): n is a, c, g, or t
tcagcagtagacgtcacgaccggtgctcgatttagtgtgagtagtttgggtttgggggagctacaacagggcaggcaggggcagcaagatggtgttgcagacccaggtcttcatttctctgttgctctggatctctggtgcctacgggggacatcgtgatgagcctagtttccagacctccgtggctgtgtctcgtgggcgaggcggccaccatcaactgacaacgcccagccagtagttgttttactccggacccctaacaataaccaacttactacgcttacggaccagacgaaggtaaaggtacggactaccgtccctaacctaactctagtacttacgnggtccttaccgacccgggctacggttcccgggttacctaaccgtattcagttcggacgtacgggtcgggtcgtacgggtaccttagtacctacctcttaccaacctctacgacgcaccggtccgtagccgtaggctaacgaagtgtgggtcgtacgttagttttatcgtcgtacgacgtacctaattagtttcttacgtttccgttaccgtacgttccggttaccgggacgggtacggtaccggtaagggtcggaaagtacctaaaccggtaaacgtacgttcgggtacgacgtacgacctaacccgttattccggtcgttccttaccgttaccccg

SEQ ID NO: 64444 - DNA, 747 bp, Homo sapiens
  misc_feature: GYAE6OF01B86I7.31.78.H01.1.454.CMB.1.raw
  modified_base (706)..(706): a, c, t, g, unknown or other
  misc_feature (706)..(706): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaacgtccagccagtagttgtttttacttcggaccccaactaaataaaccaacttaacttacgtcttacggtaaccagtaccaagtaaaacggtacggtaacacgtacccgtaaccccttaaaactcccgttaggttaacttttaccggtcgggtcctttaccggtaccccgggacgtaacggttccccgggggtttaccctaaaccgtactttacgtacgttcggacgtacggtccggggtaccgttaggggtaacccgttacgtttaccaaccgttcctaccgtaacccaatacgtacgcgacgtccgtcggacgacggcttaggaagtagtacgggtgacgtttagtttacttatcgtacagtactaactatttaactacgtttactttcggtaccttacgggtttacggacgggtaacggtaaccggtaacgggttggtaacgtaacgtaaccggtaaacgtaagttccggtaggttacccggtanaccccggttactaacctttacgtacttccgttacgttaccc

SEQ ID NO: 64445 - DNA, 717 bp, Homo sapiens
  misc_feature: GYAE6OF01BDA7Q.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagacctcccgtggctgtgtctcgtgggcgaggacggccaaccatccaacgtgacaacgtccagccaggtgttgttttagttccggaccccaactaataacaacttacttagtcgttacggtaccagacaagtaaagtacggacacgtaccctacctaaacctccgtagtacgtttacgtcgggtaccttaccggacccgggtctacgttccccggggttaccctaaccgtacttcgtagttcggacgtacgggtccggggttccgtacggggtacccgtactttccgaccttcctacctaacctactacgacgccgacgtcccgtagccgtacggctaggaagtagttacggtggtactttacgttttaacttacgttagtcctaacgtactaaacgtatttaaccttactttccgttacgttaccgttaccgtttcgggacggtacggtaacggtaagggtacggtaacgtaacgtaaccgtaaacggtagttacggtcggacgtacgacctacctacttaccgttcttaccgttccgtacccg

SEQ ID NO: 64446 - DNA, 755 bp, Homo sapiens
  misc_feature: GYAE6OF01DB8Y3.31.78.H01.1.454.CMB.1.raw
  modified_base (419)..(419): a, c, t, g, unknown or other
  misc_feature (419)..(419): n is a, c, g, or t
tcagcagtagacgtcacgaccggtgctcgatttagtgtgagtagtttgggttgggggagctacaacaggcaggcaggggcaggcaagatggtgttgcagacccaggtcttcatttctctgttgctctggatctcgtgggtgaccgtacggggactagtcgtgatgacgcctagttccagacctcctggctgtgtctcgtgggcgaggacgggcccaccgtatacgaactcgacgtaacgtccacgccaggtagttcgttttacgttccggacccctaactaaataacctaactacttaggcttacggtaaccagacaagtaaaggtacgacacgtacctaccgtaaacctccgtagtactttacggtcggtaccttacggtacccgggactacgggttccccggggttacctaaccgtnttacgtagttcggacgtacgggtccgggtgttacgggaccgttacttaccaccgttcaccgtacagtccctagaccacgtccgtgacgaggtacgtacggaacgtacttcggtacggtacttagtttacgttaccgtgtaccgtaacgtacccgtaaattactttaacgttactttacccggtttacttaccgttaccgggttaccgggtaacgggttaccggggaaccggttaacggggtacgggtaaacgtaaaccgtaacggtaaaaccggtcttaggggtacgtacccgtacgacctacccgttacttccgtacgttcttacgttaaccccg

SEQ ID NO: 64447 - DNA, 761 bp, Homo sapiens
  misc_feature: GYAE6OF01BJ2NS.31.78.H01.1.454.CMB.1.raw
tcagcagtagacgtcacgaccggtgctcgatttagtgtgagtagtttgggtttggggagctacaacaggcaggcaggggcagcaagatggtgttgcagacccaggtcttctatttctctgttgctctggatctcgtggtgccgtacgggacagtcgtagatgacgcctagtttccagtacctccgtggcttgtcgtcgtcgtgggcgaggacggccaccatcaactgacaagtccagacctagtagtttgttttacgttccggacccctaaactaaacgtaaactaacttacttagtcttaggtaccagacaaggaaagtacgacgacgtcctaccttaaacgtcgtagtacgtttacgcggtccttaccggtacccggcgttaccggttacccgggtacccttaaacgtacgttactacggttcggaccgagggtccggttacggtacgggtaccgttaatttcccgacgttaccctacgaccgtaacgtacgtacggtaccgacgttccgtaccggaccgtaaggtacgtaacggaaagtacggtcgtacggtacctttaagtttaccggttacgttcgaacgtaacgtactaaaccgttgtttaacctttacgtttacccgttgttacccgtttaggttaccgggacggtaaacggtaaccggtaagggtacgtacgtaaaccgttaaccgtaagttaggttcccggtgtacccgtacgtaccgtaacttcggttcttacgttccgttaacgtacccg

SEQ ID NO: 64448 - DNA, 935 bp, Homo sapiens
  misc_feature: GYAE6OF01AGV4B.31.78.H01.1.454.CMB.1.raw
  modified_base (124)..(124): a, c, t, g, unknown or other
  misc_feature (124)..(124): n is a, c, g, or t
  modified_base (134)..(134): a, c, t, g, unknown or other
  misc_feature (134)..(134): n is a, c, g, or t
  modified_base (142)..(142): a, c, t, g, unknown or other
  misc_feature (142)..(142): n is a, c, g, or t
  modified_base (882)..(882): a, c, t, g, unknown or other
  misc_feature (882)..(882): n is a, c, g, or t
tcagcagtagacgtcacgaccggtgctcgatttagtgtgagtagtttgggtttgggggtagctacaacaggcaggcaggggcagcaagatggtgttgcagacccaggtcttcatttctctgttnctctggactntcgtggtnccgtacggggactatcgtgagtgacgcctagtttccgagacctccgtggctgtcgttctcgtgggcgacggacggacccacacgtcaactcgacgtaacgtccgacgccgtaagtaggtttacgtttttacgttcccggcccccaaactaaacgttaaaccaaaccgtttctttaacggctttaccgaaccgaagacgtaaacggtaaaggtaaccggtaacgaccggtacccctttaccggttaaaaacccttccgttaacggttaaccgtttttaacccgggtcgggtaccccttttacccggtaaaccccgggggtactttaccggggttacccccggggtttttaacccaaaccggtttacgttaccggttaaccgtccggggtaccgtaaaccgggggtacccggggtttccggtaaccgggggttaaccccgtttacttttacccggtaaccccgtttcctaacccgggtttaaaccctaaccgggttaccttaaacccgggcccggtaacccgtccgttaccggggttaccgtaaccgggttccgttaaacggtaaccggtagttaccgggttaggtacgttaacggtttttacgtaacgtttaccgtacggtaactaacgtaaacctttattaaccgtttacctttaccgtttaccggttaccgttaccggttaccggggtacggtacgggaaccgtaagggtcgtaacgtacgttaccgtaacggtaccgnggttcgaccggttacacccggtactaaccgttcactttcccgtacgttacccg

SEQ ID NO: 64449 - DNA, 759 bp, Homo sapiens
  misc_feature: GYAE6OF01BG9X0.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgacgcctagtttccagtaccttcccgtggctgttcgtctcgtgggcgaggacgggccaccatacaactgcaagtccagccagtagtttgttttagttccggaccccaactaaataacctaactacttacgtcgtttacggaccagacgaagaaacgtacggaccacgtccctacctaaactcctagtactttacgtggtccttccgtacccggtctacggttcccgggttacctaaccgtattcagttcggacgtggtccgggtcgtacggggtacctactttcaccttaccgtacctaacctacttcaacgtccgaccgtcctgacgacggttcgaagaacggtagttcggtacggttacgtttaagttttacgttacgtacgttacgaacggtaaccttaaacttaagttttcccgtttacccttttaccgtttttacccggttacgtttacccggtttcggggaaccggggttaccggtaacgtaggggtacgtaaacgggtaaaccgttaacccgtaaaacggttacggttacggtccggtccttaaggtacccctacgtttaccgttacctttaccgtttccttccgttaccccg

SEQ ID NO: 64450 - DNA, 692 bp, Homo sapiens
  misc_feature: GYAE6OF01BBCV0.31.78.H01.1.454.CMB.1.raw
  modified_base (375)..(375): a, c, t, g, unknown or other
  misc_feature (375)..(375): n is a, c, g, or t
  modified_base (399)..(399): a, c, t, g, unknown or other
  misc_feature (399)..(399): n is a, c, g, or t
tcagcagtagacgtcacgaccggtgctcgatttagtgtgagtagtttggggtttgggggagctacaacaggcaggcaggggcagcaagatggtgttgcagacccaggtcttcatttctcttgttgctctggatctctggtcgaccgtacggggacatcgtgatgagcctagtttccagactcccgtggctgtgtctcgtgggcgaggacgggacccacatcaactgaccaaagtccaagccgagtagtttgttttattccggaccccaaacgtaaataacctaaacttacgttacgtcgttacggaaccagacaaggaaagtacggacacgtcctacctaaactcctagtactttacgtggtctccgtacccggntacgttccgggttacctaaccgtnttcagttcggctacggtcgggtctacgggtaccgtattcactctacgaacctatccagaccacgtcctacgcgaggtctaaggaacgtgtaggtcgtacttaagtttacttacgtgtacagtactaaacttactttaacctttaccgttttccgtttacgtacctttacgggtttaccgggagggtaaacgggtaaccgtaagggttacgaacgtaaagtaaccgtaaaacggtacgtgggttaccgacttacgaacccgtacctacttacgttacttccgttgttaaccccg

SEQ ID NO: 64451 - DNA, 778 bp, Homo sapiens
  misc_feature: GYAE6OF01CZWFY.31.78.H01.1.454.CMB.1.raw
  modified_base (608)..(608): a, c, t, g, unknown or other
  misc_feature (608)..(608): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctcttgttgctctggatctcgtggtagccgtacggggacatcgtgatgagcctagtttccagtcctccgtggctgtgtctcgtcgggcgaggacgggcccaccgatacaactgacaacgtccagaccagtagttagttttacgtccggccctaaccaattaaacctaaccgttacgttacggtccgtttacggtaacccagaccgtaaaggtaaacggtaggaccgtacgtacccttaacctaaaaccttctaggttaactttacggtcggggtacctttacccggtaccccggggacttaccgggttaccccggggtttaccctaaaccgggttattacgtaacgtttcgggaccgtacggggtcccggggtttaccgacgggtaacccgtttcttacctaaccgttccgttaccaacctaactcgacgacgtacgtccctacggacgtaggtcgtagagtacgtggtacgtactagtttactacgtgtacncgtactacttagttacttacctttacgtttcccgtacgttacccggttaggggaccgggtaacgggtaaccgtaaaggggttacggaaccgtaagtaaccggttaaacggtaacgttggtaccgcgttacggaactacccttagttccgttaccgtttctccgttacccg

SEQ ID NO: 64452 - DNA, 697 bp, Homo sapiens
  misc_feature: GYAE6OF01A5SN8.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagaggccaccatcaactgcaagtccagccagtagtgttttattcggccccaccaataacaactacttagcttggtaccagcagaaagtaggacacgccctacctaaactcctgtatttacgtgggtcttaccgtaccccgggctacgtcccggggtttaccctaaccgtattccattcggcagtcggggtctcggggacgtattcgactcctcaaccatcagccagccctggcgaggctaggaagacgtgtaggacttaggttttacttaccgttcgacaacggtactaaactattttaactaacccgttttcgttttcccgtactttacccggttttaccggggaaccggggtacggggtaacccgtaaaggggttacgggtaaacggtaacgttaacccgaaaaacggttaaccgttaacggggttccggggtaccgttacgggacccttaaacccgttacttacccggtttacgtttccccgtttcgttaaaccccgg

SEQ ID NO: 64453 - DNA, 655 bp, Homo sapiens
  misc_feature: GYAE6OF01AYGIQ.31.78.H01.1.454.CMB.1.raw
  modified_base (299)..(299): a, c, t, g, unknown or other
  misc_feature (299)..(299): n is a, c, g, or t
  modified_base (377)..(377): a, c, t, g, unknown or other
  misc_feature (377)..(377): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagtacctcccgtggctgtgtctcgtgggcgagacgggccaccatcaactgacaagtccacgcagtagttgttttattcgccccacaataacaactacttagcttaggtaccagacagaaagtgacanaccctactaactccgtatacgtttcgcggtccttacgtacccggctacggttcccgggttacctaaccgtattaccgngttcggcgacgggtcggtccgttacggggaccctacgtttaccgaccttcgaccctaccctagtccgacggtccacgtccgtagtcgacggtccgtaagaacgtgtacggtacggtcttaaggttttactacgtgtacgatactaattattacttactttcttcgttacgtaccgtttcgggacggtaacgtacgtaagggtcgtaacgtacgtaaccgtaaacgtactgggtcgtccgtcgtaccgtacctacgttcgtacgttcctttcgtacccg

SEQ ID NO: 64454 - DNA, 668 bp, Homo sapiens
  misc_feature: GYAE6OF01EKFQB.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctgggtgccgtacggggacatcgtgatgacgcctagtttccagacctcccgtggctgtcgtctcgtgggcgaggacggcccaacatcaactgacaatccagccagtagttgttttacgttccgaccccaataaactaacaaccttactagtcgttacggtaccaggacaagaaagtacggacacgtaccctactaaacctctagtacttcgtcggtcctaccgtaccggctacggttcccgggtacctaacgtattcagttcggacgtacggcgggttaccgacggtacgtactttcaaccttcgaccaactatcgacgtcacgtcctagacgaggtactaagaagtactgggtacgtagttaacgttttaactcggtactacaacgtaactaagttaactttactttaaccgtttctttaccgtacgttaccggttacgggacggtaacgggaacgaagggtaacgagtaactaacggaaacgttggtagtcggactacgaacctactacttccgttcttaccgtctaacccgg

SEQ ID NO: 64455 - DNA, 776 bp, Homo sapiens
  misc_feature: GYAE6OF01AJTDF.31.78.H01.1.454.CMB.1.raw
tcagcagtagacgtcacgaccggtgctcgatttagtgtgagtagtttgggtttgggggagctacaacaggcaggcgaggggcagcaagatggtgttgcagacccaggtcttcatttctctgttgctctggatctctggtgccgtacggggacatcgtgatggacgcctagtttccagactccctggctgtcgtctcgtgggcgagacggccaccatacaactgctaacgtccaagcctaggtagttgttttacgttccgaccccaactaaactaaacctaactaacgttacgtccttacggtaaccgagacaaaggtaaaacgtacggaacctaccgtaccctaacccgttaaaacctccgttacggtaacttttaaccggtcgggttaccctttacccgggtaaccccggggtactaacccgggtttaccccggggtttaacccctaaaccggttactttaccgtaacggtttcggaaccgtcggggtacccgggttacggtaacggggtacctacgtttccaaccttcgtaccaccgtactcgacgccgtacgtcctacgcgaacgtcgaaggtaaagcgttgggtacgtaactttaggtttaactcggttacgtaccgattaacctaattaacttttaccttacctttaccgtttacgggtactttaccggtttacggggaaccggtaacgggaccgtaaaggtggaacgtaactaacggaaaccgtgtagggtctcgacccgtactacgtactcgttccttagtctacccgg

SEQ ID NO: 64456 - DNA, 878 bp, Homo sapiens
  misc_feature: GYAE6OF01AGMWO.31.78.H01.1.454.CMB.1.raw
  modified_base (248)..(248): a, c, t, g, unknown or other
  misc_feature (248)..(248): n is a, c, g, or t
  modified_base (517)..(517): a, c, t, g, unknown or other
  misc_feature (517)..(517): n is a, c, g, or t
tcagcagtagacgtcacgaccggtgctcgatttagtgtgagtagtttgggtttggggagctacaacaggcaggcaggggcagcaagatggtgttgcacgacccaggtcttcatttctctgttgctctggatctcgtggtcgccgtacgggacagtcgtgatgagcctagtttccagtacctccgtggctgtcgtctcgtggacgaggacggcccaccatcaactgacaacgtcacgccaggtcgtttnttttactccggacccctaacaaactaaccaaccttaaggttcgtaccgttacggtaaccacggcgaaagtaaaacggtacggaccgtactaccccctaaccgttaaaccttcccttaggttaacttttaccgacgggtacccttttaccccgggacccggggtaccttaccgggtttaccccggggttaacccttaaaccggtactttacccgtaaaggtttcgggaccgtaacgggtcggggtttaccggtacgggtaaacccctttnttttccggaaccccttaacggtcccctaaaacggacgtttcccacggtacccgtacgtcccgtcggtacgacggttacgaccggtaaagtcggttacgtaccggtacgtttaacgttttcgttaaccgggttacgtacgaaccggttaactaaacccgttattttaaccgtaaccgtttttccggtttaaccgttacgtttaacccgggtttacgggtaaccgggtaccggttaacgggttaaaccgggcggttaaacctacggtaaaacggtaccgtaaggtttccggcggttcccgaaaccgttaccgtacccccgtttaagttccggtttaacccctgtttaaccgttaaccccccgg

SEQ ID NO: 64457 - DNA, 124 bp, Homo sapiens
  misc_feature: GYAE6OF01DQCKS.31.78.H01.1.454.CMB.1.raw
  modified_base (59)..(59): a, c, t, g, unknown or other
  misc_feature (59)..(59): n is a, c, g, or t
  modified_base (87)..(87): a, c, t, g, unknown or other
  misc_feature (87)..(87): n is a, c, g, or t
  modified_base (120)..(124): a, c, t, g, unknown or other
  misc_feature (120)..(124): n is a, c, g, or t
tcagcagtagacgtcacgaccggtgctcgatttagtgtgagtagtttgggttggggganctacaacaggcaggcaggggcagcaagntggtgttgcagacccaggtcttcatttctcttnnnnn

SEQ ID NO: 64458 - DNA, 772 bp, Homo sapiens
  misc_feature: GYAE6OF01BVF6A.31.78.H01.1.454.CMB.1.raw
  modified_base (748)..(748): a, c, t, g, unknown or other
  misc_feature (748)..(748): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctcgtggatctcgtggtcgccgtacgggacagtcgtgatgacgcctacgttccagtacctcccgtggtcgttgtcgtccgtcgtagggcgaggacggacccaccgatacaacgtcgacgaacgtccaggccgtagttagtttcgttttacgtcccggacccctaaactaaactaaactaaccttacgtaacgtcgttacgtaacccgagaaccgtaaggaaacgtacggaccacgtacccgtaacctaaacgtccttagtactttacgtcggtacctaccggtacccggtctaccggttcccggttaacctaaccggtacttcgtaacgtcggaccgtacgggtccgggttaccgtacgggtaccttacgtacctaccgttccgtacctaccgtaacttccgacgaccgtaccgtcgttacggacggtacggtacctaggtaaccgtagtcggttacgtacgtttagtttcgttacgtcgacagttaacctaattcgtttaaacttccgtttcgttaccgttaccgttacggttccgggaccgggtaacggtaacgtaggtacggtaagtaacgttaaccggaactacgggttacgcggttacccggaattacccgacgtttacncgttaccttaccgttcgtaacccg

SEQ ID NO: 64459 - DNA, 747 bp, Homo sapiens
  misc_feature: GYAE6OF01EH3OR.31.78.H01.1.454.CMB.1.raw
tcagcagtagacgtcacgaccggtgctcgatttagtgtgagtagtttggggtttgggggagctacaacaggcaggcaggggcagcaagatggtgttgcagacccaggtctctatttctctgttgctctggatctctggtgccgtacggggacatcgtgatgacgcctagttccagacctcctggctgtgtctcgtgggcgaggacggccaccatacaactgacaacgtccagccaaggtagttgttttacttcggacccctaacaataactaacttacttagtcttggaccagcaagaaagtaggacagaccctacctaaacctccgtagtaactttacgcgggtctttccgtacccgggtactaccggttcccggggttaccctaaacggtactttacgagtttcggacgtacgggtccggggttacgtacggggtaacccgttagttttaccaccgtttaccctcccgtaacccgtacgttaccgaacgtaccgtaaccggtcccgtacgaccggtacgggtacctagggaaagtacgttcgggtcggtacttaaggttttattaccgtgtaccagtacctaacgtactttacttacctttcgtttacgttacctttaacgggtttcgggaccgggttaacgggtaaccgtaaggggtaggtaacgtacttaaacccggtaaacggtaacgttcggtacggcgtaacgaccctaaccgtacttccgttacgttccttccgttacg

SEQ ID NO: 64460 - DNA, 649 bp, Homo sapiens
  misc_feature: GYAE6OF01EY3KC.31.78.H01.1.454.CMB.1.raw
  modified_base (307)..(307): a, c, t, g, unknown or other
  misc_feature (307)..(307): n is a, c, g, or t
  modified_base (310)..(310): a, c, t, g, unknown or other
  misc_feature (310)..(310): n is a, c, g, or t
  modified_base (320)..(320): a, c, t, g, unknown or other
  misc_feature (320)..(320): n is a, c, g, or t
  modified_base (499)..(499): a, c, t, g, unknown or other
  misc_feature (499)..(499): n is a, c, g, or t
  modified_base (588)..(588): a, c, t, g, unknown or other
  misc_feature (588)..(588): n is a, c, g, or t
tcagcagtagacgtcacgaccggtgctcgatttagtgtgagtagtttgggtttgggggagctacaacaggcaggcaggggcagcaagatggtgttgcagacccaggtctcatttctctgttgctctggatctcgtggtcgccgtacgggacatcgtgatggacgcctagtttaccacgacctcccgtggctgtgtctcgtggcgaggacgggaccacactacactgactacgtccacgaccagtgtttagttttacgctacgaccaccaactactactacttagtactcgacagacagaacgagtanccntacctaaccnacctacgtacttacgtacgtcggtaccgttaccggtacccggccgtacggttaccgggttaccgtaaccgtacgttacgtagtcggtcgtacggtcggtcggtacgggtaccgtacttacctaccgtctacctacctacgtcacgccgacgtaccgtacgacgtaacggtacgtacggnccgtacgtcggtacggttacgttacgtttacgttacgtacgtacgtaacgactaactacttacttaccgttacttacgttaccgtacgnttcggtacggtacgggtaccggaacggtacgtacgtaacgtacgtaacgacgtcgtggtcg

SEQ ID NO: 64461 - DNA, 834 bp, Homo sapiens
  misc_feature: GYAE6OF01DU0KW.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtcgccgtacggggacagtcgtgatgacgcctagtttaccagacctcctggtctgtgtctcgtgggcgaggacggccaccactacaacgtgacaacgtaccacgaccgtagtagtttacgttttacgtttcccggacccctaaacctaaacttaaacctaaacttaacgttacgtcgtttacggtaaccaagactaaaggtaaagtacggaaccgaccgtaccctaacctaaaccttccgtacgtactttacggtcggtaccgtttaccggacccggtacgtaccggtttacccgggttacccttaaccggtacttacgtacggttacggacgtacgggtccgggtacggtacgggtacccgttactttaccgtacccttcctacccaacctacgtaccgacgtacgacgtccctacggccggtaactcggtaacggtaacgtaggttgttacggtaaccgttagtttttaacgtaccgttacgttaacgacctaacgttaacgttacttttaacgtttaccgttttacccgttttccggtacccgtttaacggtttcgggggaaccggtaacggggtaaacgttacggggtagtaaaccgttaaactaaccggttaaaacgggtcgttaaggccggttacgacccgggaaccttacgtaaccttcccgggtttactttcccttacgtttacccccgg

SEQ ID NO: 64462 - DNA, 895 bp, Homo sapiens
  misc_feature: GYAE6OF01EGOCD.31.78.H01.1.454.CMB.1.raw
tcagcagtagacgtcacgaccggtgctcgatttagtgtgagtagtttgggtttgggggagctacaacaggcaggcaggggcagcaagatggtgttgcacgacccaggtcttcatttctctgttgctcgtggatctcgtggtcgccgtacgggacagtcgtgatggacgtccgtagtttcccagtaccttcccgtggtccttggtcgtaccgtcggtcggggacgacggacgggcccaactataccaactgaccgtaaacgtccaagtccaaggtagtttcgttttacgttccggaaccccctaaactaaaagtaacctaaaccgttaacgttacggtacgtttacggaacccaacggacgaaaggtaaacgttacggaccaacggttacccctaaccgtaaaccttccgttaagttaacgtttaccggtggtacctttaccggaccggttaacaccgggtttaccgggttaaccctaacgtactttacgaggttacggaccgtaagggtccggttaacggtcgggtaaaccttacgttttacaccgtttacctaccccggtaactaaacgtccgaacgggtaccgtacgtccccgtagtaccggaacgggtctaaacgggaaagtacggttcggtacgggtaactttacggttttaactaccgttagtaccgaacgtaacttaactaacgttttacgtttaacccgtttcgtttacccggtaaccgtttaccgggttttccgggaaccgggttaacgggtaaccgttaaggggtaacggttaaccgtaaacgttaaaccggaaaaccgggttaacgttccggttacgggtccttaaacccggtaacgttacccgttaacgttaacccggttcggtttaacctccggttaaccccg

SEQ ID NO: 64463 - DNA, 761 bp, Homo sapiens
  misc_feature: GYAE6OF01CV0CH.31.78.H01.1.454.CMB.1.raw
  modified_base (183)..(183): a, c, t, g, unknown or other
  misc_feature (183)..(183): n is a, c, g, or t
  modified_base (204)..(204): a, c, t, g, unknown or other
  misc_feature (204)..(204): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctaggatctctgggtgccgtacggggacatcggtgatgagcctagtttccagactccnggctgtgtctcgtggcgaggnggccaccatcaactgcaagtccagcagtgttgttttactcggaccccaacgtaataacctaacttacttagcttacggtaacccagacgaaggtaaagtaggacacgccctacgtaaaactcctagtactttcgacggtcctttaccgacccgggtactaacggttcccggggttacccaaccggtattccgtagttcggacgtacgggtcgggtacccgtgggacccttatttccaaccgttctaccgacccgtataccgtagaccgaacgtccctaggacgtacgggtactaaggtaaggtacgtacgggtacggtctttaaacgggttttacttacgtacgttaccgaaggtaaccctaaattacgtttaaactttacccgtttttaccgttaccgttccgttacgggtttcccgggacgggtaacgggtaccggtaaggggttacggtaactacttaaaccggaaaacggtaccggttacggttccggtaacggttacctaccccgtaaaccggttaattcccgggtttaaccttccgtttacccgtaacccg

SEQ ID NO: 64464 - DNA, 823 bp, Homo sapiens
  misc_feature: GYAE6OF01AMF85.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtagatgagcctagtttccagtacctcccgtggctgtgtctcgtgggcgaggacgggccaccagtacaacgtgacaacgtccgacgccgtaaggtaggtttcgtttttaagttccggaccccaacaaactaacctaacttacttagtcttacggtaccagtacaaggtaaagtacggaacacgtcccttaacctaactccgttacgtactttacgtcggttcctaccgtacccggggctaccgggtttccccggggttacctaaaccgtcgttaccgtacgttacggaccgtacggggtccggggtaccggttacggggtaacccggttaacgtttttacccaacccggtttacccttaaccgtaaaccccgtaagtttacccgtaacggacccgtacgggtcccttagggacccgtaacggggtactaacgggtaaagtacggttacgttaacggtacgtttaacggttttacgtttaacgtccggttaacacgtaacgtaaacttacttttattaacccgttttcccggtttacgtacgttccgggtttacgggaccggggtaacggtaacccggtaagggtaccgggtactaaaggttaacccgtaaagggtcgttaagggtcggaccttagacccgtacgttactggttactccgttcgtacccg

SEQ ID NO: 64465 - DNA, 661 bp, Homo sapiens
  misc_feature: GYAE6OF01EJJYQ.31.78.H01.1.454.CMB.1.raw
  modified_base (480)..(480): a, c, t, g, unknown or other
  misc_feature (480)..(480): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctcgtgggcgagagggccaccatcaactgacaagtccagccagtacgttgtttttacttcggacccccaacaataacaactacttagtccttacggtaccagacaagaaaggtacggacacgtacccttacctaaaactccttagtacttttacgtcgggtcttccgtacccgggctacggttcccggggttacctaaccgtattcagttcggcagggtcgggtcgtacggggtaccgtatttccacgttctacgacccatcacgccagtccctgacgaggctacggtaagngtggtacggtacgttagttttacttactgtacacgacctaacgtatttacttacctttacttttccgttacgttccgtttacgggcgggtaacgggtaaccgtaagggttagggaacgtacgtaaccgtaaacggtactaggttcgacgtcgacctaactacttacttcgttcttctaccg

SEQ ID NO: 64466 - DNA, 669 bp, Homo sapiens
  misc_feature: GYAE6OF01A15QU.31.78.H01.1.454.CMB.1.raw
  modified_base (343)..(343): a, c, t, g, unknown or other
  misc_feature (343)..(343): n is a, c, g, or t
  modified_base (388)..(388): a, c, t, g, unknown or other
  misc_feature (388)..(388): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgacgcctagtttccagacctcccgtggctgtgtctcgtgggcgagacggccaccatcaactgacaagtccagccagtagtttgtttttacttcggaccccctaacaaataacctaacttacttagcttaggaccagacaagaaagtaggaccacgtccctacctaaactcctagtactttacgngggtaccttccgtaccggctacggttcccgggttaccctaacgtnttaccgagttcggacgtaggtccgggtctacggggacctagtttccaccttccgtacctacctatccgtacgccgtacgcccgtgaccgaggtcgtaggaagtgttcgtaggtacttaagtttacttacgtacgtacgaacgtactaacgttatttacttactttccgttaccgttaccgttacggtttcgggacggtaacggtaccgtaagggtagaccgtactaacgtaacgtagtggtcgtctacgactacctacgttcctacgttccttacgtcccg

SEQ ID NO: 64467 - DNA, 748 bp, Homo sapiens
  misc_feature: GYAE6OF01B2OHQ.31.78.H01.1.454.CMB.1.raw
  modified_base (327)..(327): a, c, t, g, unknown or other
  misc_feature (327)..(327): n is a, c, g, or t
  modified_base (708)..(708): a, c, t, g, unknown or other
  misc_feature (708)..(708): n is a, c, g, or t
tcagcagtagacgtcacgaccggtgctcgatttagtgtgagtagtttgggtttgggggagctacaacaggcaggcaggggcagcaagatggtgttgcacgacccaggtcttcatttctctgttgctcgtaggatctctggtcgaccgtacggggacatcgtgatcgacgtcctacgtttccacgtacctccgtggctgtgtcgtgtggcgaggacggccacatacaactcgactaacgccacgcaaggtcgttgttttacgtccgacccaactaactaaacctaactacttacgtcgtacggtacagtacgaagaaacgtacgtacncgacccttaactaaccgttctgtaaccgtttacggtcgggtaccttaccggtacccggtacgttccgggttaccggttaacccacggttacttctaaccggttcggacaccggggttcgggtccggttacgggtaaccctttacgtttccgaacccgttcctaacccgtacaacgtcaacggacgtacgtcccgagtaccggtacgaacgtacgaggtacgtacggttacgtacgtttaagttacgtcgtacgtacgtaactactaactttcttaacttttccgttctttacggttaccgttacggttacgggtaccggtaacgggtacgaacggtagggtaacaacggttaacgtacggtaacggtcggtaccgttaccncgttacgtaacttcgaccttcggtttacctgttaaccccg

SEQ ID NO: 64468 - DNA, 955 bp, Homo sapiens
  misc_feature: GYAE6OF01EYL5L.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctcgtggatcgtcgtggtgaccgtacggggactagttcgtagagtgacgtccgtagtttccaagaccttcccgtggcttgttgtctcggtgggaccgaggacggaccaacgataccgaacgtcgacgaacgtccgaagacctaggtagtttacgtttttacgttccggaccccctaaactaaaacgttaacctaaaccgttacgtttaacggtaccgtttacggtaacccgtaagaccgaaaaggtaaaacggtaacggtaaccaacgttaccccgttaaccgtaaaaccgttccgttaacgttaacgttttaaccggttcgggtacctttacccggtacccgggtacgtaccgggtttaccccggggttaacctaaccgttacttacgtacggttcggacgtacgggtccgggttacgtacggggtacccttagtttacctaccgttcgtaccgaaccgtacgttaacgacgtacgaccgtaccgtacggaccgtacggttacgaacggtaaaggtcgtaggtcggtaacgtttaacgttttacgttaaccgttaggtaaccaacggttaacctaaaccgtttaacgtttaccgttttaaccgtttaccgggtttaccttaaccgggtttaacccggttttaccgggggaaaccggtttaacgggggtaaaccgttaacggggttaacgggtaaacttaaacccggtaaaacccggtttaaaacggtacccggttaggttaaccggggtaccctaacccgggttaacccctacggttttaaaccggttaccccgtttaacgggtttccccgttaaacccgttaacccccgg

SEQ ID NO: 64469 - DNA, 737 bp, Homo sapiens
  misc_feature: GYAE6OF01ARA8P.31.78.H01.1.454.CMB.1.raw
  modified_base (317)..(317): a, c, t, g, unknown or other
  misc_feature (317)..(317): n is a, c, g, or t
tcagcagtagacgtcacgaccggtgctcgatttagtgtgagtagtttgggtttgggggatctacaacaggcaggcaggggcagcaagatggtgttgcagacccaggtcttcatttctctgttgctctggatctctggtgccgtacggggacatcgtgatgagccagtttccagactccctggctgtgtctcgtgggcgacggagggccaccatcaacgtgcaagtccagccagtagttgttttattcggaccccacaataacaactacttagcttaggtaccagacagaaagtaggacagccctacctaaactcctnaatttacgtcgggacttccgtacccgggctacgtcccggggtttacctaaccgtattccagttcggccgaggtcggggtcgtacgggggacctaagtttccacttcctaccgaaccactcaacgcgaacgtccgtagccgagggtcctaaggtaagtagttcgggtacggtacttaagggtttttaactttccgtaggtacctaacggtactaaaaccttattttaacgtttaacccttttccgttttacccgttaccgttacgggttttcccggggaacggggtaaccggggtaaaccgtaaggggttcgggaaataggtaaccccgaaaaaccggttaccgttacggttacgggtcccgttacggaccctaacccggtttagttccccgtttacggttccccgtttcgttaacccccg

SEQ ID NO: 64470 - DNA, 853 bp, Homo sapiens
  misc_feature: GYAE6OF01ERV4J.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcattttctctgttgctctggatctcgtggtcgccgtacggggacatcggtgatgacgcctagtttccaagcctccgtgctgtgtctcgtgggcgaggaccggccaccgtataccaacgtcgacaacgtccgacgaccgtaggtaggtttacgtttttaccgttaccggaaccccctaaccgtaaaacgttaaacctaaaccgttaacgttaacgtaccgttacggtacccgaacgtacgaaagaaaacggtacggaaccgtacgtaccccttaacctaaaccttccgtacgttaacgtttaccgtcgggtacccgtttaccggttaaccccgggaccgtaccgggttcccgggttacccttaaaccggtacgttcgtaacggttacggaccgtacgggtccgggttcgtacgggggtacctttaaccgtttcgtacctacctactaaccgtaccgttaccgacgtacccgacgtccggtacaccgtacggtacgtaagaaaggttcgttcgggtacgtacgtttaagtttacgtaccgtacggtactaacgtaacttaacttaacgtttacgtttaaccgttttcgttaaccggttcgttaacccgggttcgggtacggggtaaccgggtacgtaacggggttacgtaaccggtaatacccggtaaaaccgttaagggttccggtacggaccgtaacctacgttaacctacggttacgtttccggttaccttccgttacccgg

SEQ ID NO: 64471 - DNA, 786 bp, Homo sapiens
  misc_feature: GYAE6OF01B7NG2.31.78.H01.1.454.CMB.1.raw
tcagcagtagacgtcacgaccggtgctcgatttagtgtgagtagtttggggttgggggagctacaacaggcaggcaggggcagcaagatggtgttgcacgacccaggtcttcatttctctgttgctctggatctcgtggtcgccggtacggggactagtcgtgatggacgcctacgttccagtcctccgtgctgtgtctcggtcgggcgaggacggccactataccaactggactaacgccaacgaccgtaggtcgttttagttttcgttcccgacccaaactaactaaacctacgttaccttaggtcgttacgtaccagacgtaagaaacggtacgacacgtacccgtaacctaactccgtattacgttaccgtacgggttccttaaccggtaccggtaccgtaccgggtttacccggggttaaaccctaacggtttaacttcggtaaccggtttacggaccggtaacgggggttccgggtaaccggttacccggggtaaaccgttttacccggttaacacccggtttacctaccggaaacccgttacgaccgtaacggccgtaacccgtccggtacggacggtacggtaacgaggtaacgtacggttaggttacggtactttaaggtttaccttagtactagtacgtaactaacgttacttactttcctttacttccgttaccgttaccggtcgggaacggtacggaccggtaggtaacgtacgtagaacctaacgggtatcggtaccgatccgactaccgtcgttactcgttactccgtaccc

SEQ ID NO: 64472 - DNA, 723 bp, Homo sapiens
  misc_feature: GYAE6OF01C9CP2.31.78.H01.1.454.CMB.1.raw
  modified_base (162)..(162): a, c, t, g, unknown or other
  misc_feature (162)..(162): n is a, c, g, or t
  modified_base (169)..(169): a, c, t, g, unknown or other
  misc_feature (169)..(169): n is a, c, g, or t
  modified_base (205)..(205): a, c, t, g, unknown or other
  misc_feature (205)..(205): n is a, c, g, or t
  modified_base (321)..(321): a, c, t, g, unknown or other
  misc_feature (321)..(321): n is a, c, g, or t
  modified_base (459)..(459): a, c, t, g, unknown or other
  misc_feature (459)..(459): n is a, c, g, or t
tcagcagtagacgtcacgaccggtgctcgatttagtgtgagtagtttgggtttgggggagctacgaacaggcaggcaggggcagcaagatggtgttgcacgacccaggtcttcatttctctgttgctctgatctcgtggtcgaccgtacgggactagtcgtnagtgacnccgtacgttccagtcctccgtggtctgtcgtctcgngggacgaggacggcctacatacaagtcgactaacgccagaccgaagtgttcgtttacgtccgacccaactaataactacttactagcgttacgactagacgtaagaaagtacgacncgtacctaacctaactctagtattacggcgtcttaccgaccggacttacggttaccgggtacctaaaccggtcttacggtacgttggaccgtagggtccggtacggtacgacggtttacttacgacttccacgaaccngttaccgacgttacacgtaccgtcggaaccgtacggtactaaggtaagtcgttacggtaccggtttaagtttaagtttaaccgtttgtaaccgtactaacgtaactaacctttagtttaacctttaccttacgtttaccgtacgtttaccgggtacggtaacgggtaacgtaccgggtaaagtaagggaccgtttaagaaacccgtaaggtaacctgggttacacccgtgaaccgtacctagtccttacgccttcttaacccgg

SEQ ID NO: 64473 - DNA, 697 bp, Homo sapiens
  misc_feature: GYAE6OF01DMLOC.31.78.H01.1.454.CMB.1.raw
  modified_base (482)..(482): a, c, t, g, unknown or other
  misc_feature (482)..(482): n is a, c, g, or t
tcagcagtagacgtcacgaccggtgctcgatttagtgtgagtagtttgggtttggggagctacaacaggcaggcaggggcagcaagatggtgttgcagacccaggtcttcatttctctgttgctctgatctctggtgccgtacgggacagtcgtgatgacgtcctacgtttccaacgtccttcccgtggccttgtcgtctccgtggcgagcggccaacgtatcaacgtcgactaacgtccagccaggtacgtttcggtttttacttaccggaccccctaaactaaaataacctaacgttaacgtacgtaccgttagtaacccgagaccaaggtaaagtacgacacgtccctaactaaacctccgtagttattccgtgtccgttccgtaccggctacgtcccgggttaccaacgttctactagtcgcgtacgtcggtcgtacggtacgttcttacacctcgtaccacctaagtccgacgtacncgtacccgtgaccgtagacgtagacgtattgtacgtacttaacgttacttaccgtgtacctagtaacctaagttatttacctacttttcgttaccgttcgtaccggtttacggacggtacggtaaccgtagggtagtaaccgtagaaaccgtaacggtacgtacggtacgacgtcgaacccgttactacgttacttacgttacttacccgttacg

SEQ ID NO: 64474 - DNA, 817 bp, Homo sapiens
  misc_feature: GYAE6OF01DJSY0.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgacgcctagtttccagtacctcccgtggctgtgtctcgtgggcgaggacgggcccaccatacaactgacaacgtccacgccagtagtttcgtttttacgttccggaccccctaaccaaaactaaacctaaccttaacgtttacgtaccgtttacgggtaacccaagtacgaaaggtaaaaggtaacggaaccacggtaccccttaaccctaaaaccttccgtagttaacgttttaaccgtcgggtcctttacccggtaccccgggacttaccgggttccgggttaccctaaaccgtacttcgtagttcggacgtcggtacggggtccgtacgggtaaccgttacttccgaaccgttcctacgtaacccgtagtaccgaacggccgtaacgcccgttggaccgtaggtactaggaaagtcgttggtcggtaactttaggtttaacttacgtcgtaccgtagtaactaaacttactttaacgtttaccttttaccgtttaccgtttaccgtaccgggtttacggggaaccgggtacgggtaaccggtaaagggtagggaaacgttaacgtaaacccggtaaaacggtacggttcggtacgggtaccgtaagggtacccctaaccgttactttccggttacggttacccttcgttaccccg

SEQ ID NO: 64475 - DNA, 772 bp, Homo sapiens
  misc_feature: GYAE6OF01DL6AR.31.78.H01.1.454.CMB.1.raw
  modified_base (128)..(128): a, c, t, g, unknown or other
  misc_feature (128)..(128): n is a, c, g, or t
tcagcagtagacgtcacgaccggtgctcgatttagtgtgagtagtttgggtttggggagctacaacaggcaggcaggggcagcaagatggtgttgcagacccaggtcttcatttctctgttgctctgntctcgtggtcgccgtacgggacagtcgtgagtgacgccgtagtttccgacgtacctccgtgtctgtgtcgtcgtggcgaggacggaccacgactacaactcgacacgtccacgcagtagtttacgttttacgtaccgacccaaccaaataacctaactacttacgtcgttacgtaacagacgaagaaggtacgacgacgtacctaacctaacctcgtagttacttccgtcggtccgttaccggtaccccggtcgtaccgggtcccggttaaccctaaccgtattcgtacgttcggacgtcgggtccgggttcggtaccgggtaaccttacgtttcctacgtaccctacctaaccgtacgtaccgaacgtcaaccgtaccgtgtaccggagtaccgtaggaagtacggttggtacgtactttacgtttacgtttacgcgtaacgtacgtacccttaaatttaccgtttaaacgtttcctttaccgtttcccggttaacgtttaccgggttaccgggaacggtaccggggtaaacggtaagggttaaggaacggtaaccgtaaaccggtaaaacgttcggttacggttacggtccgttaacgtacccgttaacgtacgttccttacgttcccgttaccttaccccg

SEQ ID NO: 64476 - DNA, 725 bp, Homo sapiens
  misc_feature: GYAE6OF01CCGT5.31.78.H01.1.454.CMB.1.raw
  modified_base (326)..(326): a, c, t, g, unknown or other
  misc_feature (326)..(326): n is a, c, g, or t
  modified_base (344)..(344): a, c, t, g, unknown or other
  misc_feature (344)..(344): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagtacctccgtggctgtgtctcgtgggcgagacggccaccatcaactgacaacgtcagccagagttgttttattccggacccaacaagtaaccaactacttgtcttacgaccagcaagaagtgacacgacctacctaaaccttctgtactttacgnggtccttaccgacccggntacggttcccgggttactaacgtacttcgagttcggctcggtgggtccgtagggtaccctgtttccaccgttcctccgaacctacgttcgacgaccgtacgtccgtcggacgtacggtacgtacggaagtggttacggtaggtactttaacggtttaacgttacgtacggtaactaacggtaactaaaccgttaagttttaactttaccggttttaccctttaccgggttacctttaccgggtttaccggggaccggggtaacgggtaaccggtaagggttaacgggacgtaaacgttaccggaaaaccgttacggttcggtaaccggttcctacgtacccgtaaccgttacttacggttcgttacctttcccggtacccg

SEQ ID NO: 64477 - DNA, 710 bp, Homo sapiens
  misc_feature: GYAE6OF01CG962.31.78.H01.1.454.CMB.1.raw
  modified_base (480)..(480): a, c, t, g, unknown or other
  misc_feature (480)..(480): n is a, c, g, or t
  modified_base (564)..(564): a, c, t, g, unknown or other
  misc_feature (564)..(564): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacagtcgtgatgacgcctagtttccagacctcccgtggctgtgtctcgtgggcgagacggccaccatcaactcgacaagtccagccaggtagttgtttagtccggccctaacaactaactaacttactacgtcgttacggtaaccagacgaaaggtaaaggtaccggactaccggacccttaacccttaaaaccgtcccgtaagttacgttttaccggtcggggttacccttaccggtaaccccgggtacgttaccgggttaccccggggttaccctaaaccgtacttcgtacgttcggacgtacgggtcgggtaccgtacgggtaccgtnttcctaccgtctaccacgtatcgacgcctacgccgtagcgagtacgtagaagtcgtggtgtacttaagtttcgtactagacganactaacttactaacttcgtttaccgttcgtacgttaccggttccgggacgggtacggtaaccgtagggtacaacggtacgtaacgtaacggtaggtagtccggtacgtcgtaccgacttacgtcccttacgttcttaccggtaccc

SEQ ID NO: 64478 - DNA, 631 bp, Homo sapiens
  misc_feature: GYAE6OF01BXPNF.31.78.H01.1.454.CMB.1.raw
  modified_base (612)..(612): a, c, t, g, unknown or other
  misc_feature (612)..(612): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagacctccctggctgtgtctcgtgggcgagcggccaccatcaactgacaagtccagccagagttgttttacttcggccccacaataacaactacttagtccttaggtaccagcaagtaaaggtaggacagcctacccgtaaactcctagtactttacgtgggtcttccgtacccgggctacgttccccggggttacctaaccgtattcgtattcggcaggtcgggtcgtggggaaccgtacttcactctaccaccatcagcgacgcctgaccgtacggactagaagtacgtggtacggcgttaagttttattacgttgttacaacggtacaacttagttactttaacctttcgtttacccgtacgtttacgtttccgggacggtaacggacgtagggtaggagtaactaacgaaacgtagtacggtcgtcgtggaccctanacttctcgtctcgtacccg

SEQ ID NO: 64479 - DNA, 821 bp, Homo sapiens
  misc_feature: GYAE6OF01A9J7J.31.78.H01.1.454.CMB.1.raw
tcagcagtagacgtcacgaccggtgctcgatttagtgtgagtagtttgggtttgggggagctacaacaggcagggcagggggcagcaagatggtgttgcagacccaggtcttcatttctctgttgctctggatctctggtgcctacggggacatcgtgatgagccagtttccagactccctggctgtgtctcgtgggcgaggacgggccaccatcaactgcaagtccagccagagttgttttattcggccccacaataacactacttagtcttcggaccagacaagaagtacggacacgccctactaaactcctagtactttaaccgtggggtccttaccgtacccgggtctacggttcccggggttaccctaaccggtcttacgtacgttcggacgtacgggccgggtcgtacgggggtaccttatttcccgaacgttcctacccaaccgtacttacccgagtaccgtacggtcccgttcgggaccggtaacgggtacccgttaagggaaacgggtacgttacgggttacgggtaactttaacgggtttttacttaacccggtacggttacctaacggtaacccttaaacctttaacgttttaacccttttaacgttttccggtttttaaacccgttccgtttaaacccgggttttaccggggacccggggttaaccgggggtaaacccgggttaacggggttacgggtaaaccggtaacgttaaccccgggaaaaacggttaacggttcgggtaaccggttaccggtacggaacccgtaacgttacgtttaccttcgggttaccttacccgttaacccg

SEQ ID NO: 64480 - DNA, 767 bp, Homo sapiens
  misc_feature: GYAE6OF01EPCGL.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagactccctggctgtgtctcgtgggcgaggacggccaccatcaactgacaacgtccagaccagtagttgttttacttcggaccccaacctaataacaactacttagtcttaggtaccagacaagaaagtaggaccacgtacctacctaaactccgtgtacttacgtgggtccttccgtacccggctacgttccgggttacctaaccgattaccgtattcggactaggtcgggtcgtcggggtaccgtactttcgaccttcctccaaccataccgagtaccgacgtcccgtcggacgtacgggctaggaagtaagtgggtacggtactttaaggttttaacttaacgtcgtacgtaacgacctaaacgttagtttaactttacccgttttacgttttacccggttaccgttaccgggttttaaccggggaaccggggggttaaaccgggtacccgttaaaagggggttacgggtaaaccggttaattaaaccccggtaaaaaccgggtaaccgtttcgggtacgggtaacccgtcggtaaccccgtaacccggttactttacccggttcgtttacccggttacctttaaccccggg

SEQ ID NO: 64481 - DNA, 839 bp, Homo sapiens
  misc_feature: GYAE6OF01BZU44.31.78.H01.1.454.CMB.1.raw
tcagcagtagacgtcacgaccggtgctcgatttagtgtgagtagtttgggtttgggggagctacaacaggcaggcagggcagcaagatggtgttgcagacccaggtcttcatttctctgttgctcgtggatctctggtgccgtacgggacagtcgtgatgagcctagtttccagtacctcccgtggcttggtcgttctcggtgggcgaggacggacccaccagtccaacgtgaactaacggtccacgccgagtacgtttgttttacgttccgacccctaaacaaataacctaaccgttacgttaagtccgtttaggtaaccacggtacgaaaggtaaagtaccgacgtacgtacccctaaccttaaaacgtccgtaggttaactttaccggtcgggtacctttaccggacccgggtactaccgggttaccggggtttaaccccaacgtcgttcgaggttcggaacgtcggggtccggttacgtaccggggtaacccttatttacccggactacccgttacgacccgtagtaccgtacaccgtaccggtaccctcggtaccgggtaacgggccttaagggtaaacgtacgggttacggttaacgtcgttttaaacggttttaacttcccggttacgtaaccggtaccgtaaaccctttaaacgtttaatttaacgttttaccccggttttagttccccgtttaaccgtttacggggtttaccccgggaaggtaaccggggtaaccgtaaagggtcgtaaacgtaaccgtaagtaaacccgggtagtcggtaacgtccgaaggtccaaacgttcctaagttccgtttactcccgtaacccg

SEQ ID NO: 64482 - DNA, 681 bp, Homo sapiens
  misc_feature: GYAE6OF01ERU4R.31.78.H01.1.454.CMB.1.raw
  modified_base (234)..(234): a, c, t, g, unknown or other
  misc_feature (234)..(234): n is a, c, g, or t
  modified_base (380)..(380): a, c, t, g, unknown or other
  misc_feature (380)..(380): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacgggacatcgtgatgagccagtttccagacctcccgtggctgtgtctcgtgggcagaggccaccatcaactgcaagtccagccagagttnttttatcgccccactaataacaacttacttagcttggtaccagcaagtaaagtggacacgccctaccgtaaactcctagtactttacgtcgggtcctttcccgtaacccgggtcacggttcccggggtttacccttaaacccggtntttccgaagtttcggaccgtaggccgggttcctacgggggtaccctagtttccacgttcctaccgaccgtatcgaagccacgtcctaggccgaggtcgtagaacgagttagtacgtcgttaagtttacttacgtgtacgagtaccgtaactagttacttacgtttacgtttcgtacttacggtttccgggacgggtacgggtaacccgtaagggttaccggaacgtaacgtaccgaaaaccgtaggttcggtacgcgttaccgaccgtaccgttattacccgttcgttaccgttctaaccc

SEQ ID NO: 64483 - DNA, 750 bp, Homo sapiens
  misc_feature: GYAE6OF01AZYXH.31.78.H01.1.454.CMB.1.raw
tcagcagtagacgtcacgaccggtgctcgatttagtgtgagtagtttgggtttgggggaggctacaacaggcaggccaggggcagcaagatggtgttgcagacccaggtcttcatttctctgttgctctggatctctggtgccgtacggggacagtcgtagagtgagtcctagtttccagactccctggctgtgtctcgtgggcgagacggccacatcaactgacaagtccagccagtagtttcgttttacttccggaccccaacctaataacaactacttaacgtcgttcggtaaccagacgaagaacgtaggacacgaccctacctaaacctcctagtacttaccgtggtccttaccgtacccgggctacggttcccggggttaccctaccgtacttaccgtagtcggcgtacgggcgggttcgtaccggggaccgttaacgtttccgacccttactcccgaacctactacaacggtccgtaaccgcctcggaccgtacgggtacttaacggaagtacggttcgggtacggttaccgttaaggttttaacgttacgttacggtcgtaaacgtcctaaaacctttgttaaccttttacccttttacgtttacccggttacttccgggtttaccggggacggtaaaccgggcggtaaggggtcgtaaaggtacctaaccggtaaacggtagttacgggtcgtacggtaccacgttaccctacttaccggttcttccgtttacgtaccccg

SEQ ID NO: 64484 - DNA, 890 bp, Homo sapiens
  misc_feature: GYAE6OF01C4X4N.31.78.H01.1.454.CMB.1.raw
  modified_base (271)..(271): a, c, t, g, unknown or other
  misc_feature (271)..(271): n is a, c, g, or t
tcagcagtagacgtcacgaccggtgctcgatttagtgtgagtagtttgggtttgggggagctacaacaggcaggcaggggtcagcaagatggtgttgcagacccaggtcttcatttctctgttgctcgtggattctctggttgccgttacggggactatcgtgattgagtcctacgtttccagacctccgtggctggtgtctcgcgggacgaggacgggccacagtcaatgacacgtccaggccagtagttcgttttacgtccgaccctanaaactaacaacttacgttagcttcggtaaccagactaaggtaaagtacggaacacgtacccgttaacccgtaaccttccgtagttacgtttaccggtacgggtacgtttcccgtaacccgggcgttaaccgggttaccccggggttaccctaaaaccggtctttacgtacgttacgggtaccgtacggggtacgggttaccgttaggggaaccccgtttactttacccgtaacccgttaccttacccggtaaaccttcggtaaccgaacgggtacctaaccggtccccgttaggaaccgggttacggaccggttaaaggtaaacggtacgggttacgttaaaggtcccttaaaggttttttaacgtacccggtttagttaaccccgtagggtaaaccttaaacccttttaggttttacccttttaaccgtttttacccggtttacccgttacgtttaccccggggttttaacggggacccgggttaccggggtaacgtttaacgggttacccggtaaaggttacccgtaaacgggtaaacccgtagggtttacggtccgggtaacttaccgggaccttaaccgtgtttacccggtaacgtttccgtacccttaaccccg

SEQ ID NO: 64485 - DNA, 739 bp, Homo sapiens
  misc_feature: GYAE6OF01BEGT0.31.78.H01.1.454.CMB.1.raw
  modified_base (239)..(239): a, c, t, g, unknown or other
  misc_feature (239)..(239): n is a, c, g, or t
  modified_base (675)..(675): a, c, t, g, unknown or other
  misc_feature (675)..(675): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctaggatctctggtgccgtacggggacatcgtgatgagccagtttccagactccctggctgtgtctcgtgggcgagacgggccacatcaactgacaacgtccagccagtagttnttttacttcggaccccaactaactaactaactactttagtcgtttacggtaaccagacgaaggaaaacggttaacggacaacgtccccttaaccgttaaacctccttacgtaatttaccggtcgggtcctttaccggtaccccgggcgtacggttaccccggggtttacctaaccgtatttacctagtttcggacgtacgggtccgggttcgtcggggtaaccctttcgtttacaccgttacctaccgtaaccaacgtaccgacggtaccgacgtccccggttaggaccgtagggtacctaggtaacgtagttcgggtacggtcgtttaagttttaacgttacgtacgttacgaacgtactaaactattttaaccgtttacctttccgtttaccgtacgttaccggtttcgggacggtaccgggacgtaggggtanaggtactaacgaaacgtacgtggtacgccgtacgtccaacctgtaccttcgttcctcctacccg

SEQ ID NO: 64486 - DNA, 897 bp, Homo sapiens
  misc_feature: GYAE6OF01DT7DA.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgacgcctagttccagtacctcccgtggctgtcgtctcggtgggacgaggacgggcctaccatcaactgacaacgtccagaccagtagtttgttttacgtccggaccccaactaataaaccaacttacttaggtaccttacgggtaacctaaggactaaaggtaaaacggtacgggaacctaacgtaccctaacctaaaacctccgtaagttaactttacgtcggtccttaccgacccgggctaccggttcccggggttacctaaccgtattcgaagttcggaccgtacgggtcgggtacgtacggggtaaccgttaactttccgaaccgttaccctaccgtaaccctaacgtcccgaacggtaccaccggccgttacggacggtaacggcgttaaaggaaacgttggtttacgggaccgtttacgtttaacgttttaacgttaccggttacgtaccaacggttaactaaaaccgtttaacgtttaaccgttttaacccttttccggttttaaccccgggttaaccgttttaaacccggggtttacccggggggtaaacggggggttaaccgggtaaaaccccggggtaggggttaaaccgggtaaacgttaaacccggttaaaacccggtaaaaacgggttacccggttaggggttaacccgggtacccgttacgggaacccctaaacgttaacccggtttccggttttcgtttaaccccctttcggttaaacccccc

SEQ ID NO: 64487 - DNA, 671 bp, Homo sapiens
  misc_feature: GYAE6OF01DHLP3.31.78.H01.1.454.CMB.1.raw
  modified_base (362)..(362): a, c, t, g, unknown or other
  misc_feature (362)..(362): n is a, c, g, or t
  modified_base (470)..(470): a, c, t, g, unknown or other
  misc_feature (470)..(470): n is a, c, g, or t
  modified_base (531)..(531): a, c, t, g, unknown or other
  misc_feature (531)..(531): n is a, c, g, or t
tcagcagtagacgtcacgaccggtgctcgatttagtgtgagtagtttgggtttgggggagctacaacaggcaggcaggggcagcaagatggtgttgcacgacccaggtcttctatttctctgttgctctggatctcgtggtcgccgtacggggacatcgtgatgacgtcctagtttccacgtacctcccgtggctgtcgtctcggtgggcgaggacggccaccatacaactgacaacgtccgacgccagttacgtttgttttactccgaccccaacaaataaacctaactacttagtccgttacgtaaccagactaaagaacgtagaccacgccctaacctaacctctagtaacgtttccgnggtcctccggtacccggcgtaccggttcccgggtaacctaacgtctagtagttcggcgtacgggtcggtacgtacgggtacctacttccgtacctccgtacaccgtanaccacggtcacgctcggacgagtcgtaagtaacgtgtcgtaggtatttaagtttactacgnttaccgacgtaactaagtttactttacttacctttcgttcgttaccgttaccggttacgggaaggtaccggaagtaggtagagttacgaaacgtaagtcgtggtccgagtccaactacgtattcttacgtcttacgtacc

SEQ ID NO: 64488 - DNA, 741 bp, Homo sapiens
  misc_feature: GYAE6OF01DW5PI.31.78.H01.1.454.CMB.1.raw
  modified_base (551)..(551): a, c, t, g, unknown or other
  misc_feature (551)..(551): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctgatctctggtgaccgtacgggacatcgtagatgagccagtttccagactcccgtggctgtgtctcgtgggacgagacggaccaccatacaactgacaagtccaagccaagagttgtttttaacttccggacccctaacaaataaaccaacgttaacttagtccgttaggtaaccaagtacaaaggtaaacgtaggaacacgtacccttaacctaaaactccgttagtaacgttttacgtcggtaccttccggtacccgggtactaacggttcccggggtttaaccctaaacgtacgttacgtagttcggacgtacgggtcgggttaccgtaggggtaacccttaatttccgaactacctaccgtaaacctagttacgaacgcgtaacgtccgtacgacgtaggaacttaggaagtacgttaggngtaccgttaagtttactttaacgcgtaccaacgacttaaacgttattaaactttcctttagtttacccgtagttaccggttacggacgggtaacggaccgtaaagggttagaagtaaccgttaaccgaaaacggtaacgttgggtacacgttcgaaaccctactaacgttctacggtactttccgtaacg

SEQ ID NO: 64489 - DNA, 849 bp, Homo sapiens
  misc_feature: GYAE6OF01EQI6T.31.78.H01.1.454.CMB.1.raw
tcagcagtagacgtcacgaccggtgctcgatttagtgtgagtagtttgggttgggggagctacaacaggcaggcaggggcagcaagatggtgtgcagacccaggtcttcatttctctgttgctctggatctcgtggtcgccgtacggggactagtcgtagagtcgacgcctagttccagtacctcccgtggtctgtgtctcgtgggcgaggacggacccacagtcaactgacaacgtccgagcctaaggttcgtttacgttttacgttacccggacccccaaacgtaaactaaacctaaccgttaacgttacgtacgttacggtaaccacgtaacgaaaggtaaacggtacggaactaccgtacccctaacctaaaccgttaccgttacggttaaccgtttaccggtcggttaccctttacccgggtaacccgggtaccgttaccggttacccggggttaaccctaaccggtacttacgtacggtcgccgtaacggggtcccggttacggtacgggtaaccgttcgttaccaccgttacccacctaacccggtattaccgaccggtacgtaccgtcccgtacggtaccggtaggtacctaaaggtaaggcggttacgggtacggttacgtttacttttaacgttaccgtacgtaacctacgtaaccttaacgttactttaaccttttacccgttcgttaccgttaacccggttaccggttccggggaaccggtaacgggtaacggtaacgggtagtaacggaacttaaaccggtaaacggtttcggtacggttccgacgtaaccggaaccttacgtactttacgttaccggttcctacccgttacccgg

SEQ ID NO: 64490 - DNA, 834 bp, Homo sapiens
  misc_feature: GYAE6OF01A9FE7.31.78.H01.1.454.CMB.1.raw
  modified_base (367)..(367): a, c, t, g, unknown or other
  misc_feature (367)..(367): n is a, c, g, or t
  modified_base (395)..(395): a, c, t, g, unknown or other
  misc_feature (395)..(395): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgacgcctagtttccagactccctggctgtgtctcgtgggcgaggagggcccacctatcaactgacctaagtcccagccagtacgtttgttttacgttcggaccccaactaaataaacctaacttacgttacgtcgttaggtaaccaggacaaaggtaaagtaggacacggtcccttaccctaaaacttcccgtagtacttttaccggngggtacctttacccggtaaccccgggtntaacccggtttccccggggtttaccctaaacccgttagtttacccgtaggtttacggaccggtaacgggcggggtttccctacgggggaacccgtttattttacccgaacctttccgtaccaaccctacgttacccgaggtaccctaacggtccctaggtaccgtaacgggtacgtaaggtaaacggtagttacgggttacggtaacgtttaagtttttacgtaacgtttacggtacgtaacgttaacctaaacgtttgtttaaactttaccgttttcgtttaccttaccgtttaaccgtttccggggacgggtaaccgggtaacggtaacgggtagggaccgtaacggtaaacccgaaacgggttacgttacgggttacggaccgttacggtaaccctaaacctcgtttaaccgtttcgttaacccgttctaacccgg

SEQ ID NO: 64491 - DNA, 690 bp, Homo sapiens
  misc_feature: GYAE6OF01ATTC8.31.78.H01.1.454.CMB.1.raw
  modified_base (654)..(654): a, c, t, g, unknown or other
  misc_feature (654)..(654): n is a, c, g, or t
  modified_base (660)..(660): a, c, t, g, unknown or other
  misc_feature (660)..(660): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagacctcccgtggctgtgtctcgtgggcgaggcggccaccatcaactgacaacgtccagccagtagtttgttttacgttccggaccccaacaaataaccaacttacttagtcttacggtaccagacgaagaaagtcggacacgtccctacctaaacctcctagttactttacgtcggtccttaccgacccgggctacggttccccgggttaaccctaacgtacttcgtacgttggaccgtacgggtccgggttacgtcgggtaacccgttactttcccgaacttccctaccaaccgtactaccgtaccggtaccacggtccttaggaccgtacggtccgtaaggaaagtacggtgtacggtacttagtttactcgtagtcacgtactaacttacgtttacttcgtttaccttcgtacgttccgggttacgggacggtaccggaacggtaaggagtacgaactaaccgacggttatcgggtcnccgtanacctactacgttcttacgttcctctacccg

SEQ ID NO: 64492 - DNA, 684 bp, Homo sapiens
  misc_feature: GYAE6OF01BAZ6B.31.78.H01.1.454.CMB.1.raw
  modified_base (446)..(446): a, c, t, g, unknown or other
  misc_feature (446)..(446): n is a, c, g, or t
  modified_base (503)..(503): a, c, t, g, unknown or other
  misc_feature (503)..(503): n is a, c, g, or t
  modified_base (645)..(645): a, c, t, g, unknown or other
  misc_feature (645)..(645): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtcgccgtacggggacattcgtgatgagcctagtttccagtacctcccgtggctgtcgtctcgtgggcgaggacggccacactacaactgaccaacgtccacgccaacgtaggtttacgtttttacgttccggaccccaactaaactaaacgtaacttaacgttaacgtaccgttacggtaacctagaactaaggtaaacgtacggaactacgtacccttaacctaaacttccgtagttactttacgtggtaccttacggacccggtcgtaccggttacccgggttaccctaaacgtcttactagttcgngtacggtcggtcgacggtacctacttcctactccacaactcgcaacgccacgtccgngacgcgtacaaggactagtcggtacgtacttagtttaacgtactcgtacgaactacgtaacttacgtttacttaacgtttctccgtaccgttacggttacggacggtacgaacggtagggactacgtaagtaccgaaagtgnggtacgtccagacctctacgttctcttcttacggtaccc

SEQ ID NO: 64493 - DNA, 770 bp, Homo sapiens
  misc_feature: GYAE6OF01C91TK.31.78.H01.1.454.CMB.1.raw
  modified_base (140)..(140): a, c, t, g, unknown or other
  misc_feature (140)..(140): n is a, c, g, or t
  modified_base (199)..(199): a, c, t, g, unknown or other
  misc_feature (199)..(199): n is a, c, g, or t
  modified_base (345)..(345): a, c, t, g, unknown or other
  misc_feature (345)..(345): n is a, c, g, or t
  modified_base (509)..(509): a, c, t, g, unknown or other
  misc_feature (509)..(509): n is a, c, g, or t
  modified_base (559)..(559): a, c, t, g, unknown or other
  misc_feature (559)..(559): n is a, c, g, or t
tcagcagtagacgtcacgaccggtgctcgatttagtgtgagtagtttgggtttggggggagctacaacaggcagggcaggggcagcaagatggtgttgcagaccaggtcttcatttctctgttgctctggatctctggtnaccgtacggggactgtcgtgatggagcctagttcacgtacctccgtgctgtgtctacgngggcgaggcggccactatacaactcgactaacggccagaccgaggtatttcgtttttacgtcccggaccccaaacctaattaaacccaacttaacgttacgtaccgtttacggtaacccgcggtaacaaggtaaacggtacgaacnccgtaccctaccgttaaacctctacgttacgtttacggccgttccgtaccggtacccggtgtaccgggtttaccccgggttacctaaacggtcttagtacggttcggtacggacgggtcgggttacgtaccggggtactactttcgaccgttcaccgtacgtcngacgtctaccgtcctacgcgtaggtacgtaaggaatggtacggtacggtntttaacgtttaacttacgtacgtacgtaacgtaccttaacgttagtttactttacgttccgtttaccgttacgttacggttacggggtacgggacgttaccgggtaacggtacggtacgtaacgtaaccggtaaaccggtggtttacgggcctacgttacccggtaacgtaccgttacttaccggtttccgttacccgttcggttaacccc

SEQ ID NO: 64494 - DNA, 814 bp, Homo sapiens
  misc_feature: GYAE6OF01AK13D.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtcgccgtacgggacatccgtgatgagacctagtttccagtacctccctggctgtgttctcgtggggcgaggacgggccaaccatccaactgaccagtccagccagtagttcgttttagttcggccccgactaagtaacctaacttacgttacgtcgttcgtaaccagacgaagaacggtagactacgacctacctaaaccgtctagtacgtttacgcggtaccttaccgtacccgggactaccggttacccggggtttacctaaccgttagtacgtacgttacggcgtacggtccggttaccggtacgggtaccgttactttaccgacccgttccctaccgaacccgtactaccgacggtaccgtaaccggtcccgtggtaaccccgtacgggtaccgttaaggtaaacggtacgtttcgggggaacgttaacccgggttaagttttaaaccgtttaccgtaacggttactaaccggaaaccttaacgtttaaccgtttaactttaaccccggttttcttttacccggttaccgtttcggttaacccggggtcggggttaacggtaaaccgggtaacgggtacggtaaacgtaccgtaaacggtaaaccgtaccgttagggtcgtaaccgtccggtaacctaccgttacttccttacgttccgttaaaccgttcccg

SEQ ID NO: 64495 - DNA, 781 bp, Homo sapiens
  misc_feature: GYAE6OF01A0FAB.31.78.H01.1.454.CMB.1.raw
  modified_base (152)..(152): a, c, t, g, unknown or other
  misc_feature (152)..(152): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgaccgtacgggganatcgtgatgagcctagtttccagacctcccgtggctgtgtctcgtgggacgaggacgggccaccatcaacgtcgacaacgtcccagaccagtagtttgttttacgttcggaccccaaccaataacctaactacgttagtcgttacggtaccagacgaaggaaaggtacggacctacgtaccccttaacctaaacctcccgttagtaacgtttacgtcggggtcctttaccccggtaacccggggtacctaaccgggtttacccccgggggttaacccctaaaccggttacgtttaccgtacggtttacggaccgtaggggtcccgggggttacgaccgggggttaacccttacgttttcccgtaaccgttcccttaccaacccgtataccgacgtaccggacgtcccgtagaccgaacggtccgtaagggaaacgagttacggtaccgtgtttaacgttttacttaacgtcgttaaccgaataaccgtaaccttaatttacccttaactttccgttaaccgttcgtacggtttaccgggacggtacggaacgtaaggtacgtaagacttaacgaaagtaccggttcggtacgtcgacgtacccacttacgtacctcgttacctctaccg

SEQ ID NO: 64496 - DNA, 931 bp, Homo sapiens
  misc_feature: GYAE6OF01BR39V.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctcgtggtgccgtacgggacagtcgtgatggacgcctagtttccagtaccctccgtggtctgtcgtcgtcggtgggcgaggacggacccaaccataccaacgtcgacaacgtccgagcctaaggtgtttacgttttacgttcccggaccccaactaaacttaacctaacgtacgttacgtcttacgggaaccagacaaaggaaacgtacggacctacgtccccttaacctaaccttccgtagtaacgttttaccggcggttcccttacccgggacccggtacgtacccggtttacccgggttaaccttaaaccgtacgttacgtacggttaccgggacgtaaccggggtccggggttaccgtacgggggtaccccttacttttaccgaccctttacctacccgtaaaccgtaccgttaccgacgtaaccggtccgtaccccggtaggaccccgggtagtaccggttaacggtaaagttaccggggtttaggtacccggttaacgttttaaaggttttaaccgttccggtttaacggtaacccgtaaacgtacccgtttaaaacttaaccgtttttttacccgttaccccgttttttacggttaaccccgttttaaccggtttaccggtttaaccgggggaaccgggggtttaacccgtaaacggggttaccgggtaacggtaaacgtaaacccggttaacgggtaaaacccggtttaggtccgggttaaccgttacccgtaaacccggacccttaacggtccttttaaccggttcttacccgtttacccggttaaccccg

SEQ ID NO: 64497 - DNA, 693 bp, Homo sapiens
  misc_feature: GYAE6OF01AVBEU.31.78.H01.1.454.CMB.1.raw
tcagcagtagacgtcacgaccggtgctcgatttagtgtgagtagtttgggtttgggggagctacaacaggcaggcaggggcaacaagatggtgttgcagacccaggtcttcatttctctgttgctctggatctctggtgccgtacggggacatcgtgatgagccagtttccagacctccctggctgtgtctcgtgggcgaggacgggccaccatcaactgacaagtccagccagtagttgttttatcggccccacaataacactactagcttggtaccagcaagaagtagacacgcctacctaaactcctagtactttacgtcgggtcttccgtacccgggctacgttcccggggttaccctaaccggtattcctagttcggacgtacggtcggggtacgtcggggtaaccttacgtttccgaaccttcccgttaccaacccgtactaccgacgccgaaccgtccgtcggtaccgacggtacctagggaaacgtaggttcggtacgtacgttaaggttttacttacgttcgtacacgtactaacttatttaacttccgtttactttccggtacttaccggtttaccgggacggtacgggaccgtaagggtggtaacgtacgtaaaccgtaaaccggtcgtacgggtacggtactaccgacctaccgtattccttagtccttcgtccttccccg

SEQ ID NO: 64498 - DNA, 761 bp, Homo sapiens
  misc_feature: GYAE6OF01CE77E.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgacgcctagttccagtacctcccgtggctgtgtctcgtgggcgaggacgggcccacctactcgaactgactaacgtccacgaccaggtagtttgttttacgttccggacccctaaccaataacctaacctacgttacgtccgttacggtaccaagaccgtaaaggtaaacggtacggacctacggtacccttaaccgtaaaccgttcccgtaggttaaccgttttaccggtcggggtaccctttacccgggtaaccccgggtcttaacccgggtttaccccggggtttaccctaaaccggtactttcgtacgttcgggacgtacgggtccgggtacgtcggggtaaccttactttacctactcctaccacctagtccacgtaccgacgtcccgtcggtacgtacgggtacgtaaggaacgtaggtacggttacggtacgtttaagttttacgtactcgttacgaacgtacttaacttatttaacttacctttacttccgttacgtacggtttcgggacgggacggtacgaagggtacgagtaactacgtaaacggtacttggtcgtacgtccgtactactacttctcgtaccttcgttaccc

SEQ ID NO: 64499 - DNA, 801 bp, Homo sapiens
  misc_feature: GYAE6OF01CCBFM.31.78.H01.1.454.CMB.1.raw
  modified_base (152)..(152): a, c, t, g, unknown or other
  misc_feature (152)..(152): n is a, c, g, or t
  modified_base (361)..(361): a, c, t, g, unknown or other
  misc_feature (361)..(361): n is a, c, g, or t
tcagcagtagacgtcacgaccggtgctcgatttagtgtgagtagtttgggttgggggagctacaacgaggcaggcaggggcagcaagatggtgttgcagacccaggtcttcatttctcgtgttgctctggatctctggtcgccgtacggganatcgtagatagacgcctacgtttaccacgacctcccgtggctgtcgtcgtcgtgggcgaggacggccacatacacgtgacaacgtccgagaccgtaagtgtttagtttacgttccgaccccaacaataacgtaacttacgtagtcttacggtaccagacgaagaaaagtggaacacgtaccttaacctaactccgtatacgttttacgnggtaccttccgtacccgggtactacggttacccgggttaactaaccgtattaccgtaaggttcgacgtacggtcgggttacgtaccggggaacttactttaccgaactccttacaacctaacgtcgaacggcgacgtcccgtagtaccggaagtccgtaaagtaaagtacgtaggttacggaaccttttaggtttaacgttccgtaacggtacctaaacggtaacttaaaccgttaacttttacgttttaaccgtttcccgttttaacccgggtaccgtttaaaccggtttaccggggaaacccggggttaaggtaaacccgggtaaagggtcgggtaaactaaacccgtaaacgtaaaacggtacggtacggttaccggaccgtaaccgaccgttaaacccgttattaccgtttaccggttaccgttacccttaacccg

SEQ ID NO: 64500 - DNA, 684 bp, Homo sapiens
  misc_feature: GYAE6OF01CL35X.31.78.H01.1.454.CMB.1.raw
  modified_base (426)..(426): a, c, t, g, unknown or other
  misc_feature (426)..(426): n is a, c, g, or t
  modified_base (446)..(446): a, c, t, g, unknown or other
  misc_feature (446)..(446): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgacgcctagtttccagacctcccgtggctgtgtctcgtgggcgaggacgggcccaccatcaactgacaacgtccagccagtagtttgttttacgtccggaccccaactaaataacctaacttacttagcgttacggaaccagacaaggaaagtacggacacgccctacctaaactcctgtacttacgcggtcttaccgtaccggctacggttcccgggttaccaacgtacttcagttcggacgagggtcgggtcgtacggggaccttnttccacgttcctacacctanccacgcactccgtagaccgagggtactaaggaaagtcgtggtcggtactttaaacggttttactacgttgtaaccgaagtaacctaacgttaacttttacttacccgttttccgtttaccgttaccgttacggtttccggggaaccgggtaccggtaaccggtagggtgaaacggtacgtaaccgaaacgggtacgtggtcgactacgaccctactattcgttcttcttccttacccg

SEQ ID NO: 64501 - DNA, 739 bp, Homo sapiens
  misc_feature: GYAE6OF01BOA3W.31.78.H01.1.454.CMB.1.raw
  modified_base (478)..(478): a, c, t, g, unknown or other
  misc_feature (478)..(478): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacgggacatcgtgagtgagcctagttccagactcccgtggctgtgtcgtcgtgggcgagacggccacatacaactcgactaacgtccacgccgagtagttgttttacttccggacccctaacaactaacaactacgttagtcttacggaccagacaagaaacgacgacacgcctaacctaactccgtagtactttacgtcggtccttccggacccgggctacggttcccgggttacctaaccgtatcgtagttcggacgtagggcggttcgtacgggtaaccgtcttaccgacgtcctaccgtaacctactacgacgtaccacgtcccgtgacgnggactaggaaagtcgttacggtacgtacgtttaagttttactacgtacgtaccgtaaggtaccttaaacgttattttaccgtttaccgttttcccgtttaccgttaccgttaaaccggtttccgggaccggggttaaaccggaaccgggttaaggggtacgtaaacgaaaccggttaaccgtaaaaccggtcggttacggtacgggtacccgtacgtaacccgtaacttacggtttacctttacgttccttacgttccccg

SEQ ID NO: 64502 - DNA, 736 bp, Homo sapiens
  misc_feature: GYAE6OF01DAS7A.31.78.H01.1.454.CMB.1.raw
  modified_base (190)..(190): a, c, t, g, unknown or other
  misc_feature (190)..(190): n is a, c, g, or t
  modified_base (203)..(203): a, c, t, g, unknown or other
  misc_feature (203)..(203): n is a, c, g, or t
  modified_base (380)..(380): a, c, t, g, unknown or other
  misc_feature (380)..(380): n is a, c, g, or t
  modified_base (499)..(499): a, c, t, g, unknown or other
  misc_feature (499)..(499): n is a, c, g, or t
  modified_base (700)..(700): a, c, t, g, unknown or other
  misc_feature (700)..(700): n is a, c, g, or t
tcagcagtagacgtcacgaccggtgctcgatttagtgtgagtagtttgggttgggggagctacaacaggcaggcaggggcagcaagatggtgttgcgacgacccaggtcttcatttcctctgttgctctggatctcgtggtcgccgtacggggacatcgtgagtgacgcctagtttccacgtcctcccgnggctgtgtctcgngggcgaggcggccacatcaacgtgacaacgtccgagacctaggtagtttgttttacgttcccggaccccaacctaaacgtaaccaacttacgttaacgtccgttacgggtacccaggaacgtaaggaaaggtacggacacggtacccctaacctaacctccgtagttactttaccgngggtaccttcccgacccgggtagtaccggttccccgggttaccaacggtctacgtgttacggcgacgggtcgggtcgtcgggtactactttaccgacttcctaccgactatcgacgacncggtcgtacggccgacggtacgtaggaactggtcgggtagtaccgttagttttacgaacgttgtacgaactactaacgttactttacctttacgtttcccgtttaccggtcttacccggggttcggaacggggtacggtaaccgtaaggggtacgagtaaccgtaacgaacggttacgttcggcgttcggacgtaaccccncgtttaccgtacggtttctacggttacccttccccg

SEQ ID NO: 64503 - DNA, 962 bp, Homo sapiens
  misc_feature: GYAE6OF01CVRGB.31.78.H01.1.454.CMB.1.raw
  modified_base (124)..(124): a, c, t, g, unknown or other
  misc_feature (124)..(124): n is a, c, g, or t
tcagcagtagacgtcacgaccggtgctcgatttagtgtgagtagtttgggtttgggggagctacaacaggcaggcaggggcagcaagatggtgttgcagacccaggtcttcatttcctctgttnctctgatctcgtggtcgccgtacgggacatcgtgatgacgcctacgtttcccaacgtcctcccgtggcttggtcgttccgtcggtcgggcggaacggaccgggacccaaccctaataccgaaacgtcgacctaaacgtcccgaagaccgtaggttaggttttagttttaaccgtcccggaccccaaacctaaaactaacctaaaccttacgttaaccgtcgttacggtaacccgaacgtaacgaaaaggtaaacggtacggaccgtaaccgtacccttaaccccttaaaaccgtccgttaagttaccgttttaccggtaccgggtttcccgtttaacccgggtaccccgggtaccgttaaccggttacccccggggttaccctaaaccggtttacttacgtacggttcggaccgtaccggggttacgggtaccggtaccgggtaaccctttaccgtccgttacccgttaccctaacccgtaactacccgtaaccgacccgtaccgtcccggtaccgtaccggaccggtaacgggtaaccgtaacggttaacggtacggttacgggttacggttaaccgtttaacgttttaacgttaccgtaacgttaccgaacggtaacttaaacctttaacgttttaacttttaaccccgttttaccgttttaccccggttaccggtttaacccgggttaccggggtaaccgggttaacggggtaaacccggttaacgggtacgggtaaacgaaccgttaaacccgtaaacggtacggttacggttccgtaccggtacccgtacctaaccgtacccttaacggtttccttaccgttcccgttacccg

SEQ ID NO: 64504 - DNA, 927 bp, Homo sapiens
  misc_feature: GYAE6OF01BVG1A.31.78.H01.1.454.CMB.1.raw
  modified_base (918)..(918): a, c, t, g, unknown or other
  misc_feature (918)..(918): n is a, c, g, or t
tcagcagtagacgtcacgaccggtgctcgatttagtgtgagtagttttggggtttgggggagctacaacaggcaggcaggggcagcaagatggtgttgcagacccaggtcttcatttctctgttgctctggatctctggtgccgtacgggacatcgtgagtgagcctagtttccagtacctcccgtggcttgtcgtctcgtgggacgaggacggccaaccgatacaactgacaacgtccagaccagtagtttgttttacgtccggacccctaaactaaactaaacctaacttacgttacgtacgtttacggtaaccaggaaccgtaaaggtaaaacggtaacggaaccgtaaccggttacccccttaaaacccgttaaaaccgttcccgttacggttaaacctttttaccgggtacggggttaccccttttacccgggaaccccgggtaccgtttaaccgggtttaccccccgggggttttaacccctaaaaccggttaacgttttacccggtaaggtttaccgggaccgtaccgggggtttaccgggggttaccggtttaaccgggggtaaccccttttaaagttttaccctaaccgtttaccctaaccccgtaacttaaacgtaccgaaggtacccgaaccggttcccgtacggtaacggacggtacgtaaggaaacgtacggttacggttaggtaacgtttaacgttttaattaccgtacggtacaacgtaacttaaacgtttaactttaacgttttaaccgttttccgtttaacccggtttacgttaacccgggtttacggggaaccgggtaacggtacggtaaagggtacggtaaagtaaccgtaaacggtaaaccggtattacgggtacggtaccttccggaacttacttacgttaccttcgttacccgttntaaccccgg

SEQ ID NO: 64505 - DNA, 753 bp, Homo sapiens
  misc_feature: GYAE6OF01DWGWW.31.78.H01.1.454.CMB.1.raw
  modified_base (128)..(128): a, c, t, g, unknown or other
  misc_feature (128)..(128): n is a, c, g, or t
  modified_base (217)..(217): a, c, t, g, unknown or other
  misc_feature (217)..(217): n is a, c, g, or t
  modified_base (507)..(507): a, c, t, g, unknown or other
  misc_feature (507)..(507): n is a, c, g, or t
  modified_base (708)..(708): a, c, t, g, unknown or other
  misc_feature (708)..(708): n is a, c, g, or t
  modified_base (736)..(736): a, c, t, g, unknown or other
  misc_feature (736)..(736): n is a, c, g, or t
tcagcagtagacgtcacgaccggtgctcgatttagtgtgagtagtttgggtttgggggagctacaacaggcaggcgaggggcagcaagatggtgttgcagacccaggtcttcatttctctgttgctgngatctcgtggtcgccgtacgggactagtcggtgatgagcctagttccagcctccgtggcttgtgtctcgtgggcgaggaccggccaccntacctactcgactaacgtccacgcctaagttcgtttaggttttacgttccggaacccccctaactaaactaaacctaacgttacttacgtacgttacggtaccaaggacgtaaagaaaggtacggacaccgtaacccttaacctaaccgtaccttaggttaacttttaacggtccgggtcctttacccgggtaccccgggacgttacccgggttaccccgggttaacctttaacccgtagttcgtagttcggcgtaccgggtcgggttcgtaccgggtcgttacttaccnctcccgacctaactacgtactacgccgagtccctgaccggagtacttaaggacgtagttggtacgttagttaacggttactacgtactacgtacgtacgttaaacttgtttaaccgttacttttccgttacgttccgttacggttcggtaacgggtaccggtaacggtaaggtacgaaacgtacgtaaacgtaaaccggtnttcggcgtaccacgacctcttacggttnttcgttccttcgtaccg

SEQ ID NO: 64506 - DNA, 942 bp, Homo sapiens
  misc_feature: GYAE6OF01BWVWF.31.78.H01.1.454.CMB.1.raw
tcagcagtagacgtcacgaccggtgctcgatttagtgtgagtagtttgggtttgggggagctacaacaggcaggcaggggcagcaaagatggtgttgcagacccaggtcttcatttctctgttgctctggatctctggtcgccgtacggggacatcgtgatgagcctagtttccagtacctcccgtggctggtcgtcctcgtgggcgaggacggccaccatcgaacgtgacaagtccgagccagtgttgttttacttccggacccctaactaaagtaacctaaccttacgttaacgtccgttaacgggtaacccaggtacgaaaagtaaaacggtacggaaccgtaccggtaccccttaacccgttaaaaccttccccggttaagttaaccgtttttaacgggtccgggttacccgtttaacccgggttaacccccgggcgttaacccggggttttacccccggggggttttaacccttaaaaccccggttacttttaccggtaaggttttaccggaccggtaacggggttcccggggtttaccggtaaccggggttacccgtttaaaccttttcccgaacctttacccgttaacccgaaacccgtacgtttaccgaacggtaccctacggtaccccggttagaccgtaacgggtaccgtaaagggaaagttcggtacgggttacggttaacgtttaagttttaacgtaccgttaggtacccgtaactaaccttaaaccttaagtttaccgttttaaccgtttcccgtttaccggtttaccgttaccggttttaccggggaacgggttaaccggggtaacgtaaaggggttacgaaacgttaaaccggtaaccggtaaaacgttaccggttagggtcccggttaacgtacggaccccttaacgttacggttacccgttcgtttaccccgttacgttaccccg

SEQ ID NO: 64507 - DNA, 771 bp, Homo sapiens
  misc_feature: GYAE6OF01EH1C7.31.78.H01.1.454.CMB.1.raw
  modified_base (449)..(449): a, c, t, g, unknown or other
  misc_feature (449)..(449): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagacctcccgtggctgtgtctcgtggcgagcggccacatcaactgacaacgtccagccgaagtacgttgttttacgttccggacccccaaacgtaaactaaacctaaacgttacttaacgtccgttacggtaacccagtaccgtaaaggaaaggtacggaacacgtaccccttaccgtaaaacctccgttagttaacttttccggtcgggtaccctttaccggtaacccccgggcgttaaaccgggtttcccccggggtttaacccctaaaccggtntttacccgtaagtttccgggaccgtacgggtccggggttacgtaccggggaccccttaagtttcccaccttcccgtaccaaccctagttcccgaaggccgtacgccgtaggccgtacgtacgtagtaacgtagttggtacggtccgttaagttttacctacgttcgtacaacgtactaaacttagttacttacctttaccgttcgttacgttcggtttaccgggaccggtaacggacggtaaggttcggaacgtaacggtaaccgtaaacggtacgtaggtccgacgtacgacctaacctagttctccgttcgtcgtacccg

SEQ ID NO: 64508 - DNA, 829 bp, Homo sapiens
  misc_feature: GYAE6OF01BNPKL.31.78.H01.1.454.CMB.1.raw
  modified_base (656)..(656): a, c, t, g, unknown or other
  misc_feature (656)..(656): n is a, c, g, or t
  modified_base (804)..(804): a, c, t, g, unknown or other
  misc_feature (804)..(804): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacgggacatcgtagatggacgcctacgtttccagtacctcccgtggctggtcgtctcgtcgggacgaggacgggcccaaccacgtaccaacgttcgaccgaaacgtcccaagacccgtaaggtagttttacgtttttaccggttaccggaccccctaaaacctaaaacgttaaaacccttaaaccgtttaccgtttaacgtaccgttttacggtaacccaacggtaccgaaaggtaaacggtacggaccaccgtaccccgttaaccttaaaccgtcctagttacctttaacggtcgggttaccttaccggtacccggcgtaaccggttccccggggttaaccctaaccggtacttccgaagtttcggacgtacgggtcggttaccgtaccgggtccgttaacttccgaaccttacccgtaccaacctactacccggtacacccgtaccggaccttacgggactacggtcgtaggaaagtcgtggtaccgtagtttacgtttactacggttacnctaacgactaaccttatttaaccgttcttttccgttaacccggttcttaaccgggttcggggaaccgtaacgggttaaccgtaagggtgaaaccgttaacgtaaccgtaaacgtacggtacgtccggtacctaccgacgtaacccgtnttaccgtcttcccggtattaccccg

SEQ ID NO: 64509 - DNA, 771 bp, Homo sapiens
  misc_feature: GYAE6OF01C3F8I.31.78.H01.1.454.CMB.1.raw
  modified_base (216)..(216): a, c, t, g, unknown or other
  misc_feature (216)..(216): n is a, c, g, or t
tcagcagtagacgtcacgaccggtgctcgatttagtgtgagtagtttgggttgggggagctacaacaggcaggcaggggcagcaagatggtgttgcacgacccaggtcttctatttctctgttcgctcgtggactctcgtggtcgaccggtacgggactagtcgtagagtgacgtccgtagttccgaacgtcctccgtggtcctggtcgtctcggngggacgaggaccggaccaactactacgaactcgaactacgccagacctagttgtttacgtttacgtaccgacctaactaaactaacctacttacgtagtaccgtttacggaccaaggtaacgaaaggtaaacgtcgacctaccgtaccgtaacctaacttcgtagttacgttacggcggtccttccggaaccgtcttaccggtaccggttacaacgttcgtgtaccgtgacgtacggccggtagtacgtacttctccacgtctacgacacgtctagacctacgccgacggtacgtacgaaggtagttacgagtttcgtaccggtatttacgtttacgtcgtacgtacctagtaaccttacttaacgtttccttaccgtttaccggtttaccgtaccggttaaccggtttaccgggaacgggtaacgggttaccggtaaaaggggttccgaaacggttaacgaaacccgggttaacggtacggtttacggacgttacccgttaccgaaaccgttccgttaacgttcggtttaaccctcgggttacccttaccccgg

SEQ ID NO: 64510 - DNA, 880 bp, Homo sapiens
  misc_feature: GYAE6OF01BTAQH.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagacctccctggctgtgtctcgtgggcgagacgggccaccatcaactgacaagtccagccagtagttgttttattccggacccctaacaataaacctaaacttacttacgcttaggtaaccagacaagaaagtaggacacgccctacctaaactcctagtactttacgtggtccttccgacccgggctacggtccgggttacctaaccgtattctagttcggacgtaggtcgggtcgtacgggacctactttacgaccttcctaccaaccgtataccgtacgaccgacgtcccgtaacgccgtaacgggtaccgtaagggtaaacgtagttacggggttacgggtaaccgttttaacggtttttaaacgtttaaccggttacggttacccgtaaacggttaaacccttaaaccgtttaacgtttttaaccgttttaaaccccgtttttttcccgttttaacccgggtttaccccgttttaaccggggttttaacccggggggaaccgggggttaaacccgggtaaccggggttaaacgggggttaacgggttaaaccggttaaaacccggttaaacccgggtaaaaaacccggtttacgggttaccggggttaccgggttaacccggttaaccggtacccccgttaaaccgttaaccggttttacccggtttaccggttttaaccccgtttcccgtttaaacccccggg

SEQ ID NO: 64511 - DNA, 707 bp, Homo sapiens
  misc_feature: GYAE6OF01CQRA4.31.78.H01.1.454.CMB.1.raw
  modified_base (357)..(357): a, c, t, g, unknown or other
  misc_feature (357)..(357): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctcgtggtcgacctacggggacatcgtgatgagccagtttccagactccgtggctgtgtctcgtcgggcgagagggcccaccatcaactgcaagtccagccgagtagttgttttacgttcggccccaactaaataacaaactactagtcttacggtaccagtacaagaaagtacggacacgtacctacctaaactctagtacttacgtcgtcttaccgtaccgggntaacggttcccgggttacctaaacggtcttaccgtaagtttcgggaccgtacgggtaccggggttcgttacggggaacccgttactttaccgaacccttcgtaccaaacccgtattcccgaacgccgtacgtaccgttggaaccggtacggtacggtaggtaacgtagttaggttacgggtacttaggttttaactacggtctacgaacgtactaaccgttattaacttaccgtttacgttccgtacttacggtttaccgggacgggtacggtaaaccgaggggttacgagtacgtaacgaaacgtagtcgtcggtctacgtcctacctactcttacgtccttctacccg

SEQ ID NO: 64512 - DNA, 855 bp, Homo sapiens
  misc_feature: GYAE6OF01EBYXE.31.78.H01.1.454.CMB.1.raw
tcagcagtagacgtcacgaccggtgctcgatttagtgtgagtagtttgggtttgggggagctacaacaggcaggcaggggcagcaagatgggtgttgcagacccaggtcttcattctctgttgctctggatctctggtgccgtacgggacatcgtgatgagcctagtttccagcctcccgtggtctgtgtcgtcgtgggcgaggacggccaccgatacaactgacaacgtccacgacctaggtagtttagttttacgttccggaccccctaaactaaactaaacctaaccgttacgtttacggaccgtttacggtaacccaggacaaaaggtaaaacggttacggaacctaccggtacccttaaccccgtaaaaccttccgttagttaaccgtttaccgtcgggtacccttaccgtacccgggtatacccgggttcccgggttacctaacgtattcgtacggttcggacgtacggtcgggtacgtcggggtaacctatttcacctacgtacgtacctagtaccaggtccgaccgtcgtacggacggacggttacgtaggaacggtagttcgggtacgttacggtttaacgtttaccgttaacggtcgttaccgtaacgttaaccgtaaacctttaacggttttactttaacccggttttcttttaccgggttaccgtttaccggggtttaccgggtaacggggtacgggaaccggttaaagggggtaccggtaaaccgggtaaacttaacccggtaaaacgggttaccggttgggtacccggtaccgttaacccggacccgttaaaccgttacggtttccgtttaacccggtttcccgtaaccgtttaaccccgg

SEQ ID NO: 64513 - DNA, 886 bp, Homo sapiens
  misc_feature: GYAE6OF01BHSQ0.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatggagcctacgtttccagtacctcccgtggcgtgtgtctcgtgggcgaggacgggccaccattacaactcgacgtacgtccgacgccaaggtacgtttacgtttttacgttacccggaccccaactaaactaacctaaaccttaacgttacggttccgtttacgggtaacctaacggaccgaaagtaaaacgggtacgggaacctaccggtacccctaacccgtttaaaccgttcccgttagtttaacggttttaccggtcgggggttacccctttcccggtaaccccggggtaccgtacccgggttttacccccggggtttaacccccaaacggtttaccgtttaccggtacggtttaccgggaccgaacggggttccgggtacgggttaccggggtacccggttactttacccgacgtttcccgtaacccctacgtaacggttccacggtaccgtacccggccgttacgggaccgtacggtaccgtaagggtaacgttacgggttggtacggttactttaacggttttacttcgtacggtactacgtacgtaaacttcgtttaaccttacgtttccttacgttccgttaccggttacggggtacggtacgggtacgtaacggggtacgtacgtaaacgttaacggaaccggttagttaaccgggtccggtaccgtagttacccccgtagttacccggtttcgttcctttaccgttccggttacccc

SEQ ID NO: 64514 - DNA, 842 bp, Homo sapiens
  misc_feature: GYAE6OF01E3VE3.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctcgtggtcgccgtacgggactatcgtgatgacgcctagttccagacctccgtggactgtgtctcggtcggcgaggacggacccacgactacaacgtgaccaacgtccacgcctaagttagtttagttttacgttccgaccccctaacaaacgtaacctaacttacgttacggtaccttacggtaaccaagacgaaaggtaaacgtacggaccacgtacccttaacctaaaccgttaccttacgttaacgtttaccggtcgggttacctttacccggtacccgggtagtaacccggtttcccggggttaaacccttaacggttacttacgtaacgttcggacgtacgggtacggggttccgttaacggggtaccctttacgtttacccgtaccgtcctaacccgtaacccgtaacgtacccggtacgacccgttacgacccggttagtaccccgggtaagggttacctaaaggggtaaacggtcgttagggttaccggttaaaccgttacgtttttaaaccggttacgtacgggttaccaaacgttaaccgttaaactttacgtttaacttttacccggttcgttttaccgtaccggttaccggttacggggaaccggtaggtaaccgagggttacggaactaacgtaaccgtaacgtggttgccggtacctgaccctaacttcgttaccgtacgttcctccgttacccgg

SEQ ID NO: 64515 - DNA, 837 bp, Homo sapiens
  misc_feature: GYAE6OF01EC0V1.31.78.H01.1.454.CMB.1.raw
  modified_base (469)..(469): a, c, t, g, unknown or other
  misc_feature (469)..(469): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtcgccgtacggggacatcgtgatgacgcctagtttccagtacctcccgtggctgtgtctcgtgggcgaggacggccacataccaactcgactaacgtccacgaccgtaggtagtttgtttttacgtttccggacccccaaactaaacttaaacctaaccttacgtttaacgtacgtttacggtaaccaggaccgaaaggtaaaacggtacggacccaacggtaccccttaacccttaaaaccgttcccttagttaacgttttacggtcgggttaccctttcccggaccccgggtcgttaaccggttccccggggtttaaccctaaaccggtntttaccgagtttcggaccgtaggggtcccgggttcgtaccggggtacccttacgtttccaccgttcctaccaccgtactaccgacggaccaccggtcccgtaggacccggtaggtacctaaggaacggttagttcggtacggtactttaaggttttacttacgtacggtaacaacggtaaccttaaacgttacttttaaccgtttaccgttttcgtttccggttacccgtttaccgggttaccgggacggggtaaaccgggtaaccggtaagggtacggtaaactaacgtaaccggaaaaccgttacggttacgggtcgtacccgtacgaccttaacctacgtttacgttcttccgttccgttacccg

SEQ ID NO: 64516 - DNA, 783 bp, Homo sapiens
  misc_feature: GYAE6OF01ARTZS.31.78.H01.1.454.CMB.1.raw
  modified_base (87)..(87): a, c, t, g, unknown or other
  misc_feature (87)..(87): n is a, c, g, or t
  modified_base (91)..(91): a, c, t, g, unknown or other
  misc_feature (91)..(91): n is a, c, g, or t
  modified_base (760)..(760): a, c, t, g, unknown or other
  misc_feature (760)..(760): n is a, c, g, or t
tcagcagtagacgtcacgaccggtgctcgatttagtgtgagtagtttgggtttgggggagctacaacaggcaggcagggcagcaagntggngtgcagaccaggtcttcatttctctgttgctctggatctcgtcggtgccgtacggggacagttccgtagactgacgtccgagtttccagacctcccgtggctgtggtctacgtcgggacgagtaacgggcccactatacaacgttcgactaacgtcccgagaccgtaagtacgttcgtttttaacgttcggaccccctaactaaagtaaactaaccgtacgttacggtaccgttacggttacccgaagtaccgaaacggtaaacggtacggaacctacggtacccctaacccgttaaaactccctaaggtacttttacgcgggtaccttaccgttaccccgggacgttaccgtccgggttaccctaaaccggattttaccgaagtttccggcggtaacggtcccgggtcgtaccggggtaccttaacgtttacgacttccgttaaccgaccttaagccaacgtaccgacgtacccgagtacgaacgtcgttaacggaaatcgtacggtcggtaacttaggttaattactgtacacgtacaacgttaagtttactaccggttactttacggttcgaaccgtttccgggaacttaaccgggggaactaacggggtctaaggtacctaaaccgtaacggtacgttggccgtacgacggtccaaaccgggttnaaccttgtacccttctaacccgg

SEQ ID NO: 64517 - DNA, 854 bp, Homo sapiens
  misc_feature: GYAE6OF01B3TBR.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgacgcctagttccagtacctcccgtggctgtcgtctcgtgggcgaggacggccaccactacaactcgacaacgtccacgccagtacgtttgttttacgttaccggaccccaactaaactaaactaactaacttacgtaccgttacggtaaccagacgaaaggaaaacgtacggaccaccgtaccctaaccctaaccttaccgttagtaacgtttacggtccgggttacccttacccggtaccccgggtacgtaccggtttaccccggggttaaccctaacggttaccttacgttacggttcgggaccgtacggggtcccggggttacgggttaccggggtaacccgtttacgtttacctacccgttcctaccaaccctacgtccacgtcgaacccgtccgtcggtaccgacggtaccgttaaggaaacggttcgttacgggtcgttaaccgttttaagttttaacgtaccgttaggtaccctaacgtaacttaacttaacgttttaccgttttacccgttttaccttttaaccggtccctttaaccggggtttacgggacgggggtaacccggttaacgggtaaggggttacgaaaaccggtaaacccgtaaacggtaaaccggttacggttacgggtcggtccctaacgggtacctaacgttaccttacgggttacctttccctcggttacccc

SEQ ID NO: 64518 - DNA, 641 bp, Homo sapiens
  misc_feature: GYAE6OF01A9A4C.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgaggacgggccaccatcaactgcaagtccagccagagttgttttattcggccccaacaataacaactacttagcttcggtaccagcaagaaagtaggacagcctacctaactcctgactttacgtgggtccttccgtacccgggctacgttcccggggttaccctaaaccggtattccgtattcggaccgtacggtcggggtcgtcggggacccgtatttccacttcctacacccatccagcacgccctgccgaggtctaggaagtagtggtggtacgttaagtttataccgtgtacgacgtacaactattacttacctttccgtttacgtaccttacgtttccgggacgggtacgggaaccgtagggtagacgtacgtaaccgaaacggtacttgggtcggactacggaccctaaccgtactccgttacttccgttaacctccg

SEQ ID NO: 64519 - DNA, 857 bp, Homo sapiens
  misc_feature: GYAE6OF01C7CP6.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggactagtcgtgatgagcctagttccagactccctggctgtgtcgtcgtgggcgaggacgggcccaccgatccaactcgacaacgtccaggccgaaggtagtttacgtttttacgttccggaccccctaacctaaagtaaaacctaactttaaccgtttaacggcctttacgggtaaacccaaggacctaaaggaaaagttacgggacctaccgtacctaacctaaacctcgtagttaaccgtttacggtacggtcctttaccggtacccgggacgttaacccgggttccgggtaacctaaccgtattcgtagttcggacggtacggtacgggtaccggtcgggtaaaccttcgtactaaccgtcgtaacacgtacgtacacgtaccgtacggtccagggtacctaggtcgtaaggtaaagtcgttcgggtacgttaacgtttagttttaaccgtcgtagtaccgtaacgtaaaccgttaatttaacttaaccggttttaccctttcggtttacccgttaacggtttacccggggttttacccgggggaacgggttaaccgggtaaaccgttaacgggggtaacggtaaaccttaaaccggtaaaaccccgtaaaagggtttacgttaacgggggtttcccaacccggtttaaccggacccttaaacccgtggtttacccgtttaaccgtcgtttaacccgtaacccccg

SEQ ID NO: 64520 - DNA, 982 bp, Homo sapiens
  misc_feature: GYAE6OF01EPD27.31.78.H01.1.454.CMB.1.raw
  modified_base (972)..(972): a, c, t, g, unknown or other
  misc_feature (972)..(972): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggtatctcgtggtcgccgtacggggacagttcgtagtatacgacgaccttacgtttaccaacgtcccgttccccgtggtcttcggttcgttccgtcggtcgggaccggagggaccggacccaaccgacgttacgaaaccttcggaaccaacggtacccgaacggtaccgaaggtttaaggttttcgtttttaaccgttcccggaaaccccctaaacctaaaattaaacccaaacctttaaccgtttaacggtcgttaaccggttaaccgacgaacctaaaagggtaaaacgtaaaccggaaccgaccggttaaccccctttaaactaaaacccgtttaccgttacggttaacgtttaaaccggttccgggtacccgtttaacccggtaccccgggttagtaaccccgggttttacccggggtttaaccccgttaaccgttaacgtttaccggtaacgttaacgggtaccggtaccggggtacccgggttccggttaacggggtacccctttaaccggttttacctaccctttacccggtaacctaaccgaaacgtttacccggagttaaccaccggtaccgttaccggacggaaccggtacggtaaagtacggaaacgttgggttacggttaacttttaaacggttttacgtaacggtttaccgtacgtaaccggtaaacctaaactttaacgttttaatttacccgtttactttaccggtccgtttaaccgtttccgggggaacgtaaccgggtacggtaaagggtacgtaaacgtaacgttaaccggtaaacgtcgggtaacgtggtacgtaccacgaacctttagttactcgtttaacccgntttaaccccg

SEQ ID NO: 64521 - DNA, 750 bp, Homo sapiens
  misc_feature: GYAE6OF01E476C.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtcgccgtacggggacatcggtgatgacgcctagtttcccagtacctccctggtctgtgtctcgtgggcgagacgggccaccatcaactgcagtccagccagtagttgttttattcggaccccaacaataacaacttactagcttaggtaccagacaagaaacgtaggacacgtaccctacctaaaccgtcctagtaactttacgtcgggtacctttccgaccccgggtctaccggttccccggggttacccttaaccgtacttcgtaacgtttcgggaccgtacgggtcccggggttacgttacggggtaaccctacgttttaccaaccttccctacgaacccctataccgacgacgtaccggcccgtaggaccgtaacggtctaaggtaaacggtcgttacggttcggtaaccgtttaaggttttaacttacgttacggtacctaacgtaacctaacgttaacttttaaccgtttaccgtttaccgtttccgttaccggttacggtttccggggacggtaacggggtaacgtaagggtggaaacgtacgtaaccgtaaacggtacgttggacggtctaccgacctacctagttccttcgtccttccgtaccg

SEQ ID NO: 64522 - DNA, 772 bp, Homo sapiens
  misc_feature: GYAE6OF01DLWB8.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtcgccgtacggggacagtcgtgagtgacgcctaacgtttccaagtacctcccgtggcctggtcgtctcggtggcgacggacggccacacgtacaactcgacaacgtaccacgaccgtagtacgtttagttttacgtccggacccctaacaaataactacttactacgtcgttacgtacacgacaagaacgtacgacacgtacctacctaacctcgtagtacgttacggtcggtccttaccggaccgggtcgtaccggttaccccgggttacctaaccgtacgttacgtacggttacggcgtacgggtccggggttcgtacggggtaacccgtttacttacccgtaccgttcctaccgtaaccgtaactttccgacggtaccgtaccgtccggtaaccgtacgggtacgtacgtaacggaaagttcgttcgggtacgttccgtttaaggtttactacggtctacgtaacgtataactttacgtttaactttccgtttcgtttccgttacgttaccgggttcggggaaccggtacgggtaaccggttaggacggtactaacggtaaaccgtaaacggttccgttaggcgccgttaccgaacgttacccttagttcgtttacgttccgttctaccccg

SEQ ID NO: 64523 - DNA, 631 bp, Homo sapiens
  misc_feature: GYAE6OF01AP73T.31.78.H01.1.454.CMB.1.raw
  modified_base (152)..(152): a, c, t, g, unknown or other
  misc_feature (152)..(152): n is a, c, g, or t
  modified_base (191)..(191): a, c, t, g, unknown or other
  misc_feature (191)..(191): n is a, c, g, or t
  modified_base (416)..(416): a, c, t, g, unknown or other
  misc_feature (416)..(416): n is a, c, g, or t
  modified_base (433)..(433): a, c, t, g, unknown or other
  misc_feature (433)..(433): n is a, c, g, or t
  modified_base (442)..(442): a, c, t, g, unknown or other
  misc_feature (442)..(442): n is a, c, g, or t
  modified_base (458)..(458): a, c, t, g, unknown or other
  misc_feature (458)..(458): n is a, c, g, or t
  modified_base (476)..(476): a, c, t, g, unknown or other
  misc_feature (476)..(476): n is a, c, g, or t
  modified_base (570)..(570): a, c, t, g, unknown or other
  misc_feature (570)..(570): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtcgccgtacgggganatcgtgatgacgctagttccagcctccgtggctgtgtcncgtgggcgaggcggccaccatacaactgacaacgcacgcagtagttcttttacgtccgaccccaacaactaactaacttactacgtacgttacggacagacgaacggaaaggtacgactacgtccctaacctaacgtctagttacgttacgcggtccttcggacccggctcggttcccggtactacgtcttcagttcggacgaggtcggtcgtacggtaacgttnttccgactcctacactnacgagtccncggtcctgcgacggtnagtaacgtgtgtacgttnttagttactagtgtacaacgtactaacttacttaacgtttcttaccgttactcgttacgttcggacgggaacggtacgtggggtacgaacgtanaaaccgtaacggttacaggtccggtacacgtacctcgtacttccgtattccgtaccgttcc

SEQ ID NO: 64524 - DNA, 779 bp, Homo sapiens
  misc_feature: GYAE6OF01DK955.31.78.H01.1.454.CMB.1.raw
  modified_base (230)..(230): a, c, t, g, unknown or other
  misc_feature (230)..(230): n is a, c, g, or t
  modified_base (771)..(771): a, c, t, g, unknown or other
  misc_feature (771)..(771): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctcgtggatctcgtggtcgaccgtacggggactatcgtgatgacgcctagtttccagtcctcccgtggtctgtcgtctcgtgggacgaggcggccaccatacaacgngcaacgccacgaccaggtgtttgttttacgtccggacccctaacaactaacctaaccttacttacggtcgtttacggaaccagaccgaaaggaaacggtaggaacctaccggtacccttaccgttaaaccttcgtacgttaaccgtttcggtccggttacctttacccgtacccgtcggtaccgtaccgggtttacccccgggtaacttaaccggtaacttccaacggtttcgccggacggtccgggttacggtaccgggtaccttaacgtttcccaccttcctaccgtaactactacgacggccttaaccggcctggacccgagtaccgtaagggaacttggtcggtagttacgtttaagttttactaccggtgttaaccgacgtaaaccttacttaagttttcccgtttacctttcgtttaccgtcgttacgggttaccgggacgggttacgacccgggtaaggtacgaaacgtaactaaaccgggtaaacgttggttacggcgtacgtacccgtactacccgttagttccttaccgtnttaccccg

SEQ ID NO: 64525 - DNA, 886 bp, Homo sapiens
  misc_feature: GYAE6OF01DAEGZ.31.78.H01.1.454.CMB.1.raw
  modified_base (871)..(871): a, c, t, g, unknown or other
  misc_feature (871)..(871): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgacgcctagtttccacgtactcccgtggctgtcgtctcgtgggacgaggacgggcccacgactacaactcgcaacggtccacgaccgaggtagtttagtttttacttcggaccccaaccgtaaattaaacctaaccttaaacgtttacggtacgttttaccgggtaaccgaagtaccaaaggtaaaacggttaacgggactaccggtaccccttaaaccgtaaaaccttccgttagtttaaacgttttacccggtacggggtacctttacccggtaccccggggactttaccgggtttaccccgggggtttacccttaaaccgggtacttcgtaggtttcggacgtacgggtccgggtacgttcgggggaaaccgttacttttccgaacccgtttccctacccgaaacctacgttaccgaacggtacctaacggtcccctacgggtaaccgacgggtacgtaacggtaaaaggtccggttagggttaccggttaacgtttaacgggtttttaacttaccgtcggttaaccaacggttaacttaaacgttaacttttaacgttaccttttaccggtttacgtaccgttacgggtttaccgggacgggtaccgggtaaccgtaacggggtaggaaccgttaaagtaaccggtaaaaccggttaccgttgggttacgaccgttaccggaacctaacccgttaggttccttaccgngttttcctaacccgg

SEQ ID NO: 64526 - DNA, 898 bp, Homo sapiens
  misc_feature: GYAE6OF01EYBMN.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctcttgttgctcgtggacttcgtcgtgggtcgccggtacggggactagtcgtagagtacggacgtccttacgtttacccaagtcccttcccgttggcttaggtcgttcgtcggtacgggacggaagggaccgggtacccaaccgtactaccgtaactgaccgtaacgtccgtacgaccgtaggttagttttacgtttttacgtaccggaccccaaacttaaactaacctaacgttacgttacgttacgttacggtaaccacgtacggtaaggtaaacggtacgtaacgaccgtacccgttaaccgtaaaccgttcctaaggtttaacctttacgggcggttccttacccgggaccggttaccgtacccggttaaccccggggtttactaaaccggtgtttaaccgtacggttacggcggtaacgggtacggggttaccgtacgggtaaacccgtttcgtttaccgaccggtcccttacccgacttaacgacgtaccggtacctaaccggtccttacgggtaacgtacgggtcgttaaacgtacggtacggtcgtttaacggtaacgtttaacggttttataacccgggtttgtaacgtaaccggtaaccctttaagttaaccgttttacgttaacccgtttctttaaacggttcccggttaaaccgggtttcgggaacccgggttacggtaacggacgggttaacggtacgtaacctaacggaacgtttaacggcgttccgacgttccgtactaaccgtgttaccgtttctccgtcttacccg

SEQ ID NO: 64527 - DNA, 703 bp, Homo sapiens
  misc_feature: GYAE6OF01B24OP.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctcgtggtgccgtacggggacatcgtgatgagcctagtttccagtacctccctggctgtgtctcgtgggcgaggacggccaccatccaactgacaagtccagccgagtagttgttttacttccggaccccaactaataacaacttacttagtcttacggtaccagacaaggtaaagtacgacacgtaccctacctaaacctctagtactttacgtcgggtccttaccgtacccgggactacggttcccgggttacctaaccgtattcgagttcggcgacggtccgggtctacgggtacctatttccactcctacacctatacacgcacgcctggcgacggtctagaagtcgttcggtcgtacgtttaaggttttactacgtcgtaacctaacggtaacctaacttactttaactttaccgttttccgtttaccgttcgttacccggtttcggggaaccgggttaacgggaaccgttaagggtcggaactaaccggtaacgtaaaccggtagttagggtccgaccgttacgaacccgttacctacgttcgttaccgttccgttaccgtacccg

SEQ ID NO: 64528 - DNA, 961 bp, Homo sapiens
  misc_feature: GYAE6OF01AT5WU.31.78.H01.1.454.CMB.1.raw
tcagcagtagacgtcacgaccggtgctcgatttagtgtgagtagtttgggtttgggggagctacaacaggcaggcaggggcagacaagactgggtgttgcagacccaggtcttcatttctctgttgctctggatctcgtggtcgccgtagggacagtcgtagagtcgacgctacgttaccacgtaccttccgtggcttgtcgtcgtcgtgggacgaaggacggtccaccgtagtaccaaacgtcggaccgtaacgtccgaacgtaccgtaaggttacggttttacgtttttaacggtttacccggaacccccctaaaaccttaaaactaaacccgttaaaccctttaaccgtttacggtttaacccggtttaaccggtaaaccgtaaccgggaacggtaaaacgggtaaaaacgggtaccgggtaaacgtacccggtaaaccccttaaccccgtttaaaacccgttccgttaaacgggtttaaccttttaaacggggttcgggggttaaccctttaaccccggggttaacccccggggtaaccggttaaaccgggttttacccccgggggtttaaaccccttaaaaaccggttagttaacccgtaaggggtttaacccggacggtaaacccggggttacgggggttaccggtaaccggggtaaaacccgtttactttaacgacccgttaaccctaaccgttaacctaacgtaaccccgaagtaacccgtagtaacccgtaggaaccgtcgggtaactaggtaaggtacgtagggtactaagtttaacgttacgtaccaggtcgaacgttacgaaagtttcttaacttccgttttacctagtacgtaccgggttaacggacgggtaactaaccgggtaagttcggaaactaccgaaacggtaaaccgtgttacggtcggaaaccttcgacctactagttccgttacgtccgttctaacccgg

SEQ ID NO: 64529 - DNA, 1120 bp, Homo sapiens
  misc_feature: GYAE6OF01B6I27.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctcgtggatctcgtggtcgccgtacggggactagtcggtgatgacgtcctacgtttccgacgtaccgtcccgtggtcgtggttcgtcgtcggtacgggacgacggacgggcccaaccgtataccaacgtcgacgtaacgtaccgaacgtccgaaggtagtttcgtttttacgttcccggaaccccctaaactaaactaaacctaaccttaacgttacgtaccgttaacggtaacccaaggaccgtaaaggtaaaacgacggaaccaccggttaacccttaaccctaaaccgttccgttacgttaaccgttttaaccggccggttaccgtttacccgggtaaccccggacgttacccgggttaccccgggttacccgtaaacgtcgttaacgtaggttacggcgtacgggtccgggtacgtacgggtaacccttctcctaaccgtccaccgtacacgtaccgacgtaccgaccggtacccgtcggtaaccgtacgggttccgtaaagggtaaacgtacggttacggttacggtttaaccgtttaaggttttaaaaccgttaccgttaacggtaccgttaaaccgtaaaccgtttaaaccgttttaaacgttttaacccgtttttacccgtttttaaccccgttttaccggggttttaaaccccgtttaacccgggttttaccccggggggaaacccgggggttaaaccgggtttaaacccggggttaaaaacggggggtaaccggtttaaaaccccgggttaaaaaaccccggttttaaaaaccccgggggtaaaaaaaaaccccggggttttttaccgggttaaaccggggggttttaaacccccggggggtaaccccccggttttaaaacccggggttaaaacccccccgggtttaaaacccgttttaaacccccggggttttttaaccccttttaaccccgggttttttaaacccccccgtttaaaccccccgggtttttttaaacccccccggg

SEQ ID NO: 64530 - DNA, 772 bp, Homo sapiens
  misc_feature: GYAE6OF01ATDZ4.31.78.H01.1.454.CMB.1.raw
  modified_base (495)..(495): a, c, t, g, unknown or other
  misc_feature (495)..(495): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagacctcccgtggctgtgtctcgtgggcgaggacggccacatcaactgacgaacgtccagccaggtagtttgtttttacgttccggacccctaaacaaactaaacctaacttacttagcttacggtaccagtacgaagaaagtacggacacgtaccctacctaaactccgtagtacgtttacgtcgggtccttaccggtacccgggctacggttaccccggggttacctaaaccgttacttacgtacggttacggccgtacgggtcgggttccggtacggggtaccttaacgtttccgtaaccgtccctaccgaaacccgttntaacccgaggtacctaacggccccgtaggacccgtacgggaccttaaggtaaaggcgttacggtacggtacgtttaagtttacgttacgtagtaccgaacgtactaaacgtttacttacgtttaccctttaccgtttacgtaaccgtttaccgggttaccgggacggggtaaccgggtactaaacggggtacgtaacggtaaccgtaacggaaaccgtaagtcggtacgacgttacgtaccctaacgttcgtaccgtttaccgtctttaacgtcccg

SEQ ID NO: 64531 - DNA, 769 bp, Homo sapiens
  misc_feature: GYAE6OF01EO2YQ.31.78.H01.1.454.CMB.1.raw
  modified_base (450)..(450): a, c, t, g, unknown or other
  misc_feature (450)..(450): n is a, c, g, or t
tcagcagtagacgtcacgaccggtgctcgatttagtgtgagtagtttgggtttgggggagctacaacaggcaggcaggggcagcaaggatggtgttgcagacccaggtcttcatttctcttgttgcttcgtggactctcgtggtacgccgtacggggacatcgtgatgacgcctagttccacgacctcccgtggtcttggtcgttctcgtgggacgaggacgggccaccatccaactgactaacgtccaacgaccgtagtagtttgttttacgtttccgaccccctaaactaaactaaacctaacttaccgttaagtccgttacggtaaccccaggaaccgtaaaggtaaaggtacggactaacccgtacctaaccctaaacttccgttagtaacgttttacgtcggtccttaccggtaccggcttacggttcccggttaacctaacgtntcctaggttcgagtacggtcggtcgcggacttcttcacttcacctacgctcgactcgactccgcgaccgtagtaccgtaggaaatacggtggttacggttacgtttattttaacgtcgtttacgtacgtaactacctaacttaactttacccgtttaaccctttaccgtttaacccgttctttaaaccgggtttcggggaacgggtaacccgggttaagggaaaggtacgtaaacgtaacgtaaacccggtaaagtaaccgggttgtacggtaaccctgaaccctaacgttacttccgttactttcctacccgtacccg

SEQ ID NO: 64532 - DNA, 864 bp, Homo sapiens
  misc_feature: GYAE6OF01BKRU9.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagactcccgtggctgtgtctcgtgggacgaggacgggaccaccatacgaacgtgacaagtcccagaccgaaggtagttgtttttacgtttccggacccctaaacctaaaactaaaaccgtaaaaccttaaccgtttaacggttaccgtttaccggggttaaacccaacggtaaccggtaaaacggtaaaaaacgggttaacgggaacccgtaaccggtaccccttaaaccccttaaaaacccttacccgttaggttaaacttttaaccggttcggggtacctttacccgggtaaccccggggtactaccgggttacccccgggggttttaaccctaaaccggttaactttccgtaacgtttcggaccgtaacgggtcccggggttaccggtaacggggtaacccgttacttttaccgtaaccctccttaccaacccgtaactacgaacgacctacggtaccctaggtaccgagggctaacggaaaggtgtaggttacggtacgttaaggttttacttaacgtcgttacaaccggtaactaaacgtaacttttaacgttacttttaccgtttaccggtaccttaccgggtttaccgggaaccggggtacggaaccgtaagggtacgaagtaacgaacgtaaaacgtacgttaggcgtccgtagacctaaccgtattcttaccgtctacgtaccc

SEQ ID NO: 64533 - DNA, 738 bp, Homo sapiens
  misc_feature: GYAE6OF01EDDXB.31.78.H01.1.454.CMB.1.raw
  modified_base (233)..(233): a, c, t, g, unknown or other
  misc_feature (233)..(233): n is a, c, g, or t
  modified_base (392)..(392): a, c, t, g, unknown or other
  misc_feature (392)..(392): n is a, c, g, or t
  modified_base (702)..(702): a, c, t, g, unknown or other
  misc_feature (702)..(702): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacgggatatcggtgatgacgcctagtttccagtcctcccgtggctgtgtctcgtgggcgagcggccacatacacgtgacgtacgtccganccgagtagtttgtttttacttcggaccccaactaaagtaacctaaacttacgttagtacgttacggtaacccagtactaaaggtaaaacgtacggactaccgtccttaaccttaaacctccttagttaactttacggtcggtacttccggtaccgggtntacccgggttaccgggttacctaacgtcttcaggttcggacgtacggtcgggtccggtacgggtacccttaactttccaacgttccctacccgtaacctacgttaccgaaccgtacgtaccggtcccgtaccggaccggtaaggtacgttaaaggacggttagtgggttacggttactttagttttaacttcgtacgtacgtagtaacgtacttaactttctttacctttccgtttcgtaacgtttcggttaccgggacggtacggtaaccggtaggtacgtaacgtagtaaacgtacggtatggtacgngtactacggtccttacggtcctcgttccctgtaccg

SEQ ID NO: 64534 - DNA, 791 bp, Homo sapiens
  misc_feature: GYAE6OF01CWVY8.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcattttctctgttgctcgtggatctcgtgggtgccgtacggggacagtcgtagatgacgacctagtttccagaccttcccgtgggctggttgttcctcgtgggcgaggcggcccaccatacaactggaccaacgtccacgaccgagtagtttgtttttacgttaccggacccccaaactaaataaacctaacttacgttacggtactttacgggtaaccaggtaaccaagggaaaacgtacggacctacgtacccttaaccctaaaaccgttccttaggttacttttacggtacggtcctttaccgtacccgggtactaccgggttacccgggttaccctaaccgtattcgtacgttcggaccgtacgggtccgggtcgacggggtaaccgttactttccaccgttacctaccaccgtactaccgactaccgaacgtccgtcggaccgacggtacgtaggtaagtggttacggtacggttacctttaaggttttacttacggtcgtacctaagaccttaaacttacttttacgttaaccttttccgttaccgttcgttaaccggttccgggacggggtaaccggtacggtaagggtacgtaacgtaacgtaaccgtaaacggttacggttcggtaaacgtcgttcaccgtaccggttacttcgttactccttcgttacccc

SEQ ID NO: 64535 - DNA, 904 bp, Homo sapiens
  misc_feature: GYAE6OF01BNKS4.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgacgcctagttccagacctccgtggctgtgtctcgtgggacgagacgggccacatacaactgcaacgtccagccgtaagtagtttgttttaacgttccggaccccctaactaaactaaacctaaaccttaacgttaacggtccgtttacgggtaacccgtacgaaccgtaaaggtaaaacggtacggaacctaccgtaccctaacccttaaaccttccgttacgttacgttttaacgtacgggtacctttacccggtaaccccgggccgttaacgggttccccggggtttaaccctaaaccgtactttacgtagtttacggcgacgggtaccggggtccgttcggggtaacccgttacgtttaccgacttcccgtacctaaccgtattccgacgtaccgaccggtccgtacgacgtaacgggtacgtaacgtaacgggtagtacgggttacgggttaactttaacggttttaacgttaccggtttaacgtaccggtaacgaacccgttaaattaaccgttttaacttttaacccgtttaccgtttttacccggtaacccgttttaccgggttttaccggggaccggggttaaccgggggttaaacccggaacgggggtttacggtaacggtttaaacgaaaccggtaaacccgggttaacggttacgggttaccgggtacccgttacgaacccgtttaccgtaacggtttaccttacccggttttaacttcccggttaaaccccg

SEQ ID NO: 64536 - DNA, 739 bp, Homo sapiens
  misc_feature: GYAE6OF01DRVMO.31.78.H01.1.454.CMB.1.raw
  modified_base (140)..(140): a, c, t, g, unknown or other
  misc_feature (140)..(140): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtcnccgtacggggacatcgtgagtgcgcctagttccagtacctcccgtggctgtgtctcgtgggcgagacgggcccaaccgatccaactcgacaacgtccagccagtagttgttttacgtccggaccccaacgtaaataacaacttaacttagaccttaggtacccagacaaagaacgtagacacgtaccctactaaacgtcgtagtaatttaccgcgggtacttaccggacccgggactacggttacccggggttaccctaaaccggtacttcagttcgggaccgacgggtacgggtccgtacggggaaccttagtttccactccgtaccacgactcgaacgccacgcccgtgaccgtggtactacggaagtacggtggtacggtagtttaacgtttactacgtcgtacaacgtaccgtaacttagtttaacttaccgttttacgtttaccggttaccgttaccggtttacgggaacgggtacggtaaccgtaaggggttacgtaaagtaaccgtaaaccggtaaaaccgtagttcgggtacggtacccgttagtaaacccgtcgtttaacgttcgtttacccgtcttccgttaacccccg

SEQ ID NO: 64537 - DNA, 643 bp, Homo sapiens
  misc_feature: GYAE6OF01A1ZWK.31.78.H01.1.454.CMB.1.raw
  modified_base (327)..(327): a, c, t, g, unknown or other
  misc_feature (327)..(327): n is a, c, g, or t
  modified_base (377)..(377): a, c, t, g, unknown or other
  misc_feature (377)..(377): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagacctccctggctgtgtctcgtgggcgaggagggccaccatcaactgacaagtccagccagagttgttttattcggccccaacaataacaactactagcttaggtaccagcaagaaagtaggacagccctacctaaactcctagtactttacgngggtccttccgtacccgggctaccggttcccggggttaccctaaaccgtnttccagttcggcaggcgggtcgtcgggacctattccactcctaccaccatcagccacgcctgacgaggctaggaagtagtggtcgtacgttagttttaactacgtgtaccagtacctaacttatttaactttacctttaccgtttcgtaccttaccggtttccgggaacggtacgggaaccgtaagggtacggacgtaacgtaaccgtaaacggtacgttggtcggacctcgacctacctacgttcgtcgttcccgtttcgtaccg

SEQ ID NO: 64538 - DNA, 841 bp, Homo sapiens
  misc_feature: GYAE6OF01DIEL8.31.78.H01.1.454.CMB.1.raw
tcagcagtagacgtcacgaccggtgctcgatttagtgtgagtagtttgggtttgggggagctacaacaggcaggcaggggcagcaagatggtgttgcacgacccaggtcttcatttctctgttgctctggatctctggtcgccgtacggggacatcgtagatgacgcctacgttccagacctccctggctgtcgtctcgtgggacgaggacggcccaccatacaactgacaacgtcacgaccagtagtttgttttactccggaccccaacaaactaaacctaacttacttacgacgttacggtaccaaggactaaaggtaaaacggtacggaaccgtacgtaccccttaacctaaaacctccgtagtttaacgtttccggtacggtccctttacccggacccggggtactaccgggttaccccgggtttaccaaaccgtcttacgtagttcggacgacgggtcgggttcgtacgggtaccgtcttccactctaccgacctagtccgacgtccacgggtccctggaccggtaggtacgtaggaaaggtcttacgggtacgggttactttagttttacgtacgtcggtacctaacgtactaaactttatttaacccttttaccgtttttaccggtttacgttcccgtttaacgggtttaccccgggggacgggttaaacccgggaaaccggggtttaaacgggtacgggtaaaccgttaaacccgtaaaccggtaaaaaaccgggttacccgggttcgggttaacgggaacccccttaggggaaaccccctttaaccgttacggttttacctttacccggttacccttttacgttaccccccg

SEQ ID NO: 64539 - DNA, 773 bp, Homo sapiens
  misc_feature: GYAE6OF01BH23W.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctcgtggatcctctggtcgccgtacggggacatcgtgatgagcctagtttccagacctcccgtggctgtgtctcgtcgggcgaggacgggcccaccatcaactgacaagtccagccaggtagtttgttttacttccggacccccaactaaataacaaccttacttagtccttaggtaccagacgaagaaagtacggacacgtccctacctaaactccgtagtactttacgtcggtccttccgtacccggctaccggttccccggggttaccctaaccgtacttcagttcggaccgaggccgggttcgagggtacctattcaaccctctaccaccacgtcacgcgtcgacccgtgcgacggtctaggtaacgacgtggtacgggtacctttaaggttttacctacgttacgtaccgtaacgacctaaaacgttcttttaaccttaccgtttttacccgttttacccgttaaccggtttacccgggtttaccgggggaaccgggggtaaacccgggttaaccggtaaagggggttaccgtaaacgggtaacccttaaaccggaaaacggtttacccgttagggttacccggacctcggtaaccctaaccggttacttaacccggttcgtttccccgtttaacgttaaccccg

SEQ ID NO: 64540 - DNA, 832 bp, Homo sapiens
  misc_feature: GYAE6OF01E2H23.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagtttccagacctccctggctgtgtctcgtgggcgagacgggccaccatccaactgacaacgtccagccagtagttgttttacgtttcggacccccaacctaaactaaacaactacttagcttaggtaccagacaagaaaggtaggacacgccctacctaaactcctagtactttacgtcgggccttccgtacccgggtctacgttcccggggttacctaaccgtattaccagttttacgcgtacggtccggggttcgtacgggggacccgttactttccaaccttcctaccaaccctacttacccgaacggccgtacgcccgtacggccgaacgggtccgtaaggaaacgggtagttacgggttacgggtacgtttaaggtttttaacctttaccggttacggtacccgtaaggtaaccttaaaaccgttaacgttttaactttaacccgtttttacccgtttttacccggttacccgtttaacccgggttttacggggaccgggggtaaaccggggtaacccggtaaaggggttaggggtaaaccgtaaacgtaaccgggtaaaaacccggttaaacggttcgggttacgggtacccgttaccggtacccgtaaacccgttaactttaccccgggtttacgttttacccgtttccgttaaccccgg

SEQ ID NO: 64541 - DNA, 790 bp, Homo sapiens
  misc_feature: GYAE6OF01DI93U.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgacgccagttccagacctcctggctgtgtctcgtgggcgaggacgggcccaccagtccaacgtgaccgaacggtccaagcccgaaggtacgtttgtttttacgttaccggccccaactaaataaacctaacttaaccttagtccgttacggtaacccgtaagacctaaggaaaagtaacggaacacgtccctaacctaaactcctagtactttacgtcggtccttccgtaccgggtctacgttcccggggttacctaaccgtatacgtagtcggacgtacggtcgggtacgtcggaccgtacttcgactcgtaccactagtcgaacgcgtacgcctacgtacgtacggtacgtaaggaagtagttcggttacggtacgttagttttaacgttacgttcgtacgtacgaacctaactttaacttaactttaacccgttttacgttttaccggtacgttaccggttttaccggggaaccgggtaacgggtaacccggtaagggttaacggacgttaaacccggtaacgtaaaaaccgggtacggtttacgggttaccggggtaccgtttacgaaaccccggttacccgttaacgtttacccgtttaaccggttcccgtttaccgtttaacccg

SEQ ID NO: 64542 - DNA, 790 bp, Homo sapiens
  misc_feature: GYAE6OF01BSH8B.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcggtgatgacgcctagttccagacctccgtggctgtgtctcgtgggcgaggacggccaccatccaactgcaacgtccacgccagtagttgtttttacgttaccggaccccaactaaataaccaacttacttacgtcgttacggtaaccctagacaaggaaacgtaggacctacgaccctaacctaaacctccgtgtaactttacgtcgggtccttaccggtacccgggctacggttcccggggtttaccctaaaccggtactttaccgtaagtttcggacgtacggtccggggtacgtacggggtaaccgttactttacgaacccgttcctacctaacctacgtcgtacgccgtaacgtccgtacgtacggaacggtcgtaagtaacggtaggtacggtacggttaccgtttaagtttttaaacgttacggtcgttacgaaccgtaacgtaaactttacgtttaactttaaccggttttccgttttaccgtaccgtttaccggtttacggggaaccggggtaacgggtaaccggtaagggtacggtaacgtaacgtaaccgtaaaacggtcggtaacggttcggtaccctacgtaccccgtactaccggttatttccggttaccttccgttaacccg

SEQ ID NO: 64543 - DNA, 816 bp, Homo sapiens
  misc_feature: GYAE6OF01BJJ1U.31.78.H01.1.454.CMB.1.raw
  modified_base (174)..(174): a, c, t, g, unknown or other
  misc_feature (174)..(174): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgacgcctagttccanacctcctggctgtgtctcgtgggcgaggacgggacccacctactaccaactcgacaacgtccagaccgaggttgtttagtttttacgttccgggaccccctaaactaaacttaacctaacttaacgttacgtaccgtttacggtaaccagaccgaagtaaaacggtacggacaccgtccccttaaccgttaaaccgtccgttacgttacgtttaccggtcgggttacccttaccggtaccccggggtaccgtacggtttaccccgggggtttaaccctaaaccggttatttacccggtacggttcgggaccgtacggggtccgggggttaccggtacggggtaacccgtttacgttttacccgacctttaccgtaccctaaccctacgtaccgaacggtcctaccgcccgttagacccgtaggacctaggaagtacgtacggttacggtactttaaggtttacttacgtacgtacgtaacacgtaaacttacgttactttacgtttaccgtttcggttaccgtttacgttaccggggacggggtacgtaacggtaacgggtagtaaccggtaacgtaacgtaaacgggtaactggtaacggcctaagaccctaacgtccttacgtccgttcttacgttcccg

SEQ ID NO: 64544 - DNA, 736 bp, Homo sapiens
  misc_feature: GYAE6OF01ELSXO.31.78.H01.1.454.CMB.1.raw
  modified_base (434)..(434): a, c, t, g, unknown or other
  misc_feature (434)..(434): n is a, c, g, or t
  modified_base (571)..(571): a, c, t, g, unknown or other
  misc_feature (571)..(571): n is a, c, g, or t
  modified_base (696)..(696): a, c, t, g, unknown or other
  misc_feature (696)..(696): n is a, c, g, or t
  modified_base (726)..(726): a, c, t, g, unknown or other
  misc_feature (726)..(726): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtcgccgtacggggacatcgtgatggacgcctagtttccagtacctcccgtggtctgtgtctcgtgggcgaggacggccacataccactgacacgtccacgccagtagtttcgttttacgttccgacccctaacgaaactaactaacttacttacgtcttacggtaaccagacgaaggtaaacgtacggacctacgtacccttaaccttaaacgttacctttaacgtttaccggtcggttaccttacccggtacccgggtaccttaccgggttccccggggtttaacctaaaccgttnttaccgtagtcggacgtgggtccggtcggtacggactttacgttcacctcctaccacctacgtccacggtacctcgtcgtacgacgaacgggtactacggtaaagtgttacggtgtactttagtttactcgtacganacgtaacttaagtttaactttaacgtttcctttacgtttaccgtccgtttaccgggtttacgggaccgggtaacggtaacgtagggtaagacgttaacgaaagtaacggtacgtacgggcgtacnccgacctaacgtcgtacttctaaccctttnccgttacccc

SEQ ID NO: 64545 - DNA, 870 bp, Homo sapiens
  misc_feature: GYAE6OF01CRXVW.31.78.H01.1.454.CMB.1.raw
  modified_base (171)..(171): a, c, t, g, unknown or other
  misc_feature (171)..(171): n is a, c, g, or t
  modified_base (578)..(578): a, c, t, g, unknown or other
  misc_feature (578)..(578): n is a, c, g, or t
  modified_base (604)..(604): a, c, t, g, unknown or other
  misc_feature (604)..(604): n is a, c, g, or t
tcagcagtagacgtcacgaccggtgctcgatttagtgtgagtagtttgggtttgggggagctacaacaggcaggcaggggcagcaagatggtgttgacacgacccgtaggtcttctatttctcttgttgctctggtactcgtcgtggtcgaccggtacgggactagttcgngaagtgacgtccgttacgttccacgtcctcccgtggtcctgtcgttcgtcggtacgggacgacggaccggcccaacttactaaccgaactcgaccgaaccgtacgacgaccgtaggttcgtttttacggttttaccgtacccgaacccctaaactaaactaaccgttaacgttaccgttacgtacgttaacgaaaccgagaaaccgtaagggtaaaacgtaccggacctaccgtaacccctaaccgtaccttacgtacgtttaaccgtttccggtaccggttaccgttacccggtaccggtaccgttacccgggttaccccgggtaaccttaaccgttgttacgtacggttagggcctacggggttaccgggtccaaggttcccttagtccctaattcccgactacntaccgagcctagaccgtggactacgngtaacgagtacgttggttactacgtttagttaaccgttagacgtaacgtacgttaatttaaacccgttaagtttttccgttaccgtttttaccccgttacgggttaccccggtttaccgggttaaccgggtaaccgggtacggggtaaaccgggttagaacccggttaaactaaccggtaaacgtaaaccgggtagtttcggacccgggttacacccggttactacccgttattacccggtttactcccggtttacttaccccggg

SEQ ID NO: 64546 - DNA, 896 bp, Homo sapiens
  misc_feature: GYAE6OF01C1Y7W.31.78.H01.1.454.CMB.1.raw
  modified_base (60)..(60): a, c, t, g, unknown or other
  misc_feature (60)..(60): n is a, c, g, or t
tcagcagtagacgtcacgaccggtgctcgatttagtgtgagtagtttgggtttggggganctacaacaggcaggcaggggcagcaagatggtgttgcagacccaggtcttcatttctctgttgctctggatctcgtggtcgccgtacggggacatcgtgatgacgcctagttccagacctccgtggtctgtgtctcgtgggcgaggacggcctacatacaactcgacaacgtccacgcctaaggtagtttagttttacttaccggacccctaaacgtaaaactaaacctaacttaacgttacggtacgtttacggaacctagaacgtaaaggtaaaaggtaacgaccaacgtaccccttaccgtaaaacctccgtacgtaacttttaaccggcgggtccctttacccggtcccgggtactaaccgggtttacccgggttaaccctaaaccggtacttactacggttggacgtacgggacccgggttacggttacggggtaaccctttgttaccgtaccctcgttaccaccgttaaatccgaacggcctaacgcccgtacggaccgtacgggtactaaggtaacgtaacggtttcgggtaacggttacctttaacggtttttaacgtttaaccgttacggtaacccgtaaacggtaacccttaaaacctttaacgttttaaaccttttacccgttttacccgtttttacccgtaccggtttaaccgggttttaccggggaaccgggttaaccggggtaaaccggttaaaggggttaccgggtaaacgttaaccggttaaaaccgtaaaaccggggttaacgttacgggttacgtccggtaaaccgtaaccgttacccgtagtttcccgtttaacggttcccgttaacgtttaccccg

SEQ ID NO: 64547 - DNA, 780 bp, Homo sapiens
  misc_feature: GYAE6OF01DZYVR.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacgggacatcgtgatgagcctagtttccagtacctccgtggctgtgtctcgtgggcgaggcggccaccatcaactgacaagtccagcctaggtagtttgttttactccggaccccaactaaataacctaacttacttacgtcgttacggtaacccaggacctaaaggaaagtacggaccacgtaccctaacctaaaccgtcgttaggtaactttcggtacggtcctttaccggacccgggtactaccgggtttccccggggttaacccttaaaccggtatttcgtaggttcggacgtacgggtccgggtaccgtacgggaacccttactttccgaactccctaccgacctactacaacggtccgacgtcccgtagaaccgtcgtactaaggaaagtggtacggttacgtaagttttacttacgttacgtcgtaaccgacttaactaacgttttacgtttaaccgtttccgtttacccgtttaccgttaccggttaccgggttacgggaaccgggtacggtaaacggtaagggttaccgttaaacgaaacggttaaacggtaaaccgttaggttcggttcggaaccgttaccgtacctacggttaacgttccggttaaccttccgttaccctaccccg

SEQ ID NO: 64548 - DNA, 775 bp, Homo sapiens
  misc_feature: GYAE6OF01ENG5J.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagacctccctggctgtgtctcgtgggcgaggacgggccaccatacaactgacaacgtccacgccagtagttgtttttacttccggacccccaacaaactaacctaaccttacttacgtcttacggtaccagacaagaaagtaggacacgtccctacctaactctagtactttacgtggtccttaccgtacccggtctacgttcccgggttacctaaccgtacttacgtagttcggcgtacgggtccgggttcgtacgggtacctacgtttaccgtactcctacctaacccgtactaccgacgccacggtcccttacggaccgtacggtacgttaaggaaacgttacgttcgggttacggtaccgtttaaaggtttttaaccttacggttacgtacgaacggttaaccctaaactttaacgttttaaccgttttaaccttttaccgttttcccggttaaccgtttaccgggttttacccggggacgggggtaaccgggtaaccggtaagggtagggtaacgaaccgttaacgtaaaaccggtaggttcggtaccggcgtaccgacccttaaccgtagttaccttcggttccttacccgttacccg

SEQ ID NO: 64549 - DNA, 718 bp, Homo sapiens
  misc_feature: GYAE6OF01A5Z86.31.78.H01.1.454.CMB.1.raw
  modified_base (711)..(711): a, c, t, g, unknown or other
  misc_feature (711)..(711): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggactctctggtcgaccgtaacggggactatcgtgagtagacgcctacgtttccactacctcccgtggctgtgtccgtcgtgggcgacggcggacccacgataccaactcgacacgtccacgaccgagttacgtttagtttttacgttccggacccctaaactaaactaaccgtaacttacttacgtacgttacggtaaccagacgaagtaaagacggacacgtacctacctaacctctacgttacttaccgtcggtccttccggtacccggacgtacggttacccgggttacctaaccgtacttacgtagttacggacgtacggtcggtacggtaccgggtacctactttaccaaccgttccacccgtaccgtacgtaccgacgacgtaccgtcccgtagaccgtagtacgtagaaagtcggtcggtacggtacgtttagtttacgttactcgtaccagtactaactttattaactttaccgtttccttcgttaccgttacggttacgggaacggtacggaccggtaaggcgtagaaccgtaacgagtacgtaggtcaccgtgactactcgtacttcgttccngttaccc

SEQ ID NO: 64550 - DNA, 748 bp, Homo sapiens
  misc_feature: GYAE6OF01ANYGJ.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagtttccagacctcccgtggcctggtgtctcgtgggcgaggacgggccaccatcaactgacaacgtccagccagtagttgttttattcggacccctaacaataaaccaactactagtcttcggtaccagcaagaaagtaggacacgccctaccgtaaactcctagtactttacgtgggtaccttaccgtaccccgggtactaccggttcccggggttaccctaaaccggtattaccgtacgttcggaccgtacggtccggggtcgtaccgggggaaccttacgtttaccaacttccgtaccaaccctacgttaccacgtacctacgtcccgttcggaccgtacggtacgtaggaaagtagtcggtacggtacgttaagttttaacgttaccgtgtaacgaacgtactaaactatttaacgttactttccgtttaccgttaccgtttaccggtttacgggtaccgggtacgggtaccggtaaaaagggtcgggaacggtaacttaaccggaaaaccggttacgttagggtacggtacgtaccgtaccgtaaccgtacgttaccgttcgttcccgttcgttacccg

SEQ ID NO: 64551 - DNA, 675 bp, Homo sapiens
  misc_feature: GYAE6OF01EK0TS.31.78.H01.1.454.CMB.1.raw
  modified_base (375)..(375): a, c, t, g, unknown or other
  misc_feature (375)..(375): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctaggggacatcgtgatgagccagtttccagactccctggctgtgtctcgtgggcgagacgggccaccagtcaactgcaagtccagccagtagttgttttattcggccccaacaataacaactacttagtcttaggtaccagcaaggaaagtacggacacggcctacctaaactcctagtactttacgtgggccttcgtacccgggctacgttcccggggttacctaaaccggtnttcgagtttggcgtacggcgggttcgtcgggaccgtatttccgacgttcctccgaaccattcagacctagccgttgcgaggtactagaaagtacgtggtacggtacttaggttttacttacgttggtacaacggtaactaacgttaactttacttaccttttacgtttacgttaccgttaacgtttccgggacgggtaacgggtaaccgtaagggtaggtacgtacgttaaacgaaacgttacgttacggtcggtacctacgacccgtaacgtcttacgttccggtttcctcggttaccc

SEQ ID NO: 64552 - DNA, 779 bp, Homo sapiens
  misc_feature: GYAE6OF01BBRQJ.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctcgtgggcgagacggccaccatcaactgcaagtccagccagtagttgtttattccgaccccacaataactaactactagtcttcggtacagacaagaagtacgacacgtaccctacctaactcctagtactttacgtcggtaccttccgtacccgggtactacggtcccggggttaccctaacggtacttacgtagtttacggacgtacgggtccgggttcgtacggggtacccgttagtttcctacgtcctaccgaacctacgtccgacgaccacgtcctcggaccgaacggtcgtaaggaacgtgtacgggttacggtaacgtttaacgttttaacgtttacgtacggtaacgtacggtaacctaaaccgttaacttttaaccgtttaaccgtttttccgtttaccgttaacccgtttaccgggttttacccggggaccggggttaaaccggggtaaccgttaaagggggtacggtaacggtaacgtaaacccggtaaaaccggttaacggttacgggttaccggaccgtttaccggacccgtaacccttacggtttacccgttcggtttacccgtttaccgtacccg

SEQ ID NO: 64553 - DNA, 640 bp, Homo sapiens
  misc_feature: GYAE6OF01CYABF.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtcctcgtgggcgaggagggcccaccatcaactgacaacgtccagccagtagttgtttttattcggccccaacaaactaaacaactacttagcttaggtaccagacaagaaagtagacagaccctacctaaactctagtacttacgtgggtcttacgtcccggacacgttcccggggtacctaaccgattcagttgacaggtcgggtactgggaccgtaatttccgaactctacgaccatcaagcaacgtcctcgacgtacggacgttagaagtagtcgggtggacttaaggtttatacgtgtacaagacctaaactatttaactactttcgttttacgtcgttaaccggtttcggacgggtacgggaacctaaagggtgaacttacgaaacgtaaacggaaaccgtttggtacggaccgttgaccgtacctaagttctacgttccttcgtaacc

SEQ ID NO: 64554 - DNA, 900 bp, Homo sapiens
  misc_feature: GYAE6OF01D730F.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctcgtggtcgccgtacggggacatcgtgatgagcctagtttccagtacctcccgtggctgtgtctcgtgggcgaggacggcccaccatcaactgacaacgtccagccgtagtagttgttttacgttccggaccccaactaataacctaacttacttacgtcgttacggaaccagacgaaaggaaacgtaggaacctaccgtacccttaccgtaaaaccttccgttagtaacgttttaccggcgggtaccctttacccggtaccccgggtacgttacccgggtttaccccgggggtttaacccctaaaaccggttactttaccgtaaggtttcgggaccgtaggggttcccggggtccggtacggggtaacctttactttcccgaacttccctaccctaacctattcccgaacgtcccgtaacgtcccgttacggacccggaaggtaccgttaagggtaaacgtacgggttacgggttacgggtacgttttaacgtttttaacgttaaccggtttcgtacgtaaacgtaaccctaaacgttaacttttacgtttaacccgtttttcggtttacccgtttaccggttaaccgggttttacccggggaaccgggggttaaccgggtaaacccggtaaggggttaacgggtaaacggttaaacgttaaacccggaaaaccgggttacggttaacggggttccgggtaaccgttaccggaacccgttaacccgttaacgttcccggtttacgtttacccgtccgtttaccccgg

SEQ ID NO: 64555 - DNA, 637 bp, Homo sapiens
  misc_feature: GYAE6OF01BRBU5.31.78.H01.1.454.CMB.1.raw
  modified_base (157)..(157): a, c, t, g, unknown or other
  misc_feature (157)..(157): n is a, c, g, or t
  modified_base (382)..(382): a, c, t, g, unknown or other
  misc_feature (382)..(382): n is a, c, g, or t
  modified_base (428)..(428): a, c, t, g, unknown or other
  misc_feature (428)..(428): n is a, c, g, or t
tcagcagtagacgtcacgaccggtgctcgatttagtgtgagtagtttgggtttgggggagctacaacaggcaggcaggggcaacaagatggtgtgcagacccaggtcttcatttctctgttgctctggatctctggtcgccgtacggggacatcgtnatgacgccagtttccagacctcctggctgtctctcgtgggcgagacgggccaccatcaactgactaagtccagccagacgttgttttacttcggaccctaactaaataaccaacttacttagctttaggacctagaccaagaagtacgacaacgccctactaaacctccagtactttacgcggtctttccgaccgggactacgttcccggggttacctaaccgtnttcgagttggacacggtcgggctacgggacctattcactctccacntcagctacgctgacgagtctagaagtgttggtacgtacttagtttacttcgtgtacaagtacctaattactttacgttactttcgttcgaccgttacgtttccggacgggtaacggtacgtaacggtagggaactacgtaaacgaaaccgtcgtaggtcggtaacctcgaacctcctacgtttacctggttcctaccttcgtaccccgg

SEQ ID NO: 64556 - DNA, 842 bp, Homo sapiens
  misc_feature: GYAE6OF01CUS8J.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttctatttctctgttgctctggatctcgtggtgccgtacgggacatcgtgagtgacgccgtacgtttaccacgtacctcccgtggtcgttggtcgttccgtcggtgggtacggacggaccgggtaccaaccgtaataccgaaacgttcgaccgtaacgtccgacgtaccgaggttacggttttacgtttttacgttacccggaccccctaaactaaacttaaacctaaccgttaacgttaacggtccttacggtaaccgacgtacgaaacggtaacggtaaggacaccgttaccctaccgttaaaaccttccgttacgttacgtttacgtcggtccgttccggtaccccgggtccgtaccggttaccccgggttaccctaccgtacgttacgtacggttcggtacggtacgggtcgggttccggtaccgggtaccttaccttaccgtacctcctaccgtaacctacgtaccgacgtacctcgtcccgtacggtacggacggtacgtaaaccgaaggttagtacgggtacggtttacgttacgtttacgttaccgtgtacgtaacctacgttaaacctttagtttaacccttccgttttactttccgggttaccgttaccgggtttacggaccggtaacggtaccggaaacgggttagaacgttacgaaccggtaacgtacggtacggttcgccgtacgaccttacggtactttccgtacttcgtccgttaaccg

SEQ ID NO: 64557 - DNA, 835 bp, Homo sapiens
  misc_feature: GYAE6OF01BST3Q.31.78.H01.1.454.CMB.1.raw
  modified_base (126)..(126): a, c, t, g, unknown or other
  misc_feature (126)..(126): n is a, c, g, or t
  modified_base (162)..(162): a, c, t, g, unknown or other
  misc_feature (162)..(162): n is a, c, g, or t
  modified_base (407)..(407): a, c, t, g, unknown or other
  misc_feature (407)..(407): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctntggatctctggtgccgtacggggacatcggggggtnatgacgcctagtttccagctcccgtggctgtgtctcgtggcgagcggccaccatcaactgacaacgtccagccagtgtttagttttacgttccggaccccaacaaactaaacctaaccgttacttaacggccgtttacggtaccaagacgaaaggtaaaacgtaggaccaacggtacccctaaccgtaaaccttcccgtagttaacgtttaccggtcggggtacctttaccggtacccccggggntaaaccgggtttccccgggggtttaacctaaacccggtattttaccgaaggttccgggacgtaacggggtcggggttaccctacggggtaaccccgttaattttccggaacccttcccgtaaccgtaaaccctaacttaccggaacgacccgtaacgtcccgttacggcccgtaacggcgttacggaaaaggtcgttacgggtagtaccggtttaacgttttaacggttaccgtttcgtaccgtaacgtaaccttaaacgtttaacgtttacctttaaccctttacgtttacccgttaccgtttacccggtttacggggtaacccgggtaacgggtacccgtaaaggggttcggaagtaaaccgtaaccgtaaacggtgtacgggttcgactgaccgtacgtacttaccgttcgtcctttccgtaccg

SEQ ID NO: 64558 - DNA, 748 bp, Homo sapiens
  misc_feature: GYAE6OF01B30DR.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagactccctggctgtgtctcgtgggcgaggacggccaccatacaactgaccaagtccacgccagtagttgttttattcggaccccaacaaataactaaccttacttagtcgttacggtaaccagcaagaaaggtacggaaccacgaccctacctaaacctcctagtactttacgtcgggtccttaccgaccccgggctaccggttacccggggttaccctaaccgtattacgtacgtttcggcgtacgggccggggttcgtacggggtaacccgtactttccgaacttccgtaccaacctagtccgtaagccgtacgccgtagaccgtaggtacgtaggaacgtagtacggtaggtacgtttaggtttacttaccgtaggtccaacgtactaaacgttactttaaccgtttacccttttacggtttccttacgttaccgggtttaccggggtaacgggaaccggtaccggtaaagggtacggtaacgtaaacggtacccgtaaaaacgggttgtacgggtcgggacctacggacccgtacctacgttacccttgtttaccccgtgttaacccccgg

SEQ ID NO: 64559 - DNA, 711 bp, Homo sapiens
  misc_feature: GYAE6OF01EAEPM.31.78.H01.1.454.CMB.1.raw
  modified_base (471)..(471): a, c, t, g, unknown or other
  misc_feature (471)..(471): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagtacctccctggtctgtgtctcgtgggcgaggacgggccacatcaacgtgacaagtccagccagtacgttgtttttacttccggacccctaacaaactaacctaacttacttacgtcttacggtaccagacaaggaaagtacggaccacgtaccctaaccttaaactccgtagtaacttttacggcgggtacctttcccggtacccgggtctaccggttaccggggtttaccctaacggtacttccagttcggcgtacgggtccgggtcgtcgggtaccgtactttccaacgtttccnccgtaacagtacgacgtcacggtcctagacgtagtacgtaagaagacgttggtacggtacttagttttataacctcggtacaagtactaaacttactttacttaacctttcgtttcgtaccgtttaccggttcgggaacgtacgggtaaccgaagggtcgtaagtaacctaccgaaaaccggttacgcgggtaccgtacgacgtacccgaacttacgttcgttcgttacctcgttacccg

SEQ ID NO: 64560 - DNA, 1016 bp, Homo sapiens
  misc_feature: GYAE6OF01E1X0J.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctcgtggattctcgtggtcgccgtacgggacagtcgtgagtgacgcctagtttccagtacctcccgtggctgtcgtctcgtgggcgaggacggccacatacaactgacacgtccagaccgaggttacgtttgttttacgttccggaccccctaaactaaacttaaaccgtaaccttacgttacggtccgttacggtaacccaggaacgtaaaggtaaaacggtaacggaacctaaccggtacccctttaaacccgtaaaaccgttccgttaagggtttaaccgttttaccgggtccggggtttaccctttacccgggtaaccccgggtacgttaacccggggtttaccccggggtttaaaccccttaaaccggttactttacccgtaacggtttcgggaccgtaacgggggttcccgggttaccggttaaccggggtacccgtttaacgtttcccctaacgttccccgtaaccctaaccgttaacgtaccgaacggtacccgtaccgtcccggttacggaccgtaacgggtacgttaaaggtaaacggtcgtttcggggtaaccgttacgttttaacgggtttttaacctccggtttacggttaaccgacgttaaacctttaaacgttaacgtttttacccgtttacggttttacccgttttacgggtttaacccggtttaaccgggggtttaccgggggaaccggggtaaaccgggaaccgggtttaagggggttaaccggtaaaccgttaaaaacggttaaaccccggggttaaaacgggtttacccgggttcggggtaaacccgggttcccgtaaacggtttaaacccccttaaccggtttaccggtttttaacccgtttccggtttaaccttcccggtttaaccccccg

SEQ ID NO: 64561 - DNA, 1062 bp, Homo sapiens
  misc_feature: GYAE6OF01EZA62.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtcgccgtacggggacatcgtgatgagcctagttccagacctccctggctgtgtctcgtgggcgaggacgggccaaccagtacctaactgactaacgtccaagccgtaagtacgtttagtttttaacgttcccggacccccaaacctaaaacttaaactaaaccgttaacgtttaacggtaccgtttacggtaacccgaaaggtaaccgaaaaggaaaacgggttaaccggaaccgtaacgtaccccgttaaacccttaaaaccgtcccgttaacggttaacgtttttaccggtcggggttacccctttaccggttaaccccgggtacttaacccgggtttaccccggggtttaaccccttaaacccggtaatttaccgaacgtttcggaccgtaaggggtcccggggttaccgttacggggtaaaccgttaccgtttttaccgaaccgtttacccgtaaccgtaaacccgttaacgtaaccgaaccggtaaccggttaaccgtcccccgttaggaacccggtaacggggttaacccggtaaagggttaaaaccgggtacggtttaacgggtacgggtttaacccgtttaaagggttttttttaaaccgtttaaccggtttacggttaaacccgaaacgttaaacccccgttaaaaagttttaccgttttaaaacgtttttacccctttttacgtttttaacccccggttaccgggttttaaaccgggtttttccccgggggaaaacgggggttaaacgggtaaaaccccggttaaagggggtttaacggggaaaccttaaacggttaaaacccgggttaaaaaccggtaaacggtttcggttaaacggggaccctttacggtaaaccccgtaaacgtttacccgtttaaggttttacccgtttaaccgttccccgtttaaacccg

SEQ ID NO: 64562 - DNA, 667 bp, Homo sapiens
  misc_feature: GYAE6OF01AKFKU.31.78.H01.1.454.CMB.1.raw
  modified_base (353)..(353): a, c, t, g, unknown or other
  misc_feature (353)..(353): n is a, c, g, or t
tcagcagtagacgtcacgaccggtgctcgatttagtgtgagtagtttgggtttgggggagctacaacaggcaggcagggggcagcaagatggtgttgcagacccaggtcttcatttctctgttgctctggatctctggtgcctacggggacatcgtgatgagccagtttccagactccctggctgtgtctcgtgggcgaggagggcccaccatcaactgcaagtccagccagagttgttttatttcggccccaacaataacaactacttagcttggtaccagcagaaagtaggacagcctacctaaactccttattacgtcggcttcgaccggcacgtccgggttcctaacgnttcattcggcaggtcgggtctgggacctagtttcactctacaccatccagcacgcctgacgaggtctagtaacgagtcgggtgtacgttaagttttacttaacgtcgtacgacgtacctaaacttactttaacttccgttttaccgttttcgtaccgttacgttttaccggggacggggtaaccgggttaccggaaagggttggaaacggtacgttaaacccggaaaacggttaaccggtgggttacggtacccgtacggtaccctaacccggttacttaccgttaggttccctttaccgtaccgttaccccgg

SEQ ID NO: 64563 - DNA, 981 bp, Homo sapiens
  misc_feature: GYAE6OF01AY96D.31.78.H01.1.454.CMB.1.raw
  modified_base (93)..(93): a, c, t, g, unknown or other
  misc_feature (93)..(93): n is a, c, g, or t
tcagcagtagacgtcacgaccggtgctcgatttagtgtgagtagtttgggtttgggggagctacaacaggcaggcaggggcagcaagatggtnttgcagaccaggtcttcatttctctgttgctctaggatctcgtggtcgccgtacggggacatcgtgatggagtcctacgtttccagtacctcccgtggcttggtctctcgtcgggcgaggacggcccaacctactaccgtaactggacctaaacgtccgacgtacctaagtacggttttcttttacggttccggaaccccctaaacgtaaaacttaacaaaccttacgttacggttacctttaccgggacctaaggaacgaaggtaaaacggtacggaccgtaacgtcccttaaccttaaaccgtccgttaagttaccgttttaacggccggttacctttcccggtaaccccgggtacgtaccggggtttacccccgggttaaccttaaaccgggtacctttacggtacgtttaccgggaccgtacggggtcccggggtttacgacgggggtaaccccttacggttttaccactttacgacccgtaacccgtatccggaacgtccgtacgtccgtacggtaccgaacggtaccggttagaacggtacggttacggttaccggtaaccgttttaggtttaaccgtttacgtacggtaccgtaaacgttaacccggttaaaaccttttacggttttaacctttttacccggttttaccccggttttaaccgggttaccccggttttaaaccggggtttacccgggggaccggggttaaaccggttacccgggttaaaaggggtacccggtttaaacgaaaccggttttaaaccccgtaaaacggttccggggttaacgggggttcccacccggggttaaacctttccccggtaaacttttacccggttaccgtttaaccggttttcccctaaacggtttttaacccccgg

SEQ ID NO: 64564 - DNA, 758 bp, Homo sapiens
  misc_feature: GYAE6OF01E2B69.31.78.H01.1.454.CMB.1.raw
  modified_base (186)..(186): a, c, t, g, unknown or other
  misc_feature (186)..(186): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacgggacatcgtgatgagccagtttccagacctccctggctgtntctcgtgggcgagcgggcccaccgataccaactgccaacgtccagccagtacgttgttttacgttcggacccccaaccaataaccaacttactagtcttggtacccagacctaaggaaaggtacgacacgcctaccgtaaactctagtaactttacgtgggtccttaccggtacccggactacgttacccggggttaccctaaaccggtacttccgtaggttcggccgtagggtcccggggttcgtacgggggtaaccctactttccgacgtttacctaccaacccgtactaccgaacggaccgtaacgcccttacggacgtaacggtaccgttaggaaacgttagtcggtcggtacttaacgttttaacgtacttcggttacccagtaaccctaagtacttttaaccgttactttaaccgtttccgtacgttaaccggtttcggggaccggaacgggtaaccgtaacggggttaggaaacgtaaccgtaacccggtaaaacgtaccggttacggtcgccgttaccaccccgtaaacctacgttaccgttacgttacccttaccggttaccg

SEQ ID NO: 64565 - DNA, 804 bp, Homo sapiens
  misc_feature: GYAE6OF01BZEWK.31.78.H01.1.454.CMB.1.raw
  modified_base (227)..(227): a, c, t, g, unknown or other
  misc_feature (227)..(227): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctcgtggtcgccggtacggggactatcgtgatggacgcctagtttcccagtacctcccgtggcttgtcgtctcgtcgggacgaggacggaccaacntacaacgtgacaacgtccagaccgagtagttagttttacgttccggaccccaaacgtaaacttaaacctaaaccttaacgtttaacggtacgttacggtaaccgaagtaacgaaacggtaaaacggttaacggaacctaaccggtaccccttaaccgtaaaaccgttccgttaagtaacgttttaccggtacggggttacctttacccggtaacccgggacttaaccggtacccggggttaacctaaaccggtattacgaacggtttacgacggtacgggtacgggtacggttacgggaacccgttattaccgtaacctacgtacaacctacgtacaacgtactaccgtccgtagtaccggtaggtacgttaaggaactaggttacgggtacggttattaaacggttttacgtacggttaccgaagtaaccgaacgttaaattaacgtttaacgttacctttacggttaccgtacgttaccggtttcgggacgggtaacggacggtaaaggcgtaaacgagtaaacgaaacggtagtggtacagtacgacctagtactattacgtctaacgtacccg

SEQ ID NO: 64566 - DNA, 901 bp, Homo sapiens
  misc_feature: GYAE6OF01BARUL.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctcgtggtgccgtacgggacagtcgtgagtgagcctagtttccagacctcccgtggtcctgtgtctcgtggcgaggcggccacatacaactgacaacgtccagaccagttagttgtttttacgttacggaccccctaactaataaacctaacgttaccttaaggtccgttacggtaaccacggtactaaagggtaaacggttaacggtaacctaccgttacccttaaccccgttaaaacgttcccgttacgttaaccttttaccggtaccggggttaccccttttacccgggtaaccccggggtccgtttaaaccggtttcccccgggggtttaaccctaaaccccggtttatttacccgtaggtttaccgggcccgtaaggggttcccgggggtttacccgacgggggtaaccccttaacgttttccgtaaccccgttacttaccccggaactaccgtacccgacggttaccgaccgtacccgttaggtaccggtacggggtaccttaaacggaacggttaagttaggggttaccgtacgtttaacgttttaaaccgttacgttacggtaccgtacgttaacgttaaaccttaacgtttaaacgtttacctttacggtttacccggttacctttaaccgggtttacgggacccgggtaaccgggtaacctaggggtaaccgtaaggtaacccgttaacgaaaccgtttacggcgggttacccgtcggtcccaccgttaaaccgtcttaccgtcccttccgttgtacccg

SEQ ID NO: 64567 - DNA, 878 bp, Homo sapiens
  misc_feature: GYAE6OF01A40O7.31.78.H01.1.454.CMB.1.raw
  modified_base (829)..(829): a, c, t, g, unknown or other
  misc_feature (829)..(829): n is a, c, g, or t
tcagcagtagacgtcacgaccggtgctcgatttagtgtgagtagtttgggtttgggggagctacaacaggcaggcaggggcagcaagatggtgttgcagacccaggtcttctatttctctgttgctcgtggatctcgtggtgccgtacggggacagttcgtgagtgacgcctagttccagacctccgtggcgtgtcgtctcgtagggcgtaggcggccacgatacgaacgtgacgtaacgtccgagccgtaaggttaggttttacgtttttacggttcccggaacccctaaacctaaacttaaaaccgtaacctttacgttaacggtccgtttaacgggtaaccaacggtacgtaaaggtaaaacggttacggaacctaaccggtaccccttaaaccggtttaaacctacccgttaggtttaaccgttttaccgggtacgggttacccgtttaccgggtaacccgggtacgtaacggggtttaccccggggttaaccctaaaccggttatttaccggtagtttccggggaaccggtcggggttaccggggttaccgtacgggggtaaccctttacgtttacccggtacctttaccgaacccgtaaccttaaacggtcctaacgggtacccgaccggttacccgtacgggaccggtacggtaccggtaaggtaacggttacgttacgggtacgtaccgttaacgtttacgttacggtcgtaaccgcgtaacgtaacgttaacttttgttacctttaacttccggttaaccgttcggttacgggacgggtacggtaaccggtagggtcgaacgtaccgtacgtaaacggtnttaggccgtcgactccggtactacgttcgttacttccgtcgttaacccg

SEQ ID NO: 64568 - DNA, 762 bp, Homo sapiens
  misc_feature: GYAE6OF01A6004.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgaggagggccaccatcaactgcaagtccagccagagttgttttattcggccccacaataacaactactagcttgtaccagcaagaagtaggacacgccctacctaaacctcctagtactttacgtcgggtaccttaccgtaccccgggctacggttccccgggggtttaccctaaccggtactttccgaacgtttcggaccgtacgggtccggggttaccgtacgggggtaaccccgttatttttacccgaccttacctacccgtaaccctaacgttccaacggtccgaacgtcccgtaggaccgaacgggtaccctagggaaacggtagttcgggtaggtaccgttaaggtttttaacttacgttcgtaccaaggtacctaaacgttactttacgttaccttttccgtttacgttaccttaccggtttccgggaccgggtaacgggtaaccggtaagggttcgggtaaacgtaacgttaacccggaaaaccgtaacgttcgggttacggcccgttacggtaccctaaacccgttacgttaccttccggttacctttccgtaccccg

SEQ ID NO: 64569 - DNA, 839 bp, Homo sapiens
  misc_feature: GYAE6OF01B13VZ.31.78.H01.1.454.CMB.1.raw
tcagcagtagacgtcacgaccggtgctcgatttagtgtgagtagtttgggtttggggagctacaacaggcaggcaggggcagcaagatggtgttgcagacccaggtcttcatttctctgttgctctggatctctggtcgccgtacggggacagtcgtgatgacgcctagtttccagtacctccctggctgtcgtctcgtgggcgaggacggccaccatacaactgacaagtccagccagtagtttgttttacgtccggaccccaacctaataacctaaccgttacttagtccgtttacggtaacctacgacgaaacggtaaacggtacggacctaccgtacccttaaccccttaaacttccgttacgtaacgttttacggtacgggtacctttacccgggaaccccgggtactacccgggtttacccgggttaaacccctaaaccggtactttacgacggtttaccggacgtacgggtccggggttaccggtacggggtaaccccgtttctttaccgacccgtttcctacccgtaccgtacgtccgaacgacccgacgtccgtaccggaccgtacgggtacgtaacgtaacgtacgttagggtaccggttactttaacggttttacttaaccgtggttaacccgtaagtacccttaacgttaacttttaacgttacccgttttaccgtttacccggttaccgttaacccgggttttccggggaaccggggtaaccggtaccggttaaacgggtcgtaaacggacccgttaaacgtaaaccggttaacgttacggtcgtacgtaaccgcgtacctacgttacttcgttaccttccgtccg

SEQ ID NO: 64570 - DNA, 668 bp, Homo sapiens
  misc_feature: GYAE6OF01EKERF.31.78.H01.1.454.CMB.1.raw
  modified_base (647)..(647): a, c, t, g, unknown or other
  misc_feature (647)..(647): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagttccagacctccctggctggtgtctcgtgggcgagacgggcccaccatcaacgtgaccaagtccacgccagtagttgttttacgttcggaccccacaaataacaactactagtcttacggtaaccagacaaaggaaacgtacggacacgtccctaacctaaactcctagtactttacgtcggtaccttccggacccgggctacggttcccgggttacctaaccgtattcagttcggctacggggtcggtcgtcgggtaccgtatttcacgttcctccaacagttccgacgacgtaggccctggactaggtcgtagaacggtatggtagtattagtttacttacgtgtactacgaactaactaattacttaccttcgtttcgtaccgttaccggtttccgggacgggtacgggtaaccggtaaggtacgggtactaacgtaaacggtaaccgtagtcggtcgtacctacgtaccaaccgtnttaccgtcgttcgtcctaccg

SEQ ID NO: 64571 - DNA, 651 bp, Homo sapiens
  misc_feature: GYAE6OF01DA8ST.31.78.H01.1.454.CMB.1.raw
  modified_base (491)..(491): a, c, t, g, unknown or other
  misc_feature (491)..(491): n is a, c, g, or t
  modified_base (500)..(500): a, c, t, g, unknown or other
  misc_feature (500)..(500): n is a, c, g, or t
  modified_base (513)..(513): a, c, t, g, unknown or other
  misc_feature (513)..(513): n is a, c, g, or t
  modified_base (523)..(523): a, c, t, g, unknown or other
  misc_feature (523)..(523): n is a, c, g, or t
  modified_base (542)..(542): a, c, t, g, unknown or other
  misc_feature (542)..(542): n is a, c, g, or t
  modified_base (547)..(547): a, c, t, g, unknown or other
  misc_feature (547)..(547): n is a, c, g, or t
  modified_base (633)..(633): a, c, t, g, unknown or other
  misc_feature (633)..(633): n is a, c, g, or t
tcagcagtagacgtcacgaccggtgctcgatttagtgtgagtagtttggggtttgggggagctacaacaggcaggcaggggcagcaagatggtgttgcagacccaggtcttctatttctctgttgctctggatctcgtggtcgccgtacggggacatcgtgatggagcctagtttccaagtcctcccgtggtctggtcgtctcggtgggacggacggacgggccactatcaacgtcgacaacggtccaggtaccgtaaggtacggtttacgtttttaacgtcccggaaccccctaaactaaaactaaccgtaaactttaacgttacggtccgttacggaaccagtacgtaaaggaaacggtacgactacgtaccctaaccgtaactcgtatacttacgtcggtaccttcgaccggcgtacgttaccgggttacctacgtactacgtggtacgcgtacggcggtcggtacggtactcttacactcctacacnctactagcncggtcctgaccgngacttagagngtggtcgattacgtattcncgtanctacaattactgtctttccgattcgtccggtggcgagtaacgtaggtcaagtacgaagtacgtagtcgtgccgtagtacacgtacnggttactccgtatacccg

SEQ ID NO: 64572 - DNA, 790 bp, Homo sapiens
  misc_feature: GYAE6OF01CHBHV.31.78.H01.1.454.CMB.1.raw
  modified_base (586)..(586): a, c, t, g, unknown or other
  misc_feature (586)..(586): n is a, c, g, or t
  modified_base (759)..(759): a, c, t, g, unknown or other
  misc_feature (759)..(759): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctcgtggtcgccgtacggggacagtcgtagagtcgagcctagttccagtcctcccgtggctgtcgtctcggtcgggacgacggacgggaccaactactacaacgtgaacgtaacgtaccgacgacctaaggtagtttaggttttaacgttaccggaaccccctaaacaaaacttaaaacctaaaccttaacgtttacggtaccgttaacgggtaaacccaggaaccgaaaggtaaaacggtaacggaactaacggtaacccttaaacctaaaaccttcccgttagttaacgtttaaccggtcgggtaccgttaaccggtacccgggtacgtaaccgggtttaccccggggttaaccttaaaaccggttaacttcgtaacggttcggaccgtaacggggtccgggtacggttacggggaaccgtactttaccacgtacctacaaacgtctacgacnccgtacgtaccgtcgacggacgacgttaggaagtaggtcgtaggactttaaaggtttactagtacggtacagtaacaactagttaccttacgtttacttaccggtactacgttcgggacggtaacggacggtaaggtacgacgacttaaccgaaagtaggtcgtacgagtacncctaacgtacttacgttctacgttcgtaccg

SEQ ID NO: 64573 - DNA, 669 bp, Homo sapiens
  misc_feature: GYAE6OF01E27H1.31.78.H01.1.454.CMB.1.raw
  modified_base (378)..(378): a, c, t, g, unknown or other
  misc_feature (378)..(378): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctgatctctggtgccgtacgggacatcgtgatgacgcctagttccagacctcccgtggctgtgtctcgtgggcgagacggccaccatccaactgacaacgtccacgccagtagtttgttttattccggaccccaactaataacaacttactagcttacggaccagacaagaaagtaggacacgtccctacctaaactctagtacttacgtcggtcttccgacccggtctacgttcccgggttaccctaacgtntactacgttcggctaggtccgggtcgtacgggtaccttacgtttaccacctcctaccgaccctatccgacgaccacgtcccgtaggcgtaggtacgtagaacgtactggtacggtcttaagttttactacgtacgtcaacgtactaactactttaacgttacctttcgtttacgtacctttacggttccgggacgggtaacggtaccgtaagggtcgtaaacgaacgtaaccgaacgttacgtaggtcggtacctcgaccctactacttccttaccgttcgtccttacccg

SEQ ID NO: 64574 - DNA, 821 bp, Homo sapiens
  misc_feature: GYAE6OF01DYKIT.31.78.H01.1.454.CMB.1.raw
tcagcagtagacgtcacgaccggtgctcgatttagtgtgagtagtttgggtttggggagctacaacaggcaggcaggggcagcaagatggtgttgcacgacccaggtcttcatttctctgttgctcgtggatctcgtggtcgccgtacgggactagttcgtgagtgacgtcctacgttccacgtcctcccgtggtcttggtcgtcgtcggtcggacggaggaccggacccaacctatactaacgtacgacgtaaccgtccgaacgccgtaaggttagtttacgtttttacgtacccgaacccctaaacctaaaactaaaccgtaaccgttaacgttacgtaccgttacggtaaccgaagaacgtaaaaggtaaacggtaagaccgaccgtaacccttaaccgtaaccttcgttacgttaacgtttaccggtccggtaccgtttacccggacccggtacgttacccggtttcccggttaaccctaacgttcttacgtacgttcggaccgtacgggtccggtacgtaccggtacttacttccgtacctcctacgacctataccgacgcgtacgtcgtacgacgtacgtagtaagacgtagtcggtacgttactttaagtttaccgttacgtaccgtacgtaacgtaacttaacgtttactttaaccgtttcccgtttacgtttaccgttccgtttaacggttccgggaacggttaacggtaccgggtaagtacgaacgtaaccgtaaacgtaacggtacgttcgggtacctacggttaccgaccgttacgttaccgttcgtttacgttccgttaacgtccccg

SEQ ID NO: 64575 - DNA, 723 bp, Homo sapiens
  misc_feature: GYAE6OF01AXD1V.31.78.H01.1.454.CMB.1.raw
  modified_base (283)..(283): a, c, t, g, unknown or other
  misc_feature (283)..(283): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagacctcccgtggctgtgtctcgtgggcgaggagggccacatcaactgacagtccagccagagttgttttatccgcccaacaataacaactactagcttaggtaccacgtnaagaaagtaggacacgcctacctaaactccgtagtaatttacgtcggtccttaccggtacccgggtactacggttcccggggttaccctaaaccggtagtttaccgtacgttacggcgacggtccgggtcgttacgggtaacctgtttaccaccgtctaccctaaccgtactacgacgtaccgcgtaccgtacgacgtacgtaccggtagtaaggtagtcggtacgtacgttaacggttttacttaaccgtcggtaaccgtacggtaacaaaccgttaacgtttaaccttacgttttaccgttacgttcccgtacgggttttaccgggacggggttaacggaccgttaacggggtgtaacgtaacgtaaccgtaaaaccgtacggttacgtaccggtagccgtaccgtaacctagtaccgtttacgtccgttgtaacccg

SEQ ID NO: 64576 - DNA, 853 bp, Homo sapiens
  misc_feature: GYAE6OF01CK79N.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttctatttctctgttgctcgtggatcttcgtggtcgccgtacggggactatcgtgatgacgcctacgtttccacgacctcccgtgtctgtcgttcgtgtgggacgacggacggccaaccataccgaacgtcgacgtaaccggtaccgacgaccgtaagtttacggtttagtttttaccgttacccggacccctaaaccgtaaaacttaaacctaacctttacgtacgttaccgttacggtaaccaacgtaacggaaagtaacggtacggaaccaccgtaccccttaaccgtaaaccttccgttagttaaacgtttcggtacccggttacccgttacccggtacccgggtaccttaacccgggttccccggtttaacccgaaccgttacttccgtacgttaccggcgtaccgggtccggggttcgaccgggttaccgttacttccgtaccctctaccctaaccgactcccgaacgtcgtaccgtccgtcgaccgggacgtacgtaaacggtaacgtacgtacggttacgggttacttaacggttttactacggttacaccgtaaataccgttaaactttactttaacccttttacctttccgtttaccgtaccgtttaccgggtacggtaccgggtacggtaaccggtagggtacgtaacgtaacgtaaccgtaaacggttacgtacggtccggtaccgaccgtaacctaccgttacttacgtttacctccttaacccgttacccg

SEQ ID NO: 64577 - DNA, 751 bp, Homo sapiens
  misc_feature: GYAE6OF01E3LRG.31.78.H01.1.454.CMB.1.raw
  modified_base (390)..(390): a, c, t, g, unknown or other
  misc_feature (390)..(390): n is a, c, g, or t
  modified_base (411)..(411): a, c, t, g, unknown or other
  misc_feature (411)..(411): n is a, c, g, or t
  modified_base (421)..(421): a, c, t, g, unknown or other
  misc_feature (421)..(421): n is a, c, g, or t
tcagcagtagacgtcacgaccggtgctcgatttagtgtgagtagtttgggtttgggggagctacaacaggcaggcaggggcagcaagatggtgttgcagacccaggtcttctatttctctgttgctcgtggatcttcgtggtcgccggtacggggactagttcggtgatcgaacgtcctagtttaccaacgtaccttcccgtggccttgtcgtctacggtgggacgaggaccggccacactccaacgtgaccgtaacgtccacgccgagttacgtttgttttacgtccgaccccaaactaataactaacttactacgtcttacgacagacaagaacgtcgaactacgtaccctacctaacgtctagtacgttacgcggtcctcgaccgtntaaccggttccggtactaacnttcgatcggntaggcggttacgacggtaccttcttcaccgttcctaccgacagttaccgactaccgacgtcgtacggccgtaacgtaccgttaaggaagttccggtagggttacgtaacgtttaattttacgtttacgtaccgtaacgtacctaaaccgtaacttttaacttttacgtttacccttttacggtttaccgttaccgtttaaccgggtaccgggttaacgggacgggttaaacgtagggttaacgtaaagaaacccttaacgggaaaacgttggtacggtacgttaccgtaccgtaacgtcctagtttccaccgttttaacgcctttacccg

SEQ ID NO: 64578 - DNA, 696 bp, Homo sapiens
  misc_feature: GYAE6OF01BEPP0.31.78.H01.1.454.CMB.1.raw
  modified_base (413)..(413): a, c, t, g, unknown or other
  misc_feature (413)..(413): n is a, c, g, or t
  modified_base (575)..(575): a, c, t, g, unknown or other
  misc_feature (575)..(575): n is a, c, g, or t
tcagcagtagacgtcacgaccggtgctcgatttagtgtgagtagtttggggtttgggggagctacaacaggcaggcaggggcagcaagatggtgttgcagacccaggtcttcatttctctgttgctctggatctctggtcgccgtacggggacatcgtgatgacgcctagtttccagacctcccgtggctgtgtctcgtgggcgaggacggccacatcaactgacaacgtccacgccagtagttgttttacgttccggacccccaacaaactaaaccaacttacgttacgtccgttaggtaccagacaaaggtaaaggtacggacacgtccctaacctaaacctccttagtactttacggcggtaccttaccggacccgggtctaccggttcccggggttaacctaaaccgtnttaccgaggttacggccgtacgggtccggggttacgtacggggtaacccttatttccgacctcctaccgaacctactaccgacgtcctacgtcctacgacggtagtacgtaagaacgtgtggtacgtactttaagtttactcgtcgtacaacgtacctaatnttaacctttcctttcgttaccgtacgttacggttaccgggacgggacgtaacggtagggtacgtagtaactaacggaacgtacgttggcgtactacgactactctcgtcttcctacgtacc

SEQ ID NO: 64579 - DNA, 785 bp, Homo sapiens
  misc_feature: GYAE6OF01AQKSB.31.78.H01.1.454.CMB.1.raw
  modified_base (758)..(758): a, c, t, g, unknown or other
  misc_feature (758)..(758): n is a, c, g, or t
tcagcagtagacgtcacgaccggtgctcgatttagtgtgagtagtttgggtttgggggatctacaacaggcaggcagggggcagcaagatggtgttgcagacccaggtcttcatttctctgttgctctggatctctggtgccgtacggggacatcgtgagtgacgcctagtttccagacctcctggtctggtgtctcgtgggcgaggacggccaccatacaactcgacaacgtccacgcctaagtgtttcgtttttagttaccggacccctaaacaaacttaaccaaacttacttacggtccttacggtaccaggacgaaagtaaaaggtacggaactacggtaccctaccttaacctccttagtacgtttaccgtcgggtaccttcccggtacccgggcttaccgggttacccgggttacctaaccgtattacgtacggtcggacgacgggtccgggttcggtacggtaccgttacttccaaccgtcctacgacctacgtactacggacctacggccgtacggaccgacgggtacctaaaggtaacggtagttacgggtacggtacctttaaaggtttttaacgttaccgtctaaccgacttaactaaacgtttactttaacttttacccgtttcgtttacccgttacgttaccgggtttaccggggacgggtaaccggtaacggttaagggtaggtaaacgtaaacgtaacccgtaaaggttaacggttcgggtcgtaccgtagacccgttaaccncgttactacgttccgttcttaaccccg

SEQ ID NO: 64580 - DNA, 622 bp, Homo sapiens
  misc_feature: GYAE6OF01DQDLM.31.78.H01.1.454.CMB.1.raw
  modified_base (430)..(430): a, c, t, g, unknown or other
  misc_feature (430)..(430): n is a, c, g, or t
  modified_base (438)..(438): a, c, t, g, unknown or other
  misc_feature (438)..(438): n is a, c, g, or t
  modified_base (454)..(454): a, c, t, g, unknown or other
  misc_feature (454)..(454): n is a, c, g, or t
  modified_base (459)..(459): a, c, t, g, unknown or other
  misc_feature (459)..(459): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctatttccagactccctggctgtgtctcgtgggcgagcgggccaccatcaacgtgacaacgtccagccagtagtttgttttacttcggaccccaactaataacctaacttacttagtcttacggtaccagacgaagaaagtacggacacgtaccctacctaaactcctagtactttacgtcgggtccttccggacccggtctacgttcccggggttactaaccgtattcagttggcgaggtcggcgtcgggactattcacgtcacacntcagcganctgacgagctagaagngtcgngtacgttagtttacttactgtacatactaacgtatttaacttcgtttaccttcgttaccgttacggtttcgggacggtacgggtaacgtaagggtagaaacggtactaaccgtaaacgtagttgggacgtactcgactaccctattcgttctccttcgtaccg

SEQ ID NO: 64581 - DNA, 752 bp, Homo sapiens
  misc_feature: GYAE6OF01EVQ6Y.31.78.H01.1.454.CMB.1.raw
  modified_base (188)..(188): a, c, t, g, unknown or other
  misc_feature (188)..(188): n is a, c, g, or t
  modified_base (457)..(457): a, c, t, g, unknown or other
  misc_feature (457)..(457): n is a, c, g, or t
  modified_base (741)..(741): a, c, t, g, unknown or other
  misc_feature (741)..(741): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatggagcctagttccagactcccgtgctgtntctcgtgggcgaggacgggtccaaccagtaccaacgtgacctaacggtccacggccctaagggtagttacgtttttacgtttccgggaccccctaaacaaattaaaaccaaccgttactttagtaccgtttagggtaacccaggtacaaggaaaacgtacggacacgtcccgtaacctaaaccttcgtaggtactttcgcggggtccttaccggtacccgggctaccggttacccgggttacccaaacgtgttccaaggttcggaaccngggtccgggtcgtcggaccgttaacttccacttccgactacccgtataccgagtccaccggtccttacggcgaacggtcgtaacggaaatcgtgggtacgtagttaacgtttacgttacgtcgtacgaacgtactaaacttactttacgttaccttttaccgttccgtaccgttacggttacgggacgggtacgtaaaccgggacgggttagaaccgtaacgtaaccgtaaacgggtagttccggtacgacgtacgacccgttacaacggttcctacgtttccncggtttacccg

SEQ ID NO: 64582 - DNA, 871 bp, Homo sapiens
  misc_feature: GYAE6OF01EOLYW.31.78.H01.1.454.CMB.1.raw
tcagcagtagacgtcacgaccggtgctcgatttagtgtgagtagtttggggtttgggggagctacaacaggcaggcaggggcagcaagatggtgtgcagacccaggtcttcatttctctgttgctctggatctctggtgccgtacggggactatcgtgagtgacgcctaggtttccacgtacctccctggctgtgtctcgtgggcgaggacggccaccatacaactgacaagtccacgaccgtaaggtagtttgtttttaacgttccggacccccctaaacgtaaaacttaaaacctaaccttaaccgttaacggttaccgtttacggtaaacccgaaggaaccgaaaagaaaaacgggttaacggaacctaaccggtacccttaacccgttaaaaaccttcccgttaaggttaacgttttaacgtcgggttacccttacccgggttaacccgggaccgttaaccgggtttaccccggggttaaaccccgttaaaccgtacgtttaccgtaaaggtttccggacggtaacgggttccgggggttaccgtacggggtaacccgttacttttaccgaccgttttcccgaacctaaccgtaacgttacgaaccggtacgtaaccggtcccgttaggaccggtacggaccgttaaggaaacggtaaggttacgggtacggtacgtttaaacgttttaacgttagtcgtaacgtacgaacttaaacgttaacttacgtttaccgtttctttacgtacccgttacggtttcgggaaccggttacggaacggtaacggtaggtaactaaccgttaaacgaaacggtagtggtcggtacctacgaccgtaaacgttcttacgttcgtaccttcgtaccg

SEQ ID NO: 64583 - DNA, 741 bp, Homo sapiens
  misc_feature: GYAE6OF01AZ2GO.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagacctcccgtggcctggtgtctcgtgggcgaggagggcccacatcaactgcaagtccagccagtagttgttttacgtcggaccccaacaacgtaacaactacttagccttaggtaccagcaagtaaagtacggacagccctacctaaacctcctagtaactttacgtcgggtccttaccgtacccgggactacgttcccggggttaccctaaaccgtattaccagttcggcgaggtccgggtactacgggggaacccgtatttccaccgtctaccaccataccgagccacgcctacggacgtaggacgtagaaagtcggttagtcgggtacttacggttttaacttaccgtacgttcgaaacgtacgtaaacttacgttttaacctttaacgtttccgtttaccgttaccgttaccggtttccggggtaacgggtaacgggtaaccgtaaagggggtcggaaacggtaaccgttaaaccggtaaaacgttaccggtagggttaacccggtcttaacggtaacccctaacgttacctttccggtacttttcccgtaccgtttaaccccg

SEQ ID NO: 64584 - DNA, 715 bp, Homo sapiens
  misc_feature: GYAE6OF01EPHDP.31.78.H01.1.454.CMB.1.raw
  modified_base (209)..(209): a, c, t, g, unknown or other
  misc_feature (209)..(209): n is a, c, g, or t
  modified_base (403)..(403): a, c, t, g, unknown or other
  misc_feature (403)..(403): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctcttgttgctctggatctcgtgggtcgtccgtacggggactatcggtagatgacgcctagtttccagtaccttcccgtggctgttcgtctcgngggcgaggacggccaccataccacgtgacaacgtccagccagttagtttcgttttagtccgacccctaactaaactaacaacttacgtagtcgttacgacagacgaagaaacgtacgacctacgtcctaaccttaactcgtagtcttacgccggtccttaccgaccggctacggttcccggttaacctaacgtnttacgacgttcggcgtcgggtccgggtcgtacgggtaccttattccgacttccaccaaccgtatcgaacgtcacgtccgtagcgacggtactagtaacggtcgttggtacgtacgtttaagtttaacgttcgtacgtacgaacgtttaacctaacgtttactttaaccgtttacctttaccgtttcccgtaacgtttacgggttacgggaccggtaaagggttacgtaggggttaaccgagtaaaccgtaaccgtaaaggtaccgttggtcgaccgttacgaccctagtacttctcgttaccgttctacccg

SEQ ID NO: 64585 - DNA, 796 bp, Homo sapiens
  misc_feature: GYAE6OF01A5TK3.31.78.H01.1.454.CMB.1.raw
  modified_base (207)..(207): a, c, t, g, unknown or other
  misc_feature (207)..(207): n is a, c, g, or t
tcagcagtagacgtcacgaccggtgctcgatttagtgtgagtagtttgggtttgggggagctacaacaggcaggcagggcagccaagatggtgttgcagacccaggtcttcatttctctgttgctctggatctctggtgccgtacggggcatcgtgatgagccctagtttccagacctcccgtggtctggtgttctcgtgggcgagngggccacagtcaactgctaagtccagccagtagttgttttacttccggacccctaacaaagtaaccaacttacgttagcttggtaccagcgaaagaaagtcggaactacgtccctaaccgtaaacttccgtagtaacgttttaccgtgggtacctttaccggtaaccccggggtctaaccggttccccggggtttaccctaaaccggttatttcccgtaaggtttcggcctaacgggtccgggttacgtacgggggtacccgttatttcgaccgttcctaccgtaccgtaattccgaagttccgaacgtccgtaggacgtacggtacgttaggaaacgtacggttaggtacgggtaccgttaagggttttaacttcccggttagtacccggaaggtacctaaacgttaatttaaccgttaacgtttccggtttacgttaaccgtacggttttaccgggacgggttaacgggtaacccggtaagggtttccggaaagttaccggttaaaccgtaaaccggttaacccgtagggtccgggacgtaccgtacccgttaacgtacttaccgtttacttccggttactacccgg

SEQ ID NO: 64586 - DNA, 921 bp, Homo sapiens
  misc_feature: GYAE6OF01ERCH2.31.78.H01.1.454.CMB.1.raw
  modified_base (909)..(909): a, c, t, g, unknown or other
  misc_feature (909)..(909): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctcgtgggtcgccgtacggggacagtcgtgatgacgccgtacgtttccacgacctcccgtggtctgtgtcgtcgtgggcgaggcggcccaccataccaacgtcgaccgaacgtcccgaacgcctaaggtaggtttcgttttttacgtttccggaacccccccaaacgtaaaacttaaacctaaactttaaccgtttacgtccgtttacggtaacccgaaggtaccgaaaaggtaaaacggttaacggaaccgtaaccggtaccccttaaccccgtaaaaccgttccgttacgtttaacgtttaccggtcggggtaccctttcccggtaccccggggtacgttacccggtttaccccggggtttaaccccttaaccggttacttaccgtaagtttcggaccggtacgggtccggggttccggtaccggggtaacccggttcgttttacccacccgttaccgtacccgtaaccctacgttaccgaacggtcccgtaaccggtcccgttacggaccgtaccgggtcgtaaggtaaccggtagttcgggtacggtaccgttttaaacgtttttacttaccgttacgtaccgtaacgtaccctaatttaacgttttaacctttaccgttttaccctttcgggttaccttttacccgggtttaccgggggacgggttaaccgggtaccgggtaaaggtggtaaaccggtaacgtaaacggtaaccgttacggtacggtagggtacccttacgacccttaacgttcttaccgttccgttttaccnccggttaccccg

SEQ ID NO: 64587 - DNA, 859 bp, Homo sapiens
  misc_feature: GYAE6OF01BXVY3.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctcgtggtcgtccgtacgggacagtcgtgagtgacgccgttacgtttaccacgtaccctcccgtggtcttggttcgtcgtcggtacggggacggtaggaccgggaccccaacgtactaccaacgtcgaaccgtacggtaccacgtaccgtacggttaggttttacgttttacgttcccggacccctaaactaaactaacctaacgttacttacgtaccgttaccgaacagaacgaaaggtaaacggacgactaccgtcccttaaccgtaaaccgttccgtaagttaccgtttaccggtcgggtacccttaccgggtacccggcgttaccggttccccgggttaacctaccgttacttcgtaggtcgacggtcgggtcggtcggtaccggtacttacttccaccgttactacctaacctacgtccgacgtacgtacccgtcgacggaccgtaacggtctaaggtaaccgttggttacggttacgtaccgttttaagttccttaacggtcgtaacctacgtaacgtttaaccttaagttttacctttaccggttttcttacccgttaaccgggtttaccgggttaccgggggaaacccggttaggtaaaccggggtacggttaacgggtaacccgttaaaccgaaccggtaaacggttcggttacgtacccgggaccttaccggaccttacgttaccgtttggttaaccccttcgtaacccgttccccgg

SEQ ID NO: 64588 - DNA, 809 bp, Homo sapiens
  misc_feature: GYAE6OF01DTCS9.31.78.H01.1.454.CMB.1.raw
  modified_base (777)..(777): a, c, t, g, unknown or other
  misc_feature (777)..(777): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctcgtggtgccgtacggggacatcgtgatgacgcctagtttccagtaccttcccgtggctggtgtctcgtgggcgaggcgggccacctatacaacgtcgactaacgtccagaccgtagtagtttgtttttacgttccggaccccaacctaaactaaactaacttaacttacgtcgttacggtacctagacgaaggaaaaggtacggacacgtcccgttacctaaaccgtccttagtaacttttaccggtcggtcctttaccggtaccccggtactaccggttcccggggtttaccctaaaccggtattccgtaacggttcggacgtacgggtccgggttactacgggggtacccttactttaccgactccgttacccaccgtataccgacgccaacgtccgtacgaccggtacggtacgtaacggtaagtagttgggtaccggtacgtttaacgttttacgtacgtcgttaacgaacgtaccgtaacttactttaaccgtttaaccgtttccgttttaccgttacgttaccgggtttacccgggtaacggggtacgggttaaccgaagggttacggaaccggttaacgtaaacgtaaaacccggttacttggggttaccggaccgttaacgacccttaaaccgttnttaccggttccgtttccgttacggttaacccc

SEQ ID NO: 64589 - DNA, 851 bp, Homo sapiens
  misc_feature: GYAE6OF01DD08G.31.78.H01.1.454.CMB.1.raw
  modified_base (614)..(614): a, c, t, g, unknown or other
  misc_feature (614)..(614): n is a, c, g, or t
tcagcagtagacgtcacgaccggtgctcgatttagtgtgagtagtttgggtttgggggagctacaacgaggcaggacagggcagcaagatggtgttgcacgaccaggtcttctatttctctgttgctctgatctcgtggtcgccgtacggggacatcgtagatagacgaccgtagttccgactaccgtcccgtggtctcgttcgttcgtacggtcgggacgaggaccgggaccaacctataacctaacgtcggaacctaacggtccaacggaccgtaaggttaggttttacgtttttaccgttacccggaacccctaaactaaacttaacctaaccgttaaccgttaggtaccgttacggtacccaagacgtaaaggtaaacggtacggactaccgtacccgttaaaccttaaccgtacgttacggttaacgtttaccggtccgggtttaccctttacccgggaaccccgggttacgttaaccccggggtttaaccccgggttaaccctaaacggttacgttacgtacgttccggaacgtcgggtacgggttaccgcggggtaactttcgtacctactacctaccgacgtatccgacgtcgacgtcgcgaacgngggtactaaggtacgtaggttacggtacgttagtttaacgtttacgtacgtaacgtacgtaacgaacttaacgtttatttaacgtttaccgtttaccgtttaaccgtcgtttaaccgggttcggaaacccgggtacggtaaccggtaagggttacggaacttaaggtaaccgtaaaccggtaggtccgtagtaccgtacacgtaccctaattcgttacgtacccgtttgtaaccccg

SEQ ID NO: 64590 - DNA, 828 bp, Homo sapiens
  misc_feature: GYAE6OF01CBS4S.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgacgcctagtttccagacctcccgtggctgtgtctcgtgggcgaggacgggcccaccatacaactgacaaacgtccagaccaggtagttgtttttacgttccggacccccaacaaattaaaccaaacgttacttaacgtccgtttacggtaaccaggtaccaaggtaaaacggtaggaaccacggtcccttaacccgtaaactccgtagtaactttaacgtcgggtactttaccggaacccgggtctacgggttccccggggttaaccctaacgtaactttccgtagttcggacctagggtccggggttacgtaggggtaccctaagtttccaaccttcctacgacccctagtccgaacgtccgaccgtaccgtcggacgtaacgggacgttacggaaacgtagtacggtacggtacgtttaacggttttaagttaccgttacgttaaccgaaccggtacttaaaacccttattttaaaccgtttacccgttttaccgttttaaccgttacccgtttaaccggttttcccggggaacggggtaacggtaacccgggaacgggttacggtaaaccgtaaggtaaacccgaaaaacggttacggttacgggttacggtcgttacccggaacctaccgttaacgttcccgttacggttcccttacgtacccg

SEQ ID NO: 64591 - DNA, 660 bp, Homo sapiens
  misc_feature: GYAE6OF01ELS63.31.78.H01.1.454.CMB.1.raw
  modified_base (404)..(404): a, c, t, g, unknown or other
  misc_feature (404)..(404): n is a, c, g, or t
  modified_base (628)..(628): a, c, t, g, unknown or other
  misc_feature (628)..(628): n is a, c, g, or t
  modified_base (651)..(651): a, c, t, g, unknown or other
  misc_feature (651)..(651): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgacgcctagtttccagtacctcccgtggctgtgtctcgtgggcgaggacggccaccatcaacgtcgacaacgtccacgccagtagttgtttttacttccggaccccctaacctaaataaacctaacttaacgttacgtacgttacggtaaccaggacaaaggtaaaggtacgacacgtccctaacctaactcctagtacttacgcggtccttccgtacccggctacgttccgggtacctaacgtntctagtcgcgcgggtcggtcgtagggacctattccactcctacaccctatccgacgacctacgtccctcggaccgtaggtccgtaagaaggtcgtcggtggtaccttagtttactcgtcgtacagtaacctaatactttattacctttcttcgtaccgttcgttacgggacggtacggaacgtaagggtagaccgtaatacgtaaacgtagttcggtggtaccnggtcctacgtctgttaccgttcncgttacccg

SEQ ID NO: 64592 - DNA, 783 bp, Homo sapiens
  misc_feature: GYAE6OF01AEZWQ.31.78.H01.1.454.CMB.1.raw
  modified_base (160)..(160): a, c, t, g, unknown or other
  misc_feature (160)..(160): n is a, c, g, or t
  modified_base (230)..(230): a, c, t, g, unknown or other
  misc_feature (230)..(230): n is a, c, g, or t
  modified_base (503)..(503): a, c, t, g, unknown or other
  misc_feature (503)..(503): n is a, c, g, or t
tcagcagtagacgtcacgaccggtgctcgatttagtgtgagtagtttggggtttgggggagctacaacaggcaggcaggggcagcaagatggtgttgcagacccaggtcttcatttctctgttgctctggatctcgtggtcgccgtacggggacagtcgngatgacgcctagtttcccagcctccgtggtctgtgtctgtgggcgaggacggcccaacctacgtacaacngacaagtccagccagtgtttgttttactccgacccctaacaaactaactaacctacttacgcgttacggtaaccgagacgaaaggtaaacggacgtaccacgtacccttaaccctaaacttcctagtaactttacggcggttcccttaccggtacccgggaccgttaacccgggtcccgggttaaccctaaccgtaagttccggtagtttcgggacgtacggggccggggttacgtaccggggtaccgttacttcacccgttctacccaccgntaccggacgtccgacgtccgtcggaacgcggtacgtagacgtaggtggttaacgtacgtttaaggtttactaccgttcgtaacgaacgtaacttaagtttaactttaactttacctttccgtttaccgtaccgtttaccgggttccgggaaccgggtaacgggtaaccggtaaggggtcgtaaacgttaacggtaaacccgtaaccgggttagttccggtaggttacccctagtaacccgtactttaaccgtcgttaccgtttccgttccgttaccccgg

SEQ ID NO: 64593 - DNA, 593 bp, Homo sapiens
  misc_feature: GYAE6OF01C1ZLZ.31.78.H01.1.454.CMB.1.raw
  modified_base (210)..(210): a, c, t, g, unknown or other
  misc_feature (210)..(210): n is a, c, g, or t
  modified_base (359)..(359): a, c, t, g, unknown or other
  misc_feature (359)..(359): n is a, c, g, or t
  modified_base (405)..(405): a, c, t, g, unknown or other
  misc_feature (405)..(405): n is a, c, g, or t
tcagcagtagacgtcacgaccggtgctcgatttagtgtgagtagtttggggtttgggggagctaacaacaggcaggcaggggcagcaagatggtgttgcagaacccgaggtcttcatttcctctgttcgctctaggatctctggtgcctacggggacatccgtgatgacgcctagtttccagacctccctggctgtgtctcgtggcgagngggccaacagtcaactgcaagtccagccagtagtttagttttatcggaccccaactaaataacaactacttagcttacggaccaagacgaagaaagtaggacacgaccttacctaaacctctagtaattacgtcggtcttacgaccggntacgtccgggtacctaacgatcagtgacaggcggtcgtcgggactntcactctacaccatcagcacgtcctgacgagtacgtacgaaagtgtgtacgtacttagtttactagcgtacaagactaaatatttaacttacttctttacgtacgtacgttcggacggaggtaaccgaggtacggataactacgtaaacgtgtcggtcgcgtgacctcagttctgtcttacgtacccg

SEQ ID NO: 64594 - DNA, 908 bp, Homo sapiens
  misc_feature: GYAE6OF01C7ZYQ.31.78.H01.1.454.CMB.1.raw
tcagcagtagacgtcacgaccggtgctcgatttagtgtgagtagtttgggtttgggggagctacaacaggcaggcaggggcagcaagatggtgtgcagacccaggtcttcatttctctgttgctctggatctgtggtagccgtacgggacatcgtgatgacgcctagtttccagacctccgtggctgtgtctcgtgggacgaggacggccaactagtacaacgtgacgtaacgtcgacgccaaggttagttttcgttttacgtccccgggaaccctaaacctaaaagttaaacctaaaccgttacttacggtccgttaacggtaaccacgtaacgaaggtaaaggtcgaacgtacgtacccttaccgtaaactcgttagtacgttacgtggtccttaccgaccggtataccggtccgggttaacctaacgtctactaggtcggacgtacgggtcggtcgtacgggtacctacgtttccgacgttacacctaaccgtagtaccgtaacgacgtacggtacccgttaggaccggtacggtaccgttaacgggtaaacgttacggtacgggtttacggtaacgttttaaacggttttaacgtttaaccggttaccgtaaccgttaaacggtaacccgttaaactttaaacggtttttaacccgtttaaccgtttttaccggtttaacccgggtttaaccggttttaacccggggttttaccggggaaacggggtttaaccggggttaaacccggttaaaggggttaacggtaaaccggttaaacgggttaaaacccggtaaaaccgggtaaccggttaaacgggttcccggtaaacccgggttacggtaacccgttcccggttaaaacgtttcccgtttaaccgggtttaccttaacccgtttaaccccgg

SEQ ID NO: 64595 - DNA, 839 bp, Homo sapiens
  misc_feature: GYAE6OF01CJZ63.31.78.H01.1.454.CMB.1.raw
tcagcagtagacgtcacgaccggtgctcgatttagtgtgagtagtttgggtttgggggagctacaacaggcaggcaggggcagcaagatggtgttgcaaacccaggtcttcatttctctgttgctctggatctcgtggtgccgtacgggacatcgtgagtgagcctagtttccagtacctccgtgctgtcgtcttcgtgggcgaggacggccactactactaacgtgactaacgtccgacgccaaggtagtttcgttttaacgttccggacccccaaaccgtaaactaaacctaaaccttaacgttacgtaccgtttacggaaccaacgacaaaggtaaaacggtaacggaacctaccggtaacccctaaccttaaaacccgttccgttaacgtttaccgttttaaccggtcgggtacccgtttacccggttaacccgggtaccttaccgggttaccccgggtttaacccttaaccggtacgttaccgtgttggaccgtagggtcggttcgtacggtacttacttacgaccttccgtaccaacgccttacacgaccgtacgtaccgtgacccggtagtacgtagtaagtcgttagacgttacgtttaagtttacgtaccgtagcgtaaacgtacgttaacgtttactttaacgttacgtttttcccgtaaccggtttctttaacccgggtaccgggtaacggtaacccgggtaaccgttaacggggtacggtaaaccgtacttaaaaccggggtaaaacctcgggtttaagggtccgccgtaacgtccctaaacgggttcttacctacggtttccttaacccgtccccgtttaacccgg

SEQ ID NO: 64596 - DNA, 971 bp, Homo sapiens
  misc_feature: GYAE6OF01B2ZAP.31.78.H01.1.454.CMB.1.raw
tcagcagtagacgtcacgaccggtgctcgatttagtgtgagtagtttgggtttgggggagctacaacaggcaggcaggggcagcaagatggtgttgcacgacccaggtcttctatttctctgttgctcgtggtatcgtctggtcgtccgtacgggacagttcgtgatgacgcctacgtttccacgtacctcccgtggtcttgtcgtcgtcggtcgggcgaggacggacccacctatacaacgtcgacgacgtccgacgccgtaacggttagtttagtttttaccgttcccggaacccctaacgtaaactaaccgtaaccttacgttaccgttcgttaccggtaccgacgtacgaaacggtaaaggttacggactaccgaccccttaacctaaaccgttccgttacgttacgtttacggtcgggttaccgtttacccggtaccccgggtaccgttaccgggttaccccgggttacctaaccggttactttaccgaggtttcgaccgtacgggtccgggttaccggtacggggtaaacccttcgtttaccgtaaccctttaccctacccgtaacccgtgtaacccgtaaccggtacggtacccgtccggtacggtaccggtaacggtccgtaacggtaagttacgggtaccggtttacgggtaaccgttttaaagtttttccgtacgtttaccgttaacgacccgtttaacgtaaaccgtttttaacgttaacccgtttttacccgttttacccgttttaccgtttaacccgggttttaaccgggttacccgggggtacccgggtaaaccggggttaccgtaaacgggggtttacgtaaaccggtaaaaccggttaacccgggtaaaagtttacggggttacccgggttacaaacccgggggttacccaaaccgtttaacccgtggttttacccctttccgtttttaacccgttaacccgtttaccccccggg

SEQ ID NO: 64597 - DNA, 770 bp, Homo sapiens
  misc_feature: GYAE6OF01ARB4Q.31.78.H01.1.454.CMB.1.raw
  modified_base (657)..(657): a, c, t, g, unknown or other
  misc_feature (657)..(657): n is a, c, g, or t
  modified_base (731)..(731): a, c, t, g, unknown or other
  misc_feature (731)..(731): n is a, c, g, or t
tcagcagtagacgtcacgaccggtgctcgatttagtgtgagtagtttgggtttgggggagctacaacaggcaggcaggggcagcaagatggtgttgcacgacccaggtcttctatttctcttgttcgctcgtggatcctcgtggtcgccggtacgggggactatcgtgatgacgtcctacgtttccacgtacctccgtggtcttgtcgtccgtcggtcgggcggacggacggtacccactactacctaacgtcgacgtaacgtaccgacgaccgtaaggttacggttttacggttttaccgttacccggaaccccctaaactaaactaaacctaaccttacgttacgtaccgttacggtaaccacgaacgtaaaggtaacgtacggaactaccgtacccttaacctaactccgtagttaacgttacggtcggtaccgttaccggtacccggtacgttacccggtttacccgggtacctaaccgttgtaccgtacggttcggacgtcgggtacggttacggtacgggtaccttacgttacctaccctcctacgtaccgtactacgtacgacctcgtaccgtgacgttacgataagtaagtcgtacggtactacgtttagtttactcgctaacgacgtaacttaacttcgtttaccttntttaccggtcgttacggttaccgggtacggaaccggaagtcggtaaggcgtaaacgtactaaacgtacggttanggagtccacgttcgtacttcttatccgttactcccgtcg

SEQ ID NO: 64598 - DNA, 1071 bp, Homo sapiens
  misc_feature: GYAE6OF01EOSK2.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagttccagacctccctggctgtgtctcgtgggcgaggcgggccaccatcaactgactaacgtccagccgagtagttgtttttacgttcggaccccctaacgaaactaactaaaccttacgttagtaccgttacggtaaccagtaccgaaaggtaaaacggtacggaacctacggtaccccttaacccgttaaaaccgttcccgttaaggttaactttttaccggtccggggttaccctttacccgggtaacccccggggtacttaacccggtttaccccggggggttttacccttaaaacccggtactttacccgtaaggttcgggaccgtacggggtcccggggttacggtaccggggtaccccgttaacttttccgaacccgtttacccgtaccctaaccgtacgttaccgaaccggtaccgtaacggtccccgttacgggaaccgtaacgggttaccgtaaagggtaaacggtacgttacggggtaccgggttaaccgttttaaacgggttttttaaccgttttaaccggtttaccggttaacccggttaaaccggtttaaacccttaaaacggttttaaaccctttttaaaccgtttttaaaccccgttttttccccggttttttaaacccgggttttacccggtttaaacccccggggggttttttacccggggggaaacccggggggtttaaaaccccgggggtaaacccggggttaaaaaggggggtttaccggggtaaaaacgtaaaacccgggtttaaaacccgttaaaaacccgggggttaaaccggtttacgggggtaaccggggtttacccgttaccggtaacccccggttaaccgtttaacccggttttacccgggtttaccgtttttaacccggttccccttaaccccccggg

SEQ ID NO: 64599 - DNA, 968 bp, Homo sapiens
  misc_feature: GYAE6OF01D23LQ.31.78.H01.1.454.CMB.1.raw
tcagcagtagacgtcacgaccggtgctcgatttagtgtgagtagtttgggtttgggggagctacaaacaggcaggcaggggcagcaagatggtgttgcacgacccaggtcttctatttctcttgttgctctggatctcgtggtcgccgtacgggactagtcggtgaatggactccgttaacgttttccaacgtacccttccccgtggtcctttggtcgttccgtccggttaggggaccgaacgggaccgggtaacccaaccgtaacttaccgaaacgtcggaacctaacgtccaacggtaccgtaaggtttagtttttcgttttacccgttaccccggaaacccctaaaccgtaaataaaacccgtaacgtttaaccgtttaccggttaccgtttaccggtaaaccgaacggtaactaaaggtaaaacggtacggtaactacccgttaaccccttaaccttaaaccgttccttaggttaaaccgttttacggtacgggtttccctaccccgggtaccggaccggttaccgggtttaaccccgggttaacccgttaaaccgttaccgtttaccgtaaacggttcggaccggttacgggttaccgggtaccggttaacgggggtacctttaccggtttaaccctacccttcccgtaacccgttaacctacgtttacccgaacggcccgtaaccggtccttacggaccgtacgtaccgtaacgtaagggttcgttggtacggtacgtttaacgttttaacgtacgttacgtacgtacgtacttaacgttagtttaccttttaccgtttccgttaacgtttccggttaccgtacgggtaaccgggtacgggtaacggttacggtaaggtacctaaaaccgttaaccgggaaacggttcggttacggtacggttccaacccggacctttaccggacttttccccgggtttatccccggtagttttaccccccg

SEQ ID NO: 64600 - DNA, 801 bp, Homo sapiens
  misc_feature: GYAE6OF01EW8VO.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtcgccgtacgggacatcgtgatgagcctagtttccagacctcccgtggctgtgtctcgtggcgaggacggcccacatcaactgaccaagtccagccaagtagttgttttagttcggaccccctaacaaataacctaactacttagtcttacgtaccagacaaaggaagtaggaccacgtccctaactaaaccgtcttagtacgttacgtcgggtcttaccgtaacccgggctaacggttcccggggtttaccctaaaccgtctttacgacgttaggccgtagggccggggttcgacgggggtaacccttacgtttaccacgtttacctaccgtaaccctagtcccgaacgtaccgtaacgtcccgttaggaccgaacgggtctacggtaaaacggttgttacgggttacggtacgtttaaggttttaaacgtttacgttacgtaccgtaacggtaaccctaaacgttactttaacgtttaccttttacccgttttaccgtccggtttaaccgttttaccgggggaacgggtaaccggggtaaccgtaaagggttacgggtaaacgtaaccgttaaaccggaaacggttaaacgttacgggtccggtaaccggttcgaacccgtaccgtaccgtttaccgttcgttcccgttaccgttaccccgg

SEQ ID NO: 64601 - DNA, 730 bp, Homo sapiens
  misc_feature: GYAE6OF01DWCOW.31.78.H01.1.454.CMB.1.raw
  modified_base (411)..(411): a, c, t, g, unknown or other
  misc_feature (411)..(411): n is a, c, g, or t
  modified_base (591)..(591): a, c, t, g, unknown or other
  misc_feature (591)..(591): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtcgccgtacggggacagtcgtgatcgacgtcctagttccagtacctccgtggctgtgtctcgtgggcgagcggccacatacaactgacagtccagaccgaggtagtttcgttttacgtccggacccctaactaaattaaaccaacttaccgttacgtacgttacggtaacctaaggacaaaggaaacggtacggacctaccgtaccccttaacgttaacctccgttagttaaccgtttacggtccggggtaccttttaccgggaaccccgggtnttaacccgggttaccccggggtttaccctaaaccgtcgtttctaacggttggccgacgggtcccggggttacgtccgggtaaccgttaactttccacgttacctaccaacctacgtacgaacgcctacgctggaccgagtacgtagaacgtacgtggtaccgttagttagtttacacgtntacgtacgtaaccttaacgttactttacttacgtttcctacggtccttacgggttcggacgggtacgtaaccgtaggagtacgtactaacgaacgtagttacggtcgactagacctacgtacttcctcgttctcgtacc

SEQ ID NO: 64602 - DNA, 864 bp, Homo sapiens
  misc_feature: GYAE6OF01CONOO.31.78.H01.1.454.CMB.1.raw
  modified_base (603)..(603): a, c, t, g, unknown or other
  misc_feature (603)..(603): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctcgtggtgcccgtacggggacagtcgtcgatgagcctagtttccgaagacctcccgtggtcctgtcgtctcggtgggacgaggacgggcccaacctagtccaaacgtcggaactaacgtccgaagaccgaaggttagttttgtttttaacgttccccgggacccctaaacctaaaattaaacctaaaacccgtttacgttaacggtccgttttaaaccgggaacccgaacggtaccgtaaaaggggtaaaaaaggttaccgggaaccgtaaaccccgtacccccgtttaaaaccccttaaaacccgttcccgttaggttaaacctttttaaccggccccggggtttaccttttacccgggacccccgggtgttaacccgggtttaccccggggttttaaccccgaaaacgttcgttacccgtagtttcgggaccgaacggggttccggtaccgggtacggtaaacccgttnttttaaccgacctccgtaccaaacctcgtacaaccgtccgacgtccgttacgcggacgtccgtaaaggtaacgtaaggttcgtaggttacgttaacggtttttacgtaacgttcgtaacgaccgaacttaacgttaactttaccgtttaactttcgtttacccttcggtaccgtacgggtaacggacgggtaccgtaggtaccgtagacgtaacgaacgtacgtggtcgtcaggtaccacgtctaagtccttgtacttccg

SEQ ID NO: 64603 - DNA, 833 bp, Homo sapiens
  misc_feature: GYAE6OF01ERRBP.31.78.H01.1.454.CMB.1.raw
  modified_base (128)..(128): a, c, t, g, unknown or other
  misc_feature (128)..(128): n is a, c, g, or t
tcagcagtagacgtcacgaccggtgctcgatttagtgtgagtagtttgggtttgggggagctacaacaggcaggcaggggcagcaagatggtgttgcacgacccaggtcttcatttctctgttgctcnggatctcgtcggtcgccgtacgggactacgtcgtgatcgacgtccgtacgttaccacgtacctccgtggcttgtcgtcgtcgtagggacgacggacggccacactacgaactcgacaacgtccacgaccgtaaggttcgttcgttttacgtccggacccctaactaaactaactaaccttacgttacgtcgttaacggtaccaagtacgaaacggtaaacgtacggaccgtaaccgtaccccttaacctaaaccttccgttaacgttaaccttttacggtccggttacccgttaccggtacccggtacgtaccgggttacccgggttaacctaaacggtcttaccgagttacggacgtacgggtccgggtacgtacgggtaccttaacgttccacgttcctacccgtaactacgtacgaccgacgtccggtctacggacgtacgggtactaaggaacgttgtacgggtacgtttactttacggtttaactacgttcgtaacgtaacctaacgttactttaacgttttacctttacccgttttcggtaaccgtttccggttaaacggggttcccgggaacgggttaccggtaacggtacggggttaacgaaaccgttaaaccgttaacggaaacggttacgttcgggtacccgtacgttaccgaaccgttactaccgtttcgtaccctttacgtaacttcccccgg

SEQ ID NO: 64604 - DNA, 882 bp, Homo sapiens
  misc_feature: GYAE6OF01A71SD.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggactatcgtgatgacgcctagtttccagacctcctggctgtgtctcgtgggcgaggacggccacctagtcaacgtgacaacgtccacgccaaggtacgtttgtttttacgttccggacccccaactaaactaaacctaacttacgttagtccgtttacggtaacccagacctaaggaaaacgttacggaccacgtcccttaacctaaaccttccgttacgttaacgttttaccggtacggggttccctttacccggtaaccccggggtacttaacccggggtttaccccgggggtttaaccccgttaaaaccgttacgtttacgtaacggtttcgggaccggtaacgggtcccgggggttaccgttcgggggaaaccccgtttactttcccgtaaccgtttccctaaccgtaacccgtaagtacccgacggtaccctacgtccccgttaggaccgtaacgggtaccgttaaggtaacggtaggttcggttacggttaacctttaggttttaacgttacgtacgtaaccgtaacgtaccgttaaactttacgtttaaccgtttccttttaccgttttccggttaaccgttaccgtttaaccgggggaccggggtaacgggtaaccggtaagggttacggtaacgtaaccgttaaacggtaaaccggttaaggttcggtaccgggctaaccggacctaaccttacggttacctttcggttcccttcgttaaccccg

SEQ ID NO: 64605 - DNA, 693 bp, Homo sapiens
  misc_feature: GYAE6OF01DKLQL.31.78.H01.1.454.CMB.1.raw
  modified_base (205)..(205): a, c, t, g, unknown or other
  misc_feature (205)..(205): n is a, c, g, or t
  modified_base (419)..(419): a, c, t, g, unknown or other
  misc_feature (419)..(419): n is a, c, g, or t
  modified_base (608)..(608): a, c, t, g, unknown or other
  misc_feature (608)..(608): n is a, c, g, or t
  modified_base (669)..(669): a, c, t, g, unknown or other
  misc_feature (669)..(669): n is a, c, g, or t
tcagcagtagacgtcacgaccggtgctcgatttagtgtgagtagtttgggtttgggggagctaacaacaggcacggcaggggcagcaagatggtgttgcacgacccgaggtcttctattttcctctgttgcctactggatctctgggtcgccgtacggggacatcgtgatgagcctagttccagacctcctggctgtcgtctcgngggacgaacggccaacatacaactcgacacgtccagacctagttagtttgttttacttccggaccccaactaaactaaacctaacttactagtcgtttacgacctagacaaggtaaagtacggactaccgaccccttaaccgtaaacttccgtagttactttacggcggtcctccggtacccggctacggttcccgggtacctacgtacttcgngtcggcgagggtcggtcgacgggtactctttaccacgttccaccaacctgtccacgtctacgctgacgcggatagagtgtacgtgtatttagttacttcgtacgtacgacgtaactaacgttatttacgttacttttaccgtttccgttacgttacggttaccggacgggttaacggacgttagggtanaacgtaaccgtaacgtaaccggtagttggtaacgtcgtcgtaacccacgttcttacggttnttacccgtcgttacccgttccccg

SEQ ID NO: 64606 - DNA, 827 bp, Homo sapiens
  misc_feature: GYAE6OF01AE6QE.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctcgtgatctgtggtcgccgtacgggacatcgtgatgacgtcctacgtttccagtacctccgtggcttgttcggttctcggtacgggacggaacgggaccgggacccaccacgttaccaaaccgttcgacgtaaccgtccgacgtaccgtaaggttacggttttcgtttttaaccgtcccgggaaccccctaaaacgtaaaactaaacctaacccgttacgttaacggtccgttaacggtaccgaacgacgtaaaggtaaacggtacggaccaccgtacccttaaccttaacgtcctaggttaacctttaccggtcggtaccctttacccgggaccccggtacgttacccgggttccccggttaaccctaccgttacgttaccgtaggttacggccgggttacgggtcgggttacccggtacggggtaccctttaacgttccgtaccctcctaccgtaccgtactaacgtcccgacgtaccgtccgacgtcggtaacggtccgtaaggtagtacggttacggttacgttaacgtttacgtttaacggtccttaggtactaacgaccttaacttatttccttaccgttacgttcttacggtacgtccgggaggtacggtaccggtaggcgtaaacgacgtaaccgtacgtacggtgtaccgtagtaccctaacggttcctacgttctaccgttcgtcgttacccg

SEQ ID NO: 64607 - DNA, 767 bp, Homo sapiens
  misc_feature: GYAE6OF01AQMP5.31.78.H01.1.454.CMB.1.raw
  modified_base (200)..(200): a, c, t, g, unknown or other
  misc_feature (200)..(200): n is a, c, g, or t
  modified_base (373)..(373): a, c, t, g, unknown or other
  misc_feature (373)..(373): n is a, c, g, or t
  modified_base (415)..(415): a, c, t, g, unknown or other
  misc_feature (415)..(415): n is a, c, g, or t
tcagcagtagacgtcacgaccggtgctcgatttagtgtgagtagtttgggtttgggggagctacaacaggcaggcaggggcagcaagatggtgttgcagacccaggtcttcagtttctctgttgctctggtatctcgtggtcgaccgtacggggactatcgtagatgaacgtccctacggttttaccagtaccttcccgnggtccttgtcgttcgtacggtgggcgaacggacgggacccaacctaagtacctaactggtacctaaacgtccgagacccgtaggtacgttttcgttttacgtccccggacccctaaacttaaataacctaacttacttacgtcgttacgtaccaggtacaagtaagtcgaacncgtacctacgaactctagtcttacgcggtactccggtaccgntaccgtccgggttaacctagtcgttcggagtaccgtacggtcgggttacgacggtaccttacgttacgacctacgtccctaacgattcccggaacgtccctagtcctacggtcgtacggtacgtaacggtcgaacgttcggtacggtactttaacggtttacctacgtcgttacctaacgaccgttaataacgtttacgtttacttaccggttcgttacccgttacgggttacgtaccgggtaacgtacggtaagtacggtacgtacgtaacgtaacggtaaccggttgtacccggtaccgtaccgtaccgttacgttactaccgttaacctccgttcctacccgttacccg

SEQ ID NO: 64608 - DNA, 820 bp, Homo sapiens
  misc_feature: GYAE6OF01E01PX.31.78.H01.1.454.CMB.1.raw
  modified_base (587)..(587): a, c, t, g, unknown or other
  misc_feature (587)..(587): n is a, c, g, or t
  modified_base (798)..(798): a, c, t, g, unknown or other
  misc_feature (798)..(798): n is a, c, g, or t
tcagcagtagacgtcacgaccggtgctcgatttagtgtgagtagtttgggtttgggggagctacaacaggcaggcaggggcagcaagatggtgttgcagacccgaggtcttcatttctctgttgctcgtggatctcgtggtcgaccgttacggggactattcggtgagtacgacgtccttacgtttaccgagtaccttcccgtggtcttggtcgtcgtcggtgggaccggaaggaccggccaacctaacgtaccgtaaacgttaacggaaaccggttccacggaaccgtaggtaacggttttacgtttttacggttacccggaccccctaaaaccgtaaacttaaaacctaaccttaagttacgtcgtttaacggaaccacgacgtaaacgaaaggtacggaacctacgtaaccccttaacctaaaaccgtcctagttaacggttacccggtaggtacgttacccgtacccgggtaaccgtaccgggtttaccccgggttaacctaaccgttacttacgtacgttcggacggtaacggtccggttcgaccggtacgttaccgttcaaccgttcctacgaccttaacncgtacgaccgcgtacgtaccgaggtaacggtctaacggtaaagtacttagggacgttactaaggttttacctaggtacgacgtagtaacctaacgtatttaacgtacttttctaccggttactacgggtaccgaaggggaaccgaacgtagggtacgaagtaaccgaaagtaaaccggtagtcgtacggacttccgaactacgttcgtacncgtttactacgccgttaacccg

SEQ ID NO: 64609 - DNA, 718 bp, Homo sapiens
  misc_feature: GYAE6OF01DAPKO.31.78.H01.1.454.CMB.1.raw
  modified_base (201)..(201): a, c, t, g, unknown or other
  misc_feature (201)..(201): n is a, c, g, or t
  modified_base (573)..(573): a, c, t, g, unknown or other
  misc_feature (573)..(573): n is a, c, g, or t
tcagcagtagacgtcacgaccggtgctcgatttagtgtgagtagtttggggtttgggggagctacaacaggcaggcaggggcagcaagatggtgttgcacgacccaggtcttcatttctctgttgctctggatctcgtggtcgccgtacgggacatcgtgatgacgcctagttccacgacctccgtggctgtcgtctcggngggacgagggacggaccctaaccataccaacgtcgacaacgccagaccgaggtagtttagttttacgtcccggaaccccaaactaaactaaacctaacttacttacgtacgttaccggacacgacgaaaggtaaggtacggacctacgtaccccttaaccttaaacctttacctttaacgtttaccgtacgggtacccttacccgggtaacccgggtacctaccgggttaccccggggttacctaaccggtattacctaggttcggacgacgggtcgggtacgacgggtactacttccaactcctacactacacgagacctacgctacgacgacgggataggaagtagtaggtgtactttaagttacgttanctacgataactaacttacttacttccgtttcttacgtaccgtacggttcgggacggtaacggtacgaagggtagactaacgtaacgtaacggtcgtggacgcgttaccgactacgtacttacgtacttccttacgtccttacccg

SEQ ID NO: 64610 - DNA, 771 bp, Homo sapiens
  misc_feature: GYAE6OF01D2NLP.31.78.H01.1.454.CMB.1.raw
  modified_base (632)..(632): a, c, t, g, unknown or other
  misc_feature (632)..(632): n is a, c, g, or t
tcagcagtagacgtcacgaccggtgctcgatttagtgtgagtagtttgggtttgggggagctacaacaggcaggcaggggcagcaagatggtgttgcagacccaggtcttctatttctctgttgctcgtggatctcgtggtcgccgtacggggacagtcgtgatgacgcctagtttccagtacctccgtggtctgtcgtcgtcgtgggcgaggacggccacatcaacgtcgacaacgtccacgcgtagtagtttcgttttacgtccggaccctaacaaactaactaacgttacttacgtaccttacggtaaccagaacgtaaaggtaaaggtacggaacctacggtaccccttaacgttaaaccgtccgtttagttacgtttaccggtacgggttaccctttacccgggacccgggtacgttacccgggttaccccgggtttaacctaaccggttctttacgacggttcggaccggtacggggtcccggggtcggttaaccgggtaacccgtttacgtttaccctaaccgttcccgaacctaccgttacgacgaccggtaccgacgtccgtacggtacgacggtacgaaggtaacgtacggtggtacgtacgttaagtttactacgtcgtanacgtactaattacttacttacttcgttacgtccgttacggttacgggacgtacggaacgtaggtacgacgtaacgtacgtaacgtaagttcggtacgcgtaaccgacgtactacgttcttacgttacttccgttacccg

SEQ ID NO: 64611 - DNA, 825 bp, Homo sapiens
  misc_feature: GYAE6OF01C4C91.31.78.H01.1.454.CMB.1.raw
  modified_base (499)..(499): a, c, t, g, unknown or other
  misc_feature (499)..(499): n is a, c, g, or t
tcagcagtagacgtcacgaccggtgctcgatttagtgtgagtagtttgggtttgggggagctacaacaggcaggcagggggcagcaagatggtgttgcagacccaggtcttcatttctcttgttgctctggattctcgtggtcgaccgtacggggacagttcgttagactggacgccgttaacgtttccacgtacctcccgtgggtccttgtcgttcctcggtcgggcgagggtaccgggcccaacccattacaacgtcgaccgaaacgtcccaggaccctaaggtacggtttttacggtttttacgttacccggaccccctaaaactaaaactaaacctaaaccgttaacttacgtacgttacggtaccaagacgtaaaggaaacgtaggaccacgtacctaacctaactcttagtattacgcggtccttcggaccgacgtacggttcccggtacctaacgttcgtatcggacgaggtccggtactcgggtaccgttnttaccgcttaccgactacccgtatcgaaccgcgtacggtacccgacggtaccgacggtacgtaaggtaacgtaggttacggaccgggttctttaaacggtttttacgtaccgtttaggtacctaacgtaaccctttaagttaaccttttacgtttaaccttttccggttttacctaccgtttaaccgggtttcggggaacccgggttaacggacccgggtaaaggttacgaaacggttaccgtaacggtaaaccgttggttaacggtccggtaacgttacgacccgttaacttacgttcccggttaactcgtttacgtacccccgg

SEQ ID NO: 64612 - DNA, 803 bp, Homo sapiens
  misc_feature: GYAE6OF01BNH1D.31.78.H01.1.454.CMB.1.raw
  modified_base (491)..(491): a, c, t, g, unknown or other
  misc_feature (491)..(491): n is a, c, g, or t
tcagcagtagacgtcacgaccggtgctcgatttagtgtgagtagtttgggtttgggggagctacaacaggcaggcaggggcagcaagactgggtgttgcagacccaggtcttcatttctctgttgctctggatctctaggtcgccgtacggggacatcgtgatgagccgtattcatacctccgtggctgtgtcctcgtgggcaggacggcccaactagtccaacgtcgactaacgtccgaacgacctagtagtttgttttacgttccggaccccaactaaataaacctaaccttacgttacgtacgttacgtaacgaacgacaaaggtaaacgtacggactacggtacccctactaaaacccttcgtaggtaacttttcggtcggtacctttaccggtaccccgggtatacccgggttcccgggtttaccctaaaccggtgttccctaggttcggacgtagggtccgggttacgggtaccggtaaccgttntttaccgacctttccacctaaccgtagttaccgacggtaccgtaaccgtccgtacgggaccgtaggtaaccgttaggaaaacggttcgttacgggtacgttcgtttaagttttaacgttccgtactaacgtaacgtacctaaagtttactttaaccgttacgtttcgtttaccgtccgtttaccgggttacgggacgggtaaccggtaccgtaaggggtctaaacgtaccggttaaacgaccggttaaggttacggtcgttccaacggtacccttaacgtaccgttacttccgtttccgttccccgtacccg

SEQ ID NO: 64613 - DNA, 869 bp, Homo sapiens
  misc_feature: GYAE6OF01C9H0L.31.78.H01.1.454.CMB.1.raw
  modified_base (548)..(548): a, c, t, g, unknown or other
  misc_feature (548)..(548): n is a, c, g, or t
tcagcagtagacgtcacgaccggtgctcgatttagtgtgagtagtttggggtttgggggagcgtacaaacaggcaggcgaggggcagcaagatgggtgttgcgacgacccgaggttcttctattttctcttgttgctcgtggtatctcgtggtcgccgtacggggactagtcggtagtagtgaccgtccgtaagtttccgaacggtcccttcccggtgggttccgtgttcgttccgtccggtgggaccggaagggaccgggcccaacctacgtacctaacgtcgacaaccggtccacggaccaggtttacgttttgttttaccgtcccggaaccccaaactaaattaaccaacgtttacgtagtccgttacggactaacgacgaaagtaaggtaacaccgaacgtaccctacgtaactcgttacgtactttacggtcggtaccttaccggacccggtatacccgggttccggtaacccgtattacgtgtacgtcggacgtcgggtccggggttacaccggggtaactctaacctcgtctaccgtaacngtaaacccgacgtcgaccgtccgtagacccggtagacgttaagaacggtttcgtagggttacgtacgtttttaattaccgtacgtttacggaccttaaactactttaattaaaccgttttcgttaaaccgttttcccgttttaccgtccggttaacccgggttaccggggttagggaaaccggttacggggtaaaccgtacggtaaaccggtaaaacttaaaccggttaaacccggtaagggttcggttacccggtacgttaaacccaccggttaacgttccccgggtttagtttaaccccctttgtaccccgggttaccc

SEQ ID NO: 64614 - DNA, 814 bp, Homo sapiens
  misc_feature: GYAE6OF01AICRG.31.78.H01.1.454.CMB.1.raw
tcagcagtagacgtcacgaccggtgctcgatttagtgtgagtagtttgggtttgggggagctacaacaggcaggcaggggcagcaagatgggtgttgcagacccaggtcttcatttctctgttgctctggatctctggtgccgtacggggacatcgtgatgagcctagttccagtacctcccgtgctgtcgtctcgtcgggcgaggacgggccaaccgactaccaactgacaacgtccagaccgaagtagtttgttttacttccggaccccaaccaaactaacaaccttacttaacgcgtttacggtaaccagacgaacgtaaaggtacggaccacgaccccttaaccctaaaccgtccttgtaacttttacggtcgggttcctttacccggtacccgggtctaccggtttaccccggggttaaccctaaccgtacttaccgtgttacggaccgtacgggtccggggttccgtacggggtaacccgtactttcctaaccgtccctacctaaccctgtaccgacgacctaccgtacccgtagtccgacggtacgtaagaacgtcggttacggtacggtaacgtttaggtttaaccttacgtacggtacgtaccgtaacgtaacgttacttttaacctttacgtttccgtttacccgttcggttaacccggttttacgggaaccggggttacccgggtaaacggttaacgggtagtaacggtaactaaacccggtaaacggttaccggttacgggtccggtacgtacgaacccctaacggttacttaaccgtttccgttccgttacgttacccccg

SEQ ID NO: 64615 - DNA, 1063 bp, Homo sapiens
  misc_feature: GYAE6OF01ECNX7.31.78.H01.1.454.CMB.1.raw
tcagcagtagacgtcacgaccggtgctcgatttagtgtgagtagtttgggtttggggagctacaacaggcaggcgaggggcagcaagatggtgttgcagacccgaggttcttctattttcctcttgttgcttcgtggattccttcgttggtgaccgtacggggactacgttcgtagagtgacgtaccttacgtttccaacgtccttcccggtgtcgttggtcgttccgtcggtgggacggacgggaccggcccacctaacgtacctaacgtcgtaaccgtaaccgtccgaaccgtccgtaaggttagttttacgttttaccgtttccccggaaaccccctaaaactaaaaccttaaaccttaaaccgttaacccgtttacggtaccgtttaccgggtaaaacccgaaggtaaccggtaaaacggttaaacggtaaacggtacccgtaacccgtttaccccttaaaccgtttaaacccgttccggtttaacggtttaacccgttttaccggggtacccggtttaccccgtttaccccggggtaaccccgggtttaccgtaacccgggtttttacccccggggtaaacccttaaaccggttcgtttaccggtaaggtttccggcggtaccgggttccggggtaccgtaaccgggttaccgttacttttaccggaccctttacccgacccgtaaaccgttaccgtacggtaaccgacccgttacggacccgttagaaccgggttaccggtaaggttaacgtacgggtacgtttacgggtaacggtttacctttaaggttttaccgtaccgttactacggtaacttaactttaaaccgtttacgttttacgtttacccgttttcggttttaccgttaaccgtttccgggggtttaacggtacccgggtaaacgggtttaaaccggtaagggttaacctaacggtaaaaccccgggttaacgtaaacgggtttccgtaacggggtccgttacccggttaaccggttacccgttaggtttacccgtttaccccgttaaagtttcccccgtttacccgtttaacccccgg

SEQ ID NO: 64616 - DNA, 866 bp, Homo sapiens
  misc_feature: GYAE6OF01AOHTD.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctcgtggtgccgtacggggacatcggtgatgacgccagtttccagtacctccctggctgtgtctcgtggggacgaggacgggcccacatcaactgctaacgtccacgccagtacgtttgttttacgttccggacccccaactaaataaacctaaccttacgttaggtcctttacggtacctaaggaccaaaggtaaaaggtacggaaccacgtccccttaaccctaaaacccgttcgttagtacgttttaacggcgggttacccttaccggtaccccggggactaccgggttcccggggtttacccctaaccggtacttacgtaggttcgggacctaggggtcccgggttcggtacggggtacccgttactttccgacctccgttaacccaaccgtacgttacccgacgtaccgaccgtcccgttacggacccgtaaggggttacccctaagggtaaaacggttacggttacggggtacggttaacccgttttaaggttttaaaccgtttaccggttaacgttaaccgaacgttaaccgtaaaacctttacgttttaaccgttttaccttttaccgttttaccgtaccgttttacccgggtttacggggaccgggttacgggtaacccggtaagggtacggtaaaccgaacgttaacggtaaaccggttacgttagggtcgaccggttaccgaccctaccggttattcccgtttgttcccgttccgttaaccccg

SEQ ID NO: 64617 - DNA, 949 bp, Homo sapiens
  misc_feature: GYAE6OF01CPT8F.31.78.H01.1.454.CMB.1.raw
  modified_base (390)..(390): a, c, t, g, unknown or other
  misc_feature (390)..(390): n is a, c, g, or t
tcagcagtagacgtcacgaccggtgctcgatttagtgtgagtagtttggggttgggggagctacaacaggcaggcaggggcagcaagatggtgttgcagacccaggtcttcatttctctgttgctctggatctctggtcgccgtacggggacatcgtgagtcgacgacctacgtttcccagtcctcccgtggtctggtcgtcgtcgtggggacgaggacgggcccaactactaccaaacgtcgactaacgtaccacgaccgtaagttacgtttagtttttaccgtaccggaccccctaaactaaaacttaaacctaaaccgtttaacgttaacggtaccgtttacgggtaaccccaaggaaccgaaaggtaaaacggttacgggaacccncggtaaccctttaacctaaaacctccgtacgttacttttaaccgggcggttaccttcccggaacccgggtactacgggtttaccccggggtaacctaaaccggttacttcgtaacgttcgggacgacggtaaccggggtcggtccgggtaacctacgttttaccacccgttactaaacccgtcgaacgttccgaacgtcccgaccggtacctaacgggccgtaaggtcgtaacggtaaacgttagggttacgggtaaccggtattttaaacgggtttactttaccgtaccggttaacgtaacttaaccgttaaaacttacgtttttaaacgttccctttttacgggttttaacctaccccgttttaaggttacccggggggaccgggttaacccggggtaaaacggtttaaaccgggtaacgggtaaacggttaaaccccggtaaaacccgttaaaaggggttacccggtttaaagggtccccgggttaacgtaaaccccgacgttaacccgtttaacttcccccgggttttaacttccgtaacccgtttaccccccgg

SEQ ID NO: 64618 - DNA, 822 bp, Homo sapiens
  misc_feature: GYAE6OF01CKU96.31.78.H01.1.454.CMB.1.raw
  modified_base (134)..(134): a, c, t, g, unknown or other
  misc_feature (134)..(134): n is a, c, g, or t
  modified_base (157)..(157): a, c, t, g, unknown or other
  misc_feature (157)..(157): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctntggtgccgtacggggacatcgtnatgacgcctagttccagtcctccgtgctgttcgtctcgtgggcgaggacggcccaccagtcaacgtcgacaacgtccagccgtaaggtacgtttgtttttaacttcccggacccctaaacctaaaataacctaaaccgttacgtttacgtaccgtttacggtaacccaggaactaaaggaaaacggttacggaacctacgtacccttaaccgtaaacctccgttagttaacgtttaccgtcgggtcctttaccgggtacccggacttaccgggttccccgggttaacctaaaccggtcttcgtaacggttcggaccgtacggggtcgggttaccggtacggggttaacccttacgtttaccaaccttccgtaacccactaacgtccgaacgtccgtaccggacttacggccggtaacgtaccgtaggtaacggtacgttaccgggtagtaaccgtttaaggtttttaactacgtaccgtaactaacggtaacctaacgtttaactttacctttacccgttttcgtttacccgttacgggtttcgttaccggggaacggtacggtaaccggtagggtacgggtaactaaacggtaccctaaaacgggttcttcgggtcgtaccgttcggaccctactcgttaaccgttcttaccgttcgtaccccg

SEQ ID NO: 64619 - DNA, 760 bp, Homo sapiens
  misc_feature: GYAE6OF01EOGXZ.31.78.H01.1.454.CMB.1.raw
  modified_base (227)..(227): a, c, t, g, unknown or other
  misc_feature (227)..(227): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctgatctctggtgccgtacggggacagtcgtagatgacgtcctacgtttccagtacctcccgtgctgtctctcggtgggcgaggcgggccaccatacaacgngacaacgtccacgccagttacgttgttttacgttccgacccctaacaattaacctaacttacgttacgtcttaggaccaagtacaaggtaaagtacggaacaccgttacctaaccgtaaccttccgtagttacttacgggtccggtaccttccggtaccggtctacgggtttcccgggttaccctacgtacttactcggttacgcgtagggtccggtacgtacggggtaccttacttaccgacgtttaccaccgtaaccgtactacgaccgacgacgtcccgtaggacgttacggcgttaaacggagtacgtgggttacgacgtttaacgtttacttgtaacggtacctaagttaaccgtaacttacgtttaaccctttcgtttccgtttacgtaaccgttacggggttccggtaaccggggaacgttaaccgggtaggtaggaaaccgttacgaaacccgggtaaatcgggttacggtcggtaacctagaacccgttaccttacgttaccgttcgttacctcgttaaccccg

SEQ ID NO: 64620 - DNA, 813 bp, Homo sapiens
  misc_feature: GYAE6OF01EC3XR.31.78.H01.1.454.CMB.1.raw
  modified_base (442)..(442): a, c, t, g, unknown or other
  misc_feature (442)..(442): n is a, c, g, or t
tcagcagtagacgtcacgaccggtgctcgatttagtgtgagtagtttgggtttgggggagctacaacaggcaggcaggggcagcaagatggtgttgcagacccaggtcttctatttctctgttgctctggtatctcgtggtcgtccggtacggggactatcgtagatgacgtcctacgtttccacgtacctccgtggtccttgtcgtcgtcggtcgggcggagggaccggacccaacctactacctaacgtcgaccgtaacgtccgacgaccgtaggttagtttcgtttttaccgttccggaacccctaacaaacttaaactaacttacgttacgtcttacggaccagacgaagaacgtacgacaccgtacctaacctaactcgttagttacgttacggtcggtaccttccgaccggtcgtacggttcccggtacctacgtnttactggtcgacgtcgggtcgtacggtacggtacccgttattaccgacctacgtacctacacgtactacgacgtactccgtacggaccgtaggtccgtaagtacggttacgtgggtacgttaactttacgtttacttacgacgttacgaactaaccttagttaacttttacctttaccgtttacccgtttagtacccgtttacggggttacccggaagggggtacccgttaacgggtaagggtactaaacggtacccgttaaaaccgggtaacgttacgggtcgggttacccgggttaactaccccgggaacccctttacgggttaacgttcccggtttttaaccttccggtttcccttaaacccccccgg

SEQ ID NO: 64621 - DNA, 801 bp, Homo sapiens
  misc_feature: GYAE6OF01E5DKD.31.78.H01.1.454.CMB.1.raw
  modified_base (501)..(501): a, c, t, g, unknown or other
  misc_feature (501)..(501): n is a, c, g, or t
  modified_base (679)..(679): a, c, t, g, unknown or other
  misc_feature (679)..(679): n is a, c, g, or t
  modified_base (747)..(747): a, c, t, g, unknown or other
  misc_feature (747)..(747): n is a, c, g, or t
  modified_base (765)..(765): a, c, t, g, unknown or other
  misc_feature (765)..(765): n is a, c, g, or t
  modified_base (770)..(770): a, c, t, g, unknown or other
  misc_feature (770)..(770): n is a, c, g, or t
tcagcagtagacgtcacgaccggtgctcgatttagtgtgagtagtttgggtttgggggagctacaacaggcaggcagggcagcaagatggtgtgcacgacccagtcttctatttctctgttgctctggatctcgtggtcgccgtacgggacagttcgtgagtggacgccgtacgtttccacgtaccctcccgtggtcttcggtcgttaccgtcggtcgggacggacggtaccgggacccaacctactacgtaaccgtgaaccgtaaccgtccgaaccgaccgtaaggttacgttttacggttttaacgttaccccggaaccccctaaaactaaaacttaaacctaaccttacgttagtccgttaacggtaaccagtaacgaaaggtaaacggtacgaccgtaccgtcccgtaaacccttaaacgtcctaagtttaccgttaccggtcggtaccctttaccggacccggttcgtaccgggttcccggttaaccctaacggtntttacgtacggttacggaccgtacggggttcccgggttacgtaccggtttaacccttaacttccgtaccgttaccgacctaaacgcgttaacccgaaggtcccgtaacgtccggacggtcgaacggtcgtaacgtaaggttggttacgggtgtaaccgttttagttaccgtacgtacncgtaactaacgtattaacgtttcttaccgttcgtagttaccgtcgggtgaacggtagacgtagcgtanaacgacgtaacgtgtcgngtacncactaacgttgttcctacgttctccgtaccg

SEQ ID NO: 64622 - DNA, 821 bp, Homo sapiens
  misc_feature: GYAE6OF01CDS0G.31.78.H01.1.454.CMB.1.raw
  modified_base (610)..(610): a, c, t, g, unknown or other
  misc_feature (610)..(610): n is a, c, g, or t
tcagcagtagacgtcacgaccggtgctcgatttagtgtgagtagtttgggtttgggggagctacaacaggcaggcaggggcagcaagatggtgttgcagacccaggtcttctatttctctgttgctctggatctgtggtcgaccgtacggggacatcgtgagtgacgcctagtttccagtacctcccgtggctgtcgtctcggtgggcgaggacggccaacatcaactgacacgtcacgaccaggtagttttgttttacgtccgaccccaaaactaaataacctaaacttacgttacgtacgttacggaaccagaacgtaaggaaaaggtcggaactacgtacccttaaaccttaacctccgttagtactttacggcgggtaccttaccggacccgggatacccggttacccgggttaccctaaacgtcgttacgtaacgttcggaaaccgtgggttcccggggtacggttaaccgggtaaccttacgtttaccctaacgttaccctaccaacctaacgtccgacggaccgaccggtaccgtggtaccggaacgtaaccgtaaagggtaaaccttgggttaaccggtggttaacctttaaggtttttaanaccgttcggaaacaaccggttaactaaaacttcggtttttaaccttaaccggtttttacccgttacgggtaacccgtttacggggtttaccgggaaccggggttacggtaaaccggttagggacggttaaacccaagtaaaaccgtaacgggtattcggtccggaacttccgaacgttactaccgttcttaacggtccttacgttaccccg

SEQ ID NO: 64623 - DNA, 698 bp, Homo sapiens
  misc_feature: GYAE6OF01AYA9G.31.78.H01.1.454.CMB.1.raw
tcagcagtagacgtcacgaccggtgctcgatttagtgtgagtagtttgggtttgggggagctacaacagacaggcaggggcagcaagatggtgttgcagacccaggtcttcatttctctgttgctctggatctctggtgccgtacggggacatcgtgatgagctagtttccagactcctggctgtgtctcgtgggcgagcgggccaaccatcaactgacaagtccagccagtgttgttttagtcggccccaacaataacactacgttatcgttaggtaccagacaagtaaacgtagacacgtcctaccgtaaactcctagtactttacggtcgggtacttccggtacccgggctaccgttcccggggttaccctacgtattcgtagttcgcgacggcgggttcgtcggggacctacttcgacctccgtacacctataccgacgtcgaccgtcgttcggacggtacggtaccgttaggaaacgtcggttacggtacggtacgtttagttttaacgtcttaccggtaacgacaccgttaactaagtttaccttactttccgttacgttccgttacggtttacgggtacggtaacgggtaccggtaagggtacggtaacgtaaacgtaccggtaaacgtaggtcggttacggtaccctcgaaccgttaccacgtttcggttacttcggttccttaccccgg

SEQ ID NO: 64624 - DNA, 832 bp, Homo sapiens
  misc_feature: GYAE6OF01B1SLU.31.78.H01.1.454.CMB.1.raw
tcagcagtagacgtcacgaccggtgctcgatttagtgtgagtagtttggggtttgggggagctacaacaggcaggcaggggcagcaagatggtgttgcacgacccaggtcttctatttctcttgttgctcgtggtatctcgtggtcgccggtacgggactatcgtagtagtggacgcctagttccgacgtaccctccgtggctggtctcgtcggtcggacggaggaccggccaccgtactacgaacgtacgactaaccggtcctacggactaacgggttacgttttagttttaccgttcccgacccctaaacctaaacttaacctaacgtttaccttacgtaccgttacgggtaaccagtaacgaaggtaaaacggtacggacctaccgtacccttaacgtaacctaccgttagttaccgtttacggtccggttacctaccggggacccgtacggtacccgggttaccccggttaaccgtaacgttcgttactcggtacggcggtacgggttacgggttccggtacgggtacccgttattaccctaccgttacctacctaacgtcgtacacccgcgacctccggtacggtaaccggtacgggtacgtaggtaacggtaggttcggtacggttagtttaaacggtttactacggtttacgtacaacgtaaccttaacgtttacttttaaccgttttacctttaccgttaaccgtttaccgtaccggggtttaccgggacggggtaacggtaacggtaacgggttaagacgtaacgtaacgtacggtaacggtggtcgactcgtaacgtctacttacgacttcttaaccgtccg

SEQ ID NO: 64625 - DNA, 781 bp, Homo sapiens
  misc_feature: GYAE6OF01B6F59.31.78.H01.1.454.CMB.1.raw
  modified_base (208)..(208): a, c, t, g, unknown or other
  misc_feature (208)..(208): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctcttgttgctcgtgatctcgtggtcgccgtacgggactatcggtagatggacgtccgtacgtttccagtacctccgtggtctgtcgtctcgngggacgaggacggccaacacgtacaactcgactaacgtccagaccgtaaggtgttttacgttttaccgtaccgacccctaaactaaataacctaacttacgttaacgtcgttaacgaaccgagtaacgaaaggaaagtcgaaccgaccgttaccctaaccgtaaaccgttccgttagttaaccgtttaacggtccgggtacctttacccggtacccgggtacttaccgggtttacccgggttaacccaacggttcttacgacggttcgaccggtacggccgggttacgtacggtaccttaccttacgaccctactaaccgtacctagtaccgacgtaccaccgtcgtacggaacgtcggtaccgttaagacggttagtacggtacgtacgtttaagtttactcgtacgaactaacgtaacctaatttacttaacgtttaccgttaccgtttcgtaaccgggtttacgacgggtaacggtacggtaaacgtcgggaataaccggtactaaaacggcttaagtcggacctacggtcacctaaccggttctacgtttacgtacgttcctaaccccg

SEQ ID NO: 64626 - DNA, 730 bp, Homo sapiens
  misc_feature: GYAE6OF01B2A79.31.78.H01.1.454.CMB.1.raw
  modified_base (205)..(205): a, c, t, g, unknown or other
  misc_feature (205)..(205): n is a, c, g, or t
  modified_base (376)..(376): a, c, t, g, unknown or other
  misc_feature (376)..(376): n is a, c, g, or t
  modified_base (413)..(413): a, c, t, g, unknown or other
  misc_feature (413)..(413): n is a, c, g, or t
tcagcagtagacgtcacgaccggtgctcgatttagtgtgagtagtttggggtttgggggagctacaacaggcaggcagggggcagcaagatggtgttgcagacccaggtcttcatttctctgttgctctggatctctggtgccgtacggggacatcgtgatgagcctagtttccagcctccctggctgtgtctcgtgggcgaggnggcccacagtaccaactgacaacgtccaagccgaaggtagttgtttttacgtccggaccccaactaaactaaaccaacttacttagtccttacggaacctagacaaggaaggtacgaccacgtacctacctaaacctcctaggtactttcgcggtccttacggtccccggntacggttcccgggtacctaacgtctcacgttcggacncgggtcgggtcgtacgggtacctacttcaccttctaccgaccatcgacgtacgtaccgccgttacggccgtagtaccgtaggtaaacgtcgttggttacggactttagtttacgttaccgtcgttaccgtaacttacgtaaaccttaatttaccgtttacccttttacggtttacgttacccggtttaacgggttttacgggaaccgggttaacggggtaaccgtaaaggggttacgaaggttaacccggtaacgtaaacggtacgtacgggtcgacgtaacgcctaccgtacttacttacgtccgttacttacccg

SEQ ID NO: 64627 - DNA, 682 bp, Homo sapiens
  misc_feature: GYAE6OF01BAOZF.31.78.H01.1.454.CMB.1.raw
  modified_base (380)..(380): a, c, t, g, unknown or other
  misc_feature (380)..(380): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtcgccgtacggggacattcggtgatgagccagtttccagcctcccgtggctgtgtctgtgggcgaggacggcccacatacaactgacaacgtcccagccgtagtagttgtttttagtccggaccccctaacaataaccaacttacttagtcgttacggtaccagacaaaggaaagtacggaacctacgtaccctaacctaacctcgttacgtactttacgtcgggtaccttccggtacccggntaaccgttcccgggtaacctaacgtctcgagttcgcgacggtcgggtcgtcgggtaccttcttccgacttctaccaccgtactccaggtacacggtctcggagtacggcgtaagaagtacgtggtacgtaacgttagtttactacgtagacctagaactaaccttatttaccgttacttttcgtttaccgacgtttaccgttacgggacggtacggaaccggtaggtcgtaaacacggtaaccgaaacgtacgttagggcgtagaccgtaccgtacgtattacgttcgttcctcgttacccg

SEQ ID NO: 64628 - DNA, 712 bp, Homo sapiens
  misc_feature: GYAE6OF01B9Z1M.31.78.H01.1.454.CMB.1.raw
  modified_base (416)..(416): a, c, t, g, unknown or other
  misc_feature (416)..(416): n is a, c, g, or t
tcagcagtagacgtcacgaccggtgctcgatttagtgtgagtagtttggggtttgggggagctacaacaggcaggcaggggcagcaaagatggtgttgcagacccaggtcttcatttctctgttgctcgtggatctcgtggtcgccgtacggggacatcgtgagtgacgcctagttccagcctccgtggctgtctcgtgcggagaggacggccactatacaactgactaacgtccacgccgaaggttagtttgttttacggttccggacccctaaactaaacgtaaaccgtaaacttacgttacgtccgttacggaaccgagactaaaggaagtacgactacgtaccctaacctaacgtctagtacgttacggtcggtacctcgaccggtcgtaccgggtttccggtacctacgtntacgtaggtcggccgagggtccggtacggtcggtaccttctactaccgttccacgtaatactacgtacgccgaccgtctacggtcgtagaacgtagtaaggtcgtacgttacgttactttaagtcgtactacgaaccgtaacttaattacgttttacctacgtttccgtttacgtaccgttaccgggttccgggaacggggtaacgtacgggtagggtacgtaagtaaaccgtacggtaaacgtcggttagcggtacctcgatacctgttcgtacctacgttctaacccgttcccg

SEQ ID NO: 64629 - DNA, 756 bp, Homo sapiens
  misc_feature: GYAE6OF01B45EV.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagacctccctggctgtgtctcgtgggcgaggacggccaccatcaactgaccaagtccagccagtagttgttttattcggaccccaactaataacaactacttagcttggaccagacaagaaagtacggacacgtccctacctaaacctcctagtacttacgtggtccttaccggtaccggctacggttcccgggttacctaacgtcttcagttcggcgtacggtccgggtcgtacgggtacccttacgtttcaccttcgtaccgaacctacgttacccgaacggccgtaaccggtccgtacggaccgtacgggtacccgttaaggaaaccgtggttacgggttaccggtacgtttaacgtttttaacggttacgtttacgtaccgtaacgtaacccttaaacgttacttttacttaccgtttttccggtttaaccgttccgttaaccggtttaccggggaacggggttaaccggtaaccggtaacgggtacggtaaccgtaacgttaaccggaaaccggttacggtggtaccggaccgtacgacccgtaccgttacgttacgttaccggttccttccgtaacccg

SEQ ID NO: 64630 - DNA, 701 bp, Homo sapiens
  misc_feature: GYAE6OF01AIB8A.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctcgtggtcgccgtacggggacagtcgtgatgacgcctagtttccagtacctcccgtggcttggtcgttcgtcgtggggcgaggacggaccacgtactcgaactgactaacgtaccagaccaggtacgtttagttttacgttccggaccccaactaactaacctaactactagtcgttagaaccagacaaggtaagacggactacgcccgtaacctaactccgtagtacttacggtcgggtaccttacccggaccggtacgtacggttaccccggggttaacctaaccgttacgtacgtacgttcggacgtagggtcgggtaccggtacgggaccttacttccaacgtcctacctaacgtactacacgacctccgcgtacgtccgagtcggtaagaacggtgtaacgtcggtaattacgtttaacgtccgtatacgagtaactaactactttcgttacctttacgttcgttaaccgttcgttacgggacgacggtaacgtagtacggagtaacacgtacgaagtcggtcgtaccgtagacctacgttatacttacgttcgtcccgtaccg

SEQ ID NO: 64631 - DNA, 802 bp, Homo sapiens
  misc_feature: GYAE6OF01B8PWW.31.78.H01.1.454.CMB.1.raw
  modified_base (134)..(134): a, c, t, g, unknown or other
  misc_feature (134)..(134): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctntggtcgccgtacggggacatcggtagatgagcctagtttccagtacctcccgtggctgttgtctcgtgggcgaggacgggccaccgattccaaacgtcgactaacgtccacgacctaggtgtttgtttttacgttccggaccccaacgtaaataaccgtaaccttaacgttacgtaccgtttacgggtaacccaaggtacctaaaagggaaacgttacgggaacctacggtaccccttaaccgttaaaaccttccgttagttaaccttttaaccggtcgggttacccgtttaccggaccccgggtacgttaaccggtttaccccgggggtttacctaaaaccggtctttactaacggtttcggacgtaaccgggtcggggttacggttaccggggtaacccgttagtttaccaccgtacctaccgaccctagtaccgacgtaccgacgttcccgaggtccgtacggtaccgtaggaacgttacggtcggtacggtaacgtttacgttttacgtaaccgttgtacgtaacgacttaaacgtcttttagtaccctttcgttaccgttacgttacgttcgggtaacgggtacggtaacgtacggggtagtaacgaagtaccgtaaacggtctggtcgacctagacctactgttacctcgtcgttcctaccg

SEQ ID NO: 64632 - DNA, 746 bp, Homo sapiens
  misc_feature: GYAE6OF01B6X74.31.78.H01.1.454.CMB.1.raw
  modified_base (513)..(513): a, c, t, g, unknown or other
  misc_feature (513)..(513): n is a, c, g, or t
  modified_base (526)..(526): a, c, t, g, unknown or other
  misc_feature (526)..(526): n is a, c, g, or t
  modified_base (600)..(600): a, c, t, g, unknown or other
  misc_feature (600)..(600): n is a, c, g, or t
tcagcagtagacgtcacgaccggtgctcgatttagtgtgagtagtttgggttgggggagctacaacaggcaggcaggggcagcaagatggtgtgcagaccaggtcttcatttctctgttcgctctggactctcgtggtcgccgtacggggacatcgtgatgacgcctagtttccgagtacctcccgtggccttggtcgtctacgtgggacggacggacgggcccaaccatccaaacgtcggaccaagtccagtccgaaggtacgtttacgttttacgtccggacccctaactaaataacctaacgttacttacgcttacggacacgacgtaaggaaaggtaacggacctacggtacccttaacctaaactccgtagtaactttaccgtgggtacctttaccggaccccgggtacgtaccggttacccggggttaccaaaccggtattccagttacggcgtacggtcgggtacgtcgggtaccgtatttcacgttctccgactatcaaggtccncgccctaggtacncggtacaggaagttacgtaggttacgacgtttaagtttacttctacggtacgtaactaacctaattaacctttnttaaccgttttctacccgggtttactaccgggtttcggaccgggtacggtaacgtagggttaggaacgtaacgttacgtaaaccggtattcgggccgtcgtacgtaaccgtaccttaactccgttacggttccttaacgttccccg

SEQ ID NO: 64633 - DNA, 798 bp, Homo sapiens
  misc_feature: GYAE6OF01DTWQM.31.78.H01.1.454.CMB.1.raw
  modified_base (124)..(124): a, c, t, g, unknown or other
  misc_feature (124)..(124): n is a, c, g, or t
  modified_base (600)..(600): a, c, t, g, unknown or other
  misc_feature (600)..(600): n is a, c, g, or t
tcagcagtagacgtcacgaccggtgctcgatttagtgtgagtagttttgggtttgggggagctacaacaggcaggcaggggcagcaagatggtgttgcagacccaggtcttcatttctctgttnctctggatctctggtgccgtacggggacagtcgtgatgagtcctagtttccagtcctccgtggctgtgtctcgtggacgagacggccaccatacgactgactaacgtcagccagtgtttagttttacgtcggaccccaactaaataaaccgtaacttacgttagtccttcggtaccaaggtacgaaaggaaaggtacggaaccacgtaccctaacctaaacctcgttagtttacttttacggcggggttacctttccggtacccgggtattacccgggtttcccccggggttaaccctaaaacggttcttaggacgtttcggaccgttaacggggtcgggttccggtacggggttaaccttacgttttaccgaccctcgttacccgaacccgttattccgaacggtcctaacgttcccgtggaaccgtagggtctaaggaagtaggtggtcggttactttagttttaacctcggtntaacgacgtaacttaacgtattttaaccgtccgttttacggtttacgttccgttacccgggtttaacggggaaccgggttcgggtaaacgttacggtagggaaacgttaaccgtaaccggaaaaccggttcggttacggtacggtcccttaaggtaccctaccctaagtttcccgggtacttccgtaccttaccccgg

SEQ ID NO: 64634 - DNA, 723 bp, Homo sapiens
  misc_feature: GYAE6OF01E0G55.31.78.H01.1.454.CMB.1.raw
tcagcagtagacgtcacgaccggtgctcgatttagtgtgagtagtttggggtttgggggagctacaacaggcaggcagggggcagcaagatggtgttgcagacccaggtcttcatttctctgttgctctggatctctgggtgccgtacggggacatcgtgatggagcctagtttccagacctcccgtggctgtgtctcgtgggcgaggcgggcccaccatccaactgacaacgtccacgccaggtagttgttttacgttccggacccccaactaactaaccaacttacttagtcgttacggtaccagacgaagaaacggtacggacacgtaccctacctaaactcctagtactttacggtcgggtcctttacccggacccgggtactaccgggttacccggggttaccctaaccgtattacgagttcgggacgtacgggtcggggtccgtacggggtaccctatttccgaccttcctacccgtaacctacgtaccgacggactaccggcctcggcgaggtactaaggaagtacgtgggtacggtacttaagttttactacgtcgtcgaactacctaacttactttacgttacctttcgttccgttacgttacggttacgggcgggaacgggtacgtaaggggtgaacgtaacgtaaccgtaacggtacgttcggtcggacctccgaacctaccgttcgtaccgttacgttccttccgtacccg

SEQ ID NO: 64635 - DNA, 705 bp, Homo sapiens
  misc_feature: GYAE6OF01DLENB.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtctcatttctctgttgctctggatctctggtcgccgtacggggacatcgtgatgacgcctagttccagtacctcccgtggctgtgtctcgtgggcgaggacggcccactatacaactgacaacgtccacgccagttagttgtttttacgtccggaccccaactaaactaaacctaacttacgttacgacgttacgtaaccgagactaaagaaacgtaggacacgtaccctaactaaacctctagttacttacgtcggtccttacggtaccccggactaccggttacccgggttacctaaaccgtattcgagtttcggacgtacgggtccgggtcgtacggggtacctactttccgacttcgaccactacgtcgaacgctacgcccgtacgacgtaggtactacgaagtcgtggtacggtattagtttactacgcgtacaacgtactaacgttattaacttcgtttaccgtttaccgagtttccggtacgggagggtaccgtaacggtacgggtaagaccttaaacgtaccggaaacttaagggtcgttaccggactacgtaccttaacgacgtttactccggttcttaacccttcccgg

SEQ ID NO: 64636 - DNA, 711 bp, Homo sapiens
  misc_feature: GYAE6OF01A991D.31.78.H01.1.454.CMB.1.raw
  modified_base (238)..(238): a, c, t, g, unknown or other
  misc_feature (238)..(238): n is a, c, g, or t
  modified_base (352)..(352): a, c, t, g, unknown or other
  misc_feature (352)..(352): n is a, c, g, or t
  modified_base (484)..(484): a, c, t, g, unknown or other
  misc_feature (484)..(484): n is a, c, g, or t
  modified_base (681)..(681): a, c, t, g, unknown or other
  misc_feature (681)..(681): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctcgtgggcgaggagggcccaccatccaactgcaagtccagccagagttnttttatttcggcccccacaataacaactacttagcttggaccagcagaaagtaggacagccctacctaaacctcctgtaatttaccgtgggtaccctttccgtaccccggggtntacgttccccggggttaccctaaacccgtaattcccgaatttcggccaacggccgggttcctgggggtacccctagttttccaacctccttaccgaaccaatcgagccagccctagcgaggactcgtaaagntaggtcgggtctaaggttttacttacgtgttaccgacgtaccgaaacttacgtttacgttaacctttccgttttaccgttaccgtaaccgttttcggggacccgggtaacgggggtaaccctaaggggtacggtaacggtaagtaacccgtaaaaccggtaacttaggtcggtaccgttacggaccttaaacccgtnttaaccgttcgttaccctttcgttaacccg

SEQ ID NO: 64637 - DNA, 922 bp, Homo sapiens
  misc_feature: GYAE6OF01E0WLJ.31.78.H01.1.454.CMB.1.raw
  modified_base (164)..(164): a, c, t, g, unknown or other
  misc_feature (164)..(164): n is a, c, g, or t
  modified_base (558)..(558): a, c, t, g, unknown or other
  misc_feature (558)..(558): n is a, c, g, or t
tcagcagtagacgtcacgaccggtgctcgatttagtgtgagtagtttgggtttgggggagctacaacaggcaggcagggggcagacaagatgggttgttgcagacccaggtcttcatttctctgttgctcgtggatctctggtcgccgtacgggactattcggngagtgacgtcctacgtttccagtacctcccgtggccttggtcgttctcggtgggacgaggaccggcccaaccaagtaccaacgtcgaactaacgtccgaacgtaccgtaaggttagttttcgtttttaccgttccggacccccctaaacctaaactaaacctaaccttaacgtttaccggtacgtttaacggtaccaaagtaaccgaaaggtaaagtacggacgacctacccttacctaaacctcgttagtacctttacggtcggtacccgtttacccggtacccggcgttacccggtttacccgggtttaaccctaaccgttacttaccggtaagttccggaacgttacggggtcccgggtttacggtaccgggtacgtttaccgtttaaccnccttttcccaaccttacccgtatccggtaacgccgaaccggtccgtacgggtcctaacggggtacgtaagggtaaccgggtaccgggtacggttacgttaaggtttttaccttaccgtttacggtaccgtaaccgtaaaccttaaaccgtttacctttaaactttccgtttttaccgttttaccgtaaccgtttaccgggtttaaccgggttaccgggtaacccgggtaaacgggtagggttaacgggtaagttaaaccggtaaacccggttaaccgtaccgtttagggtcggttacgtacccggtacccgtaaccttaccggttacgtttaccgttcctttaaccgtcccgtttaacccccgg

SEQ ID NO: 64638 - DNA, 821 bp, Homo sapiens
  misc_feature: GYAE6OF01EY9RM.31.78.H01.1.454.CMB.1.raw
  modified_base (810)..(810): a, c, t, g, unknown or other
  misc_feature (810)..(810): n is a, c, g, or t
tcagcagtagacgtcacgaccggtgctcgatttagtgtgagtagtttgggtttgggggagctacaacaggcaggcagggggcagcaagatggtgttgcagacccaggtcttcatttctctgttgctctggatctctggtgccgtacggggacatcgtgatgagcctagtttccagacctccctggtctgtgtctcggtgggcgaggacgggccaaccactacgaactcgacgtaacgtcccagccgtaggtaggtttgtttttacgtttccggacccccaactaaactaaactaacttacttacgtcgttacggtaccagacgaagaaaggtacggacacgtaccctaccgtaaaccttcctagtaactttacgttcggggtaccttaccggtacccgggtactaccgggtttaccccggggtttaccctaaaccggttctttactagggttacgtacgtacgggtccggggttaccggtacggggtaacccgttacgtttacccaccgtttacccttaccaaccctacgtaaccggtaccggtaccgaacggtccccggttacgacccggtaggggtaccgttaacggtaaaacggttcgttggggtacgttaaccgtttaaggttttaccttaacggtacggtaccacgttaaccgtaacttatttaccgttaacctttccgtttccgtaccgtttaacggttcggggaccggtaaccgggtaacgtaacgggtacgggtactaaacgtaaccgtaaacggtacggttcggtcggtccgacgttacccgattcgttaccgttcgtttnttccctaccgg

SEQ ID NO: 64639 - DNA, 830 bp, Homo sapiens
  misc_feature: GYAE6OF01CBJCP.31.78.H01.1.454.CMB.1.raw
  modified_base (574)..(574): a, c, t, g, unknown or other
  misc_feature (574)..(574): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggactctcgtggtcgccgtacggggacatcgtgatgacgcctagttcagtcctccgtgcttgtcgtctcggtgggacgaggaccggccaaccgtactaccaacgttcgaacctaacgtccgaacgaccgtaaggttaacgtttgtttttaccgtaccggacccctaaacgtaaacgttaaacctaacttaacgttacggtaccgtttaacggaaccacggtaacgtaaagtaaaacgggttcgaaaccgtccggtacctttaaaccgttaaccgtaccggtacgtttaacggtttaaccgtccgggttacctttaccgggtaccccggtacgttaccggttaaccccggggtttaccctaaaccgttacgttcgtaacggttcggaccggtaacgggtcgggtaccgtacgggtaacttacgtttcaccgtttaccacgacttaacnccggaactccgacgtcgtcgacgtacgtcgaacgtagtacgtcggtacgttataagtttacgttacgtcgtactaacgtacttaacttacgtttactttaaccgtttcgttaccgttaccgtacggttaccgggtaacggtaccggtaaccgggtaggtacggtaacgtaacgtaaccgtaacggttacgtacggttacgtccgttaaaccgtccgtaaacgttcgtaccgtttcgttcccgttacgttaccccgg

SEQ ID NO: 64640 - DNA, 636 bp, Homo sapiens
  misc_feature: GYAE6OF01D913L.31.78.H01.1.454.CMB.1.raw
  modified_base (93)..(93): a, c, t, g, unknown or other
  misc_feature (93)..(93): n is a, c, g, or t
  modified_base (139)..(139): a, c, t, g, unknown or other
  misc_feature (139)..(139): n is a, c, g, or t
  modified_base (388)..(388): a, c, t, g, unknown or other
  misc_feature (388)..(388): n is a, c, g, or t
  modified_base (442)..(442): a, c, t, g, unknown or other
  misc_feature (442)..(442): n is a, c, g, or t
  modified_base (449)..(449): a, c, t, g, unknown or other
  misc_feature (449)..(449): n is a, c, g, or t
  modified_base (474)..(474): a, c, t, g, unknown or other
  misc_feature (474)..(474): n is a, c, g, or t
  modified_base (596)..(596): a, c, t, g, unknown or other
  misc_feature (596)..(596): n is a, c, g, or t
  modified_base (616)..(616): a, c, t, g, unknown or other
  misc_feature (616)..(616): n is a, c, g, or t
tcagcagtagacgtcacgaccggtgctcgatttagtgtgagtagtttgggtttgggggagctacaacaggcaggcaggggcagcaagatggtnttgcagacccaggtcttcatttctctgttgctctggatctctggtncctacggggacatcgtgatgagccagtttccagactccctggctgtgtctcgtgggcgacgagggccaccatcaactgcaagtccagccagtacgttgttttacttcggccccaacaattaaccaactacttagcttggaccagacaagtaacgtagaccagaccctaccgtaaaccttccgttaggacttttaccgtcgggacctttccgtaacccgggctaacgttcccggggttaccctaaccgtntttaccgagttcggcctaggtcggtccgtacgggtaccgtctttacgacctccnctaaccntcgacgactcgcctacgcgacggtntacggaagattggtacggtcctaaggtttacttagtctacgtactacgtaacctagttacttacgtttcgttcgtacgttacgttcggacggaggtaccgaggtgacgatacgaacgtacgnggttagctagccgttaccgnttaccgttatcctgtaaccc

SEQ ID NO: 64641 - DNA, 786 bp, Homo sapiens
  misc_feature: GYAE6OF01ANQKC.31.78.H01.1.454.CMB.1.raw
  modified_base (155)..(155): a, c, t, g, unknown or other
  misc_feature (155)..(155): n is a, c, g, or t
  modified_base (178)..(178): a, c, t, g, unknown or other
  misc_feature (178)..(178): n is a, c, g, or t
  modified_base (563)..(563): a, c, t, g, unknown or other
  misc_feature (563)..(563): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctcttgttgctctggacttctcgtggtcgccgtacggganatcgtgatgacgcctagttccanacctccgtggtctgtcgtctcgtcgggacgaggccggtacccacctactctaaactcggaaccgtaaccgtccgaacgccgtaggttagttttcgttttacgttcccggacccctaaactaaaacttaaccgtaacctttacgttaacgtccgttaaccggtaccgtaacgaacaaggtaacgtacggtaccgaccgtaccctaaccgtaaccttaccgttaggttaaccttttacggtccgggttacctttacccgggtaaccccgggtgtaacccgggtttaccccgggttaaccctaaccgtagtttaccgagttccggaccggtagttccggggtaccgtacgggttaccgttacttcctacgttcccaacgtaccgtacncgtacgaccgtcggcctacgtacgtacgtagtacgtaagtcggtacgtacggtcttacgtttaccgtgtaccgtaatccggaacttacctttacgttactttacccgtttcgttaaccgttacggttacggttaccggagggtaaccggaggtagtacggtactacgtaacgtacgtagtcgtcgaccgtacgactaccgttagtccgtactgttcctaaccg

SEQ ID NO: 64642 - DNA, 876 bp, Homo sapiens
  misc_feature: GYAE6OF01A357R.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctcgtggtcgccgtacggggacagtcgtgatgacgtcctagtttccacgtacctcccgtggtctgtcgtctcgtcgggacgaggacggcccaaccataccaactcgacgtaacgtccgaacgcctaaggtagtttcgttttaacgttcccggaccccaaacttaaactaaacctaaccttaacgttacgtaccgttacggaacctacgaacgtaaggtaaaacggtacggaaccgtaccgtaccccttaaccgtaaaccttccgttacggttaacgtttaccggttacggtacccgttacccggtaccccgggacgttacccggttaccccggggtttaccctaaccgtacgttacctaacggttcggaaccggaccgggttacggggttaccggtacggggtaaccctttacgtttaccctacccgttaccgtaccaaccgtacgtacgaccgtacgtacgtaccgtcggaccgaggtaccgtaagtaacggtacgtacgggttacgtacgtttaacggtttacttacggtacggttaacaacgtaacgttaaaccttatttttaacccttaacccgttttccgtttacccgttaaccgttacgggtttcccgggaacgggtaacggttaccggaaagggttaacggaacctaacggtaaaccgtaaccggtaaggttcggtaacgacgttacccggtaacctacgtttaaccgtccgtttacgtaacccgtttcgtaccccgg

SEQ ID NO: 64643 - DNA, 864 bp, Homo sapiens
  misc_feature: GYAE6OF01AKQZC.31.78.H01.1.454.CMB.1.raw
  modified_base (846)..(846): a, c, t, g, unknown or other
  misc_feature (846)..(846): n is a, c, g, or t
tcagcagtagacgtcacgaccggtgctcgatttagtgtgagtagtttgggtttgggggagctacaacaggcaggcaggggcagcaaagatggtgttgcagacccgaggtcttcatttctctgttgctctggatctcgtggtgccgtacgggacagtcgtgagtgagcctagtttccgacgtacctcccgtcgtcgtgtcgtctcgtcgggcgacgggacggccctaaccactacctaaacgtcggaccgtaaacgtcccgacgccgaagttaggtttacgtttttacgttcccggacccccaactaaactaacctaacttaaccgttacgtaccgttacggtaaccgacgacgtaaacgaaacggtaacggacgtacccgtacccttaaaccccgttaaacctcccgttaggttaaccgttttaacggtccgggtaccttaccccggtacccggtccgttaaccgttccccgggtttaacccttaaccgtacttacgtacgttacggtaccgtccgggtaccgggtccgtaacggggtccctttaacttaccggtaaccttccccgtaacaaccccgtagttaaccgacgacccgtacgtccccggtagcccgggtagtacgtagtaacgcgttaggtcggttactttaacggttactttacgccgtaattacgaacctacgtttaactccgtttacgtttcgttaccgtttaccgttacccgggtttaacgggacgggtaacccggtaacggaacggttacgaaaccgggtagttaaaccgtaaccggttacttaacggggttcgacccgtaaagttcccgaaccggttaatccgggttttaacncccgtttagtacccccgg

SEQ ID NO: 64644 - DNA, 966 bp, Homo sapiens
  misc_feature: GYAE6OF01AQC6X.31.78.H01.1.454.CMB.1.raw
tcagcagtagacgtcacgaccggtgctcgatttagtgtgagtagtttgggtttgggggagctacaacaggcaggcaggggcagcaagatgggtgttgcagacccaggtcttctatttcttctgttgctctggtatctctggtcgaccgtacggggactagtcgtgagtgacgcctacgtttccgagtacctcccgtggtcgtgttcgttcctcggtcgggcggtaacggacgggacccaacctactaccgaacgtacgaccgtaaccggtccacggtaccgaacggttagtttcgttttacgttccggtacccccaacttaaaaccttaaacgtaaaccctttacgttaacggtccgtttaacgggtaaccctaaggtaaccgtaaaggttaaacggtaaggtaacccgtaccgtaccccgttaacctaaaaccggttcccgttaacgttaacgttttccgggtaacggggtacctttaccccgggtaaccccgggaccttaccggggttaccccgggtttaacccgtaaaccggttaccgttcgtaacggttccggaacgtacggggtccggggtaccggttaacggggtacccctacgtttaccgaccttccgtaacccgtaaccgtacggacgtaccggtacccgaacgttccggtaaccgtacggtacccgtagggtaaccgtaaaacgttacgggttacgggtacggttaacctttaacgggttttaacttaacccggttcggtaaccgtaaccgttaacgttaaaccgttaacttttaaccgtttaaccggttttacccgttaccgtttacgttaaccgggttacggggtacccgggtaacggggtaaacgtacggggtaagtaaccgttaaggtaaaaccctaagggtaacgtacgggttacccgtcgtaaaccgtccgtaaacgttcggttaaccttcgttaccgttaacccgttacc

SEQ ID NO: 64645 - DNA, 750 bp, Homo sapiens
  misc_feature: GYAE6OF01AU2IR.31.78.H01.1.454.CMB.1.raw
  modified_base (409)..(409): a, c, t, g, unknown or other
  misc_feature (409)..(409): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtcgccgtacggggacatcgtgatgagcctagtttccagacctcccgtggctgtgtctcgtgggcgaggacggccacatccaactgacaagtccagccgaagtagtttgttttacgtccgaccccaactaaataacctaactacttacgtcgttacggtaacccagacaaggtaaacgtacggacctacgtaccctaacgtaacctcgtagtacgttacgtcggtccttaccggtacccgggcttacggttaccccgggttacctaaccggtnttacgtacggttcggacgtacgggtccgggttacgtacggggtaccttacttacgtaccttaccgtaccgaactactccgacgtacctacggtccgtaggacggtacggtacgtaaggtaacgtacggttacggtacggtaacgttttaagttttaacgttaccgtacgtaccggaatacccttaaacgttaacttttaaccttacgtttaccgtttacgtaccgttaacggttaccggggacgggtaaccggaacggttaggacggtaaactacgtaaaccgtaacgtacgttcggacgtactacgacctacgttacttacgttacgtccttagtacccg

SEQ ID NO: 64646 - DNA, 625 bp, Homo sapiens
  misc_feature: GYAE6OF01BWZC8.31.78.H01.1.454.CMB.1.raw
tcagcagtagacgtcacgaccggtgctcgatttagtgtgagtagtttgggtttggggggagctacaacaggcaggcagggggcagcaagatggtgttgcagacccaggtcttcatttctctgttgctctggatctctggtgccgtacggggacatcgtgatgagccagtttccagactccctggctgtgtctcgtgggcgaggagggcccaccatcaactgacaagtccagccagtagttgttttagttcggaccccaacaataacaactacttagcttaggtaccagcaagaaagtaggacagaccctactaaactcctagtatttaccgtgggtccttccgtacccgggctacgttcccggggttacctaaccgtattccgaactttggaccgagggtcggggtacgtcggggtaaccgtattttaccacttcctcaaccctatccaagctacgccctggcgaggctaggaagattggtgcgtaagttttatacgtacgtacaagtacctaaacgtattaacttactttcttacgttcctacgtttcggcgggaggtacgtagggtcgagtaacgtacgaaacgtagtcggtggcctgacctacgtatctcgttcttctaccg

SEQ ID NO: 64647 - DNA, 813 bp, Homo sapiens
  misc_feature: GYAE6OF01CTORO.31.78.H01.1.454.CMB.1.raw
tcagcagtagacgtcacgaccggtgctcgatttagtgtgagtagtttgggtttgggggagctacaacaggcaggcaggggcagcaagatggtgtgcacgacccaggtcttcatttctcttgttgctcgtggatctcgtggtcgcccggtacggggacagtcgtgagtgacgcctagttccacgacctccgtgctgtgtctcgtgggacgagacggccacatacaactgacaacgtccgagtaccgaggtacgtttgttttaacgtcccggaacccctaaactaaaacttaaacctaaccttaacgttacggtacgttaacgggtaaccaagaccgtaaaaggtaaacggtacggaacctacggtaccccttaaaccgtaaacctccgttaagtacgtttaccggtacgggtcctttacccgaccccggggtattacccgggttaccccggggttttacccaaaaccgttgttacgtaacggttacggcgtaacggggtacccggtaggtaacccggggtaacttaccgtttaccaaccgttacctaaccctaacgtaccgtacgacgaccgtaccgtaccgttacggaccgtagggtacgtaacgggtaaacgtacgttacgggtacgttaacgtttacgtttaacgttacgttacgtacgaacttaactaaacgttaactttaaccttacgtttccgttaccgtaccgttaacggttacggacgggtacggaaccggtaggtacgacgtacgtaaacgaacgtaagtcggtcgacctacgacctaacctacgttacgtactactcgttaacc

SEQ ID NO: 64648 - DNA, 846 bp, Homo sapiens
  misc_feature: GYAE6OF01BMXQV.31.78.H01.1.454.CMB.1.raw
tcagcagtagacgtcacgaccggtgctcgatttagtgtgagtagtttgggtttgggggagctacaacaggctaggcaggggcagcaagatggtgttgctagacccaggtcttcatttctctgttgctctaggatctctgggtcgtaccgttacggggacacgttccggtagtaatcggaacggtaccttacgtttaccacgtacccttcccgtggtccttggtcgtcgtcggtagggcgaggaccggccaccgacttcacgtcgaccgtaacggtcccacggacctaaggtacgtttcgtttttacgtccggaccccctaaataacttaacctaacttaccgttaaggtccgtttacggaccctaggtacgaaacgtaaacggtacggacctaccggtaccctaacgtaaaccgtcctaggttacttacggtcgtaccttaccgaccggtctacgtccgggttacctaacgtgttaccgtgttacggacgtacgggcggttacgtacggggtacccttatttacgccttaccagtaccccgttagcccgtaagacccgtcgcccgtaggacggaacggttaccgtaaggtaagtcggttacggacgggttaactttacgtttacggttacgtcggtaacgtaacgttacttaaccgttatttaccgtttaacctttcgtttaccggttacgtttaaccggtcggggttaaccgggaccggttaaacgggtaggggtaacctacggtaaaccgttaacgggtaaacccttagggttccggtacggtacgtaccgggaacccctaagggttaccctttacgggtttaccttcccgtaacccggttccc

SEQ ID NO: 64649 - DNA, 933 bp, Homo sapiens
  misc_feature: GYAE6OF01DBVOK.31.78.H01.1.454.CMB.1.raw
  modified_base (130)..(130): a, c, t, g, unknown or other
  misc_feature (130)..(130): n is a, c, g, or t
tcagcagtagacgtcacgaccggtgctcgatttagtgtgagtagtttgggttgggggagctacaacaggcaggcaggggcagcagatggtgttgcagacccaggtcttctatttctcgtgttgctctggntctcgtaggtcgccgtacgggacagtcgtagatgacgcctagttccgacgtaccgtcccgtgtcgtgtcgtcgtcgtgggacgaggacggccactagtactacgtcgacaacgtccacgtaccgtagtacgtttgttttacgccggaccccaactaaactaaccgtaaccttacgtacgtaccgttaccggtaaccacgtacgtaaaggtaacggttaacggaaccgtaccgtacccccgttaaaccgttaacccgttaccgttacgtttaaccgtttacggtccgggttctttaaccccggggtacccgggtaccgttacccgggttaccccggggttttaacccaaaccggttttcgttacgtaccggtttacgggaccccgggtttagggtaccccggggtttaacggtaccggggtaaaccctttaccgttttcccgaaaccgtttccccgaacccgtaaaccggtccgttaaacccggagtaccccgtaccgttacccgtacgggtaacccgtggtaaacggtttacggtaacgtcggttaagggttaccgtaacgttttaacgggttttacaacccgtttcgtacgtaaaccggttaaacgttaccgttaacgtttttaacccgttcgtttaaccccggttttaccgttccgttaaccggggttaacgggtacccgggtaacggggaactttaacgggtcgggaaacgttaaaccgtacggtaaaacccgtggttaaccggtcggtaccctaccggttaccacctttacgtccgttaaccgttcttaccggtacccc

SEQ ID NO: 64650 - DNA, 766 bp, Homo sapiens
  misc_feature: GYAE6OF01AZ81W.31.78.H01.1.454.CMB.1.raw
tcagcagtagacgtcacgaccggtgctcgatttagtgtgagtagtttgggtttgggggagctacaacaggcaggcaggggcagcaagatggtgttgcacgacccaggtcttcatttctctgttgctctggatctctggtgccgtacggggacatcgtgatgagcctagttccagtacctcccgtggctgtcgtctcgtgggcgagacgggcccaccatcaacgtgacaacgtccgagcctagtagtttgttttacttcggacccccacgtaaataacaacttacttagcgttaggtaccagacaagaaacgtcggaacacgtccctaccgtaaactccgtagtacttaccgtggtccttaccggtacccggtcacggttccccggggttaacctaaccggtacttacgtacgttcggaccgtacgggtccgggttaccgtagggggtaacccgtacttttccggaaccttcccgtaaccgtaaccgtactaccgacgtacccgacgtccgtcggacgtaacggtctacggtaactcggttacgtacggtaccgttaaggtttaacttacggtaacggtactacgtaacgtaacttagtttaaccgtttaccttttacggttacccgtacgtttaccgtttacggggacggttaaccggaaccggttagggtacgtaaacggtaaccgtaaacggtaaccgttaaggtacgggttagaccgtagtcccctaaacgtccgttacgtacgttttcccgtccgttacccg

SEQ ID NO: 64651 - DNA, 685 bp, Homo sapiens
  misc_feature: GYAE6OF01BARU3.31.78.H01.1.454.CMB.1.raw
  modified_base (60)..(60): a, c, t, g, unknown or other
  misc_feature (60)..(60): n is a, c, g, or t
  modified_base (200)..(200): a, c, t, g, unknown or other
  misc_feature (200)..(200): n is a, c, g, or t
  modified_base (209)..(209): a, c, t, g, unknown or other
  misc_feature (209)..(209): n is a, c, g, or t
  modified_base (374)..(374): a, c, t, g, unknown or other
  misc_feature (374)..(374): n is a, c, g, or t
tcagcagtagacgtcacgaccggtgctcgatttagtgtgagtagtttgggtttggggganctacaacaggcaggcaggggcagcaagatggtgttgcagacccaggtcttcatttctctgttgctctggatctctggtgcctacgggacatcgtgatgagccagtttccagactccctggctgtcgtctcgtgggcgagngggccaccntcaactgcagtccagccagtagttgttttatttcggcccctaacaataacaacttacttagtcttacggtaccagtacaaggaaagtaggacacgtcctacctaaactcctagtatttacgtggtaccttccgtacccggctacgttccgggttacctaaccgtnttcgagtcgcacggcgggtcgtggaccgtatttccacgttctcgactatcgagcgacgcctagcgacggctaacggaagtacgttggtacgggaccgtttaagttttacgttaacttcgtaccacggtactaaacgttacttaactttaccgtttccgtttaccgttacgttaccggttttaccggggccgggttaacgggaaccgggtagggttaacggtacggtaagttaaaccgaaaccggttagtacggttacggtcctacggtaacccgtacctaagtttccttaccgtctttcccggtttaaccc

SEQ ID NO: 64652 - DNA, 909 bp, Homo sapiens
  misc_feature: GYAE6OF01EY5ST.31.78.H01.1.454.CMB.1.raw
tcagcagtagacgtcacgaccggtgctcgatttagtgtgagtagtttgggtttgggggagctacaacaggcaggcaggggcagcaagatggtgttgtagacccaggtcttcatttctctgttgctctggatctctggtcgccgtacggggacatcgtagatgagcctagttccagacctcccgtaggctgtcgtctcgtgggcgaggacggccaccgaatcaacctgaccaagtccgagccgtagtagtttgttttacgttccggacccctaaccaaataaacctaaccgttacttacgtaccgttacggtaacccaggtaccaaaggtaaaacggtagggaacctacggtaccccttaacccgttaaaaccgttccgttaggttaaaccttttccgggtacggttcccgtttaccccggtacccggggtaccttaccgggttaccccgggggtttaccctaaaccggttctttaccggtacggttcgggacgtacgggtccggggttacgtacggggtaccttagtttcccgtactccctaccaacccgtataccgtacgcgtaaccgtccgtaacggacggtacggtacgtaacgggaacgtacggttagggtaccggttaacgtttaacgttttacgttacgttaccggtaactaacggtaacttaaaccgttacgtttttaactttacccggtttttacctttaccggtaaccggtttaccgggtttaaccgggggtaaccgggtaacccgggttaaacgggttaacgggtaacgggtaacgttaaaccggtaaaccggtaaaccgggttaacgttaccgggttacgggtcccgtaacgttaccccgtaacgtttacccgttacggtttaccgtttaccctttaccgaccgttttaaccccccgg

SEQ ID NO: 64653 - DNA, 765 bp, Homo sapiens
  misc_feature: GYAE6OF01AM3Q6.31.78.H01.1.454.CMB.1.raw
  modified_base (196)..(196): a, c, t, g, unknown or other
  misc_feature (196)..(196): n is a, c, g, or t
  modified_base (384)..(384): a, c, t, g, unknown or other
  misc_feature (384)..(384): n is a, c, g, or t
  modified_base (449)..(449): a, c, t, g, unknown or other
  misc_feature (449)..(449): n is a, c, g, or t
  modified_base (495)..(495): a, c, t, g, unknown or other
  misc_feature (495)..(495): n is a, c, g, or t
  modified_base (513)..(513): a, c, t, g, unknown or other
  misc_feature (513)..(513): n is a, c, g, or t
  modified_base (705)..(705): a, c, t, g, unknown or other
  misc_feature (705)..(705): n is a, c, g, or t
tcagcagtagacgtcacgaccggtgctcgatttagtgtgagtagtttgggtttgggggagctacaacaggcaggcaggggcagcaagatgggtgttagcagacccaggtcttcatttctcttgttgctctggtatctcctaggtcaccgttacggggactatcgtgagtgagccagtttccagtacctcccgtggntcgtgtccgtcgtgggacagggacggcctaccgtagtcaaacgtgactacgcgacgccgagtgtttacgtttttactccggaccccaataacttaacgaacttacttaacgtcttcggtaaccaggtaccgtaggaaacgttacggaccgcgttacccttaccgtaaccttcgtacttaagtttccgnggtcccttaccgtaccgggtacctacggtcccgggttacctaacggtcttactacgttcggaccngggtaccggttacgtcgggtaccgttatcccgtacgttctaacccncgtaactcgacggtaccncgtctcgacgttacgagttcgaaagttcgtcggtacgtacgttaagtttcgtttaacgtcgtagtagacgtaacccttaagtttacctttaaccgttttacgtacgttaccccggttaaggtttccggacgggaccggtaaccggttacggggtaacggtacggtaacctaaccgggtaaacgttaccgggngttacggttcccgtactaaccggtcttaaccgttcgttacttaccggtttcgtaaccccg

SEQ ID NO: 64654 - DNA, 931 bp, Homo sapiens
  misc_feature: GYAE6OF01B0UWJ.31.78.H01.1.454.CMB.1.raw
tcagcagtagacgtcacgaccggtgctcgatttagtgtgagtagtttgggtttgggggagctacaacaggcaggcagggcagcaagatggtgttgcagacccaggtcttcatttctctgttgctcgtggatctcgtggtcgccgtacgggacatcgtgatgacgcctagtttccagtacctccgtggctgtgtctcggtggcgaggacggccacatcaactgactaacgtccacgcgtagtcgtttagttttacgtccgaccctaactaaactaacctaaccgttacgttacgtccttacggtaccgacgacgtaaagtaacggtacggtacctaaccgtccccgttaaacccgtaaacctttaccgtacgttaacgttttacccggtacggttcccgttaacccggtacccgggtacgttacccgggttaccccggggtttaaccctaaaccgttacgtttacgacggtttacggaccggtagggttacccgggggttacgttacggggtaacccgttttacgttttacgaacccggtttcctaccctaaccgttacgtaccgaacgaccgtacgtcccgttagggaccgtagtaccggttaaagaagtcggttaggtacggttacttttaacggtttacctttacggtaccgtaaccgtaacgtaaccttaaaccgtttacgtttaacccgtttttaactttttcccggtttaaccgttacccggttttaaaccggtttccgggggaaacgggtaacccggttaaacggtaccggggttaaaggtaccgtaaaacccggttaacgggtaaaaccccgttttaagggggccgtttaaaccggggaccccttaacgttaaacccccggtaaggtttaccccgttttacggttaacccgtttttaaacccgtcccggtttttaaacccccgg

SEQ ID NO: 64655 - DNA, 971 bp, Homo sapiens
  misc_feature: GYAE6OF01A3XMV.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttcctctgttgctctggatctcgtggtcgccgtacggggacatcgtgatgagcctagttccagtacctccgtggtctggtctctcgtgggacgaggacgggccaccatccaacgtgactaacgtaccacgaccgtaggtagtttgtttttacgttccggacccctaaactaaactaaaccgtaacttaccgtttaacgcgtttaccgggtaaccaacgtacgaaaggttaaaggtaccggaacaccgtacccgttaacctaaaccgttcctacggttaaacctttcggtaccgggtacctttacccggaaccccgggtcgtaccgggttccccgggttaacctaaccgtacttaccgaggttcggaccgtaggggtcccggggtaccgttcgggaaccgtttactttccgaaccttccgtacccctactaacgtacccgtacgaaccgtaccggtacctacgggtaccgtacgggaacccgttagggtaaacggttacgttaccggggttacgtttaacccgggtttaagttttaaaccgggttactttacccgggtaaccttaacggttaaaccgttaaaacctttaacgtttttaaccgttttaccgtttttaaccggttttacccggttaacccttttaccgggggggtttaacccgaaccggggggtttaaaccggaaacggggtttaacggggtaaccggggtaaacccgtttaaaacggaaacccggtaaaaacccgggttttacgggtaccggggttacccggttaccgggttaacccgtaaaccccggttaaactttcccgggtttaaaccggttttccccctttaccgtaaccggtttttaaccccccg

SEQ ID NO: 64656 - DNA, 819 bp, Homo sapiens
  misc_feature: GYAE6OF01CQTQU.31.78.H01.1.454.CMB.1.raw
  modified_base (773)..(773): a, c, t, g, unknown or other
  misc_feature (773)..(773): n is a, c, g, or t
  modified_base (801)..(801): a, c, t, g, unknown or other
  misc_feature (801)..(801): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtcgccgtacgggacagtcgtgagtgacgcctagttccagacctccgtggctgtgtcgtcgtgggcgaggacggccaccgtataccaacgtcgacgaacgtccgacgaccgtagtagtttagtttttacgtccggacccctaaactaaataaacctaacctacgtttacgacgtttacggtaaccagaacgtaaggtaaaacgttacggacctaccgacccttaaccgtaaaaccgttccgtagttaacgttttaccggcgggttaccctttacccgggtacccggtacgttaaccgggttacccccggggtttaaccctaaaccgtacgtttacggtacgtttacgggacgtacggggtcccggggttaaccgtacgggggtaaccctttaacgtttccgtaacccttccgtaaaccgacccgtaaagttccgaaacgtccgaaccggttcccgtacggtaccgtagggtaccgtaagggtaagtacggttacggttacggtaaccgtttaagtttaacgttacgtaccgggtaacctaaggtaaccttaaagttaactttaccttacgtttccgttaccgtcgttaccggtttacggacgggtacgacgtaggagtacggtaatacggtaaacgngttgtcggactaccgacgtctaacgttntacgttcctacgtacccg

SEQ ID NO: 64657 - DNA, 705 bp, Homo sapiens
  misc_feature: GYAE6OF01CBRR1.31.78.H01.1.454.CMB.1.raw
  modified_base (239)..(239): a, c, t, g, unknown or other
  misc_feature (239)..(239): n is a, c, g, or t
  modified_base (470)..(470): a, c, t, g, unknown or other
  misc_feature (470)..(470): n is a, c, g, or t
  modified_base (480)..(480): a, c, t, g, unknown or other
  misc_feature (480)..(480): n is a, c, g, or t
tcagcagtagacgtcacgaccggtgctcgatttagtgtgagtagtttgggtttgggggagctacaacaggcaggcaggggcagcaagatggtgtgcagacccaggtcttcatttctctgttgctctggatctctggtgccgtacggggacatcgtgatgagcagtttccagactccctggactgtcgtctcgtagggcaggacgggccacagtcaactgcaagtccagcctagagtttnttttactcggacccaactataacgaacttacttagcttacgggtacagtacaagaaaggtcgaacacgcctactaaacgtccagtactttacgcggactttccgaccgggtacacgggttaccggttacccgtaaacgttgttacctaggtttacggacgtaacgggtcgggttacgtccgggtaaccggtacttttaccgacttaccactaaccgacgtacgaccggtanacggttaccncgtaccgggaagtcctagaacgtatacggtcgtaacgtaggttttacgtacgtactacaggtacttaaacgctttaattaccgttactttaccggtaacctttacggtttcgggaaacccggacgggttaaacgaccgggtagggtaaccgtaaggtaccctaaagggttaccgaggttcccgtagttaacgaccttaccgtactacgtcggtccttgtaacccc

SEQ ID NO: 64658 - DNA, 763 bp, Homo sapiens
  misc_feature: GYAE6OF01AMKEN.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccgagtacctccctggctgtgtctcgtgggcgaggacggccaccgatcaactgacaacgtccagccagtgtttgttttacgttaccggacccctaactaaataacctaacctacttacgcgttacggtaccagacaaggtaaggtacggacgtacgtaccctaaccgtaaaccttcctacgtaacttttccggtcgggttaccgtttacccggtacccgggtcttacccgggttacccggggtttaaccctaaccggtacttcgtacgttcggaccgacgggttccgggtcgttaccgggtacccgttacgttttcccacttccgtaccgaccctataccgtacgtcgaccgttcccgtacggacgtacggtaccgtagggtaaacgtcggttaggttcggtacgtttaacgtttactacgtcgtacgaacgtactaacttaacgtttacttaccgtttccgttacgtaccgttcgggttcgggaacggtacgggtaaccgtagggtacgtaaacgtaaccgtaacggtaaacctagggttcggccggtacgtacccgtactacccgttacttcgttcgttccttccggtacccc

SEQ ID NO: 64659 - DNA, 861 bp, Homo sapiens
  misc_feature: GYAE6OF01CB2Y0.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctcgtggtcgccgtacggggacagtcgtgatgacgtcctagtttccagtacctcccgtggccttgtcgtcgtcggtgggacgaggacggcccaaccatacaacgtgacaacgtccagccaaggtagtttgttttacgttccggacccctaaactaaataaacctaaacgttaaccgttacggtaccgtttaacggtaacccaaggtaccggtaaaggtaaaacggtacggaaccgtaccgtaccccttaaaccgttaaaccttacccgttagttaacgttttaaccggtcgggttaccctttcccggtaaccccgggtacgttaccgggttccccggggtttaacctaaccggtattacgtacggttcggcgtaacgggtccggggttaccgtcggggaacccgttactttaccgacccgttaccttaaccgaacccgtactaccggaaccgtaccgtaaccgtcccgttaggaccggtaggtaccgtaaggaacgtagttcgggtacgttacgtttaacgttttacttacggtacgtaaccgaagttaactaaaccgttaattttacccgtttacgtttacccgtttaccgttaccgttaccgggtttaccggggaaccgggttaccgggaaccgttaagggtaccgtaagtaaccgtacggtaaaacgttacgtcgggtacgtcgtaccggaccctactaacgttccgttccttacgttccgtacccg

SEQ ID NO: 64660 - DNA, 774 bp, Homo sapiens
  misc_feature: GYAE6OF01B0G13.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtcgccgtacggggacatcgtgatgagcctagtttccagacctcccgtggctgtgtctcgtgggcgaggacgggccaacctatcaacgtgaccaacgtccagccagtgtttcgtttttagtccggacccccaactaactaaaccaacgttacttacgcctttaggtaaccagacaaaggtaaacgtacggaccacggtacccttaaccgtaaaaccttccgtagttaactttacgtcgggtacctttacccggtaccccgggtctaacccgggttccccggggtttaaccctaaccggtacttaccgtaagttcggaccgtacgggtccgggttaccgtacggggtaccccttagtttcccgacctcctacgacccgtactccgaacgtccacgtccgtcggaccgtacggtactaggaacgtacgttcggtacggtacgttagtttaacttacgtacgtaccgtaacgtacctaaactttacgtttaactttaccgttttaccgtttaccggttaccgttaaccggtttcgggaaccggggtaacggtaacccggttagggtacggtacgtaaccgtaacgaaacggtacgtgggtcgaccgtacgacctacgtattaccgtcttccttacgtcccg

SEQ ID NO: 64661 - DNA, 836 bp, Homo sapiens
  misc_feature: GYAE6OF01AW2CD.31.78.H01.1.454.CMB.1.raw
  modified_base (782)..(782): a, c, t, g, unknown or other
  misc_feature (782)..(782): n is a, c, g, or t
  modified_base (800)..(800): a, c, t, g, unknown or other
  misc_feature (800)..(800): n is a, c, g, or t
tcagcagtagacgtcacgaccggtgctcgatttagtgtgagtagtttgggttgggggaggctacaacaggcaggcaggggcagcaagatggtgttgcagacccaggttcttctatttctctgttgctcgtggatctcgtggtcgaccgtacggggactagtcggtagatgacgtcctacgttccacgtcctcccgtggtcctggtcgtctcggtgggacgaggacggcctaacatacaacgtcggacaacgtccacgacctaggttgtttagttttacgtcccgacccctaaactaaactaaaccttaacttacgttacggtccgttacggtaaccacggtaacgaaaggtaaaacggtacggaacctaccgtacccttaacctaaccttcttagttaccgttttacggcgggttaaccgttccggtacccgggacgttaccgggtttacccgggttacctaaccggttattccggtaagttccgggacgtacgggttcccgggtacggtacccggggttaaaccttcgttttacccgaccttaccgtaacccggtactacgtacgaccgacgtaccggtccgtacggtacggaacggtaccgttaaagaggttcggttaggtaccgggtttaacgttacgttttacggtacgttaacggtacaacgttaactaaccttaagttttaccttcgttttaccttaccggtaccgtttaccgggcggggtaacggtacgtaacggtagggtacggtaagtaacccgttaaacggtacgttacggnggttacccggcgttaacnccgttaacgttgtaccttcgttcgtacccgttcccg

SEQ ID NO: 64662 - DNA, 700 bp, Homo sapiens
  misc_feature: GYAE6OF01BMW2H.31.78.H01.1.454.CMB.1.raw
  modified_base (415)..(415): a, c, t, g, unknown or other
  misc_feature (415)..(415): n is a, c, g, or t
  modified_base (434)..(434): a, c, t, g, unknown or other
  misc_feature (434)..(434): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagactccctggctgtgtctcgtgggcgaggacgggccaccatcaactgcaagtccagccagagttgttttacttcggaccccacaataacgaactacttagcttggtaccagcaagaaacgtagggacacggcctacctaaacctctgtatttacgtggtcttccggtacccggctacgttccggggttacctaaccggtactcgacgtttcggcgacggcggggtctagggcccgtatttccnctcgtcaccagtcagtacncgcctgacgtaggctagaaacgtgtgtggtactaggttttacttacgtcggtactacgacgtaaacttactttaaacctttccttttacctttaccggttacctttacccggttttacgggggtaccgggtaacggggttaaccccgaaggggtttacgggaaacgttaaccggttaaaccgtaaaaccgggttaacgtcgggttaccggtaccgtacgacccggtaacctacctttagggttccctttcttaccggttaaccccg

SEQ ID NO: 64663 - DNA, 792 bp, Homo sapiens
  misc_feature: GYAE6OF01CHZAR.31.78.H01.1.454.CMB.1.raw
tcagcagtagacgtcacgaccggtgctcgatttagtgtgagtagtttggggtttgggggagctacaacaggcaggcaggggcagcaagatggtgttgcagacccaggtcttcatttctctgttgctctggatctctggtcgccgtacggggacagtcggtagatagacgtcctacgtttccaacgtacctcccgtggtcgttgtcgtccgtgtcggggcgtaggacgggacccacctactacaacgtgacgtaaacgtccgagtaccgagttacgtttcgtttttacgtacccggacccctaactaaaacgtaacttaaacgttacttaacgcccgtttaggtaaccgaacgacgtaaaggtaaaggtaaccggacctaaccgtcccgtaaaccgtttaaacctccgttacgttaactttaccgggtccggttacctttacccgggtaccggtcctaccgggttacccgggttaacccttaacgtctttacgtcggttacggaccggtacgggtaccgggtacgttaccgggtacgttcttcgtacctctaccactgacgtacgctaaccggtccgtacggacgtacgtcgtaacggaagttacgtgggttacgtaacgtttaagtttccgtaactcgacggtaactacttaagttacttacgtttaccttcgtttacgtactacggttcggaaccgggttcggaacgtggttaacgaagtaccgaaacgtacgttaggacggtcgaacgtcgtacccgtaatacttacgttccggttcctccgttaacccg

SEQ ID NO: 64664 - DNA, 659 bp, Homo sapiens
  misc_feature: GYAE6OF01E0D3L.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagtttccagactccctggctgtgtctcgtgggcgaggacgggccaaccatcaactgaccaagtccagccagtagttgttttagttcggacccccaactaactaacaactacttagcttaggtaccagacaagaaagtaggacacgcctacctaaactcctagtactttacgtcgggcttccgtacccgggctacggttcccggggttaccctaaaccggtattccgtagttggcctagggtccggggttactacggggacccttagtttccaaccttcctaccaacctattaccgaacgcctacgtcccgttaggaccgtacgggtccttaggaaacgtacgtacggtggtaccttaagttttacgttactggtacacgactaactatttactactttcttcgtcttaccgttcgggacggacggtaacgagggtgtacgactacgaaacgtactggtcgcgttacgacctaccgtattccgtcgttctcgtacc

SEQ ID NO: 64665 - DNA, 791 bp, Homo sapiens
  misc_feature: GYAE6OF01CZ5O9.31.78.H01.1.454.CMB.1.raw
  modified_base (139)..(139): a, c, t, g, unknown or other
  misc_feature (139)..(139): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtnccgtacggggacatcgtgactgacgcctacgtttccaagtcctcccgtggtctgttcgtctcggtgggcgaggacggccaaccataccaacgtcgactaacgtccacggaccagtacgttttagttttacgtcccggacccctaactaaataaacctaacgttaacgttacgccgtttacggaaccacggactaaagggaacgtaacggccacgtacccttaccgtaaacctcgtagttacttcggcgttcctaccgggacccggtatacgggttccccgggttactaaccgtcttcgtacgttcggaccgtacggggtccgtacggtacgggtaccttaacgtcctaccgtaccgtaacacccaagttccgaccgtccgtaccgtaccgtcggacggtacggtacgtaacggtaagtcggtacggtacggttaacgtttaggttttactacggttctaaccgaacgtaaccgtaaagtttaactttacctttaccgttttacccgttccgttaaccgttccggggtttaaccgggtaaccggggaacgttaaccggggtaacgggttaacgacgtaaaccgtaaccgtaaacggtaggttcggtcggcctaaacggccttaaacgtacgttcgtacttcggtccttacccg

SEQ ID NO: 64666 - DNA, 806 bp, Homo sapiens
  misc_feature: GYAE6OF01AM7RY.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtcgccgtacggggacatcgtgatgacgcctagtttccagcctccctggctgtgtctcgtgggacgaggacggccacatactaactgacaacgtccgacgcctagtagtttcgttttacgtccgacccctaacgaaataactaaccttacttagtccttacggaaccgagtacgaagtaaaggtacggaccacgtacccttaacccgtaactccgttagtacgtttacgtccggttaccttacccggtaacccgggtcttaccgggttcccggggtttaccctaaaccgtctttacgtaacggttccggtaccgtacggggtacccgggttccggtacggggtaaccccttagtttacccgtacgttcccgtaccgaacccctagccgtaaccgtcgtacgtcccgtacgtaccgagggtcctaaaggtacgtagtaccggtacggttaccgttaagttttaccgtacgtacgaccgtaacgtaactaaccgtttatttaccgtttaaccgtttccgtttcccgtaacgtttccgggttacggggaaccgggttaacggaccggttaagggtaccgtaaagtaccgttaaaccgggaaccgttaacggttaggtcccggtacgtactacccgtacttacgttaccgtttacgttccttaccggttacccg

SEQ ID NO: 64667 - DNA, 845 bp, Homo sapiens
  misc_feature: GYAE6OF01BZS1A.31.78.H01.1.454.CMB.1.raw
tcagcagtagacgtcacgaccggtgctcgatttagtgtgagtagtttgggtttgggggagctacaacaggcaggcaggggcagcaagatggtgttgcagaccaggtcttcatttctctgttgctctggatctcgtggtgccgtacggggacatcggtgatagacgcctacgtttccacgtacctcccgtggcttgtcgtcgtcggtgggcgacggacggccaccatccaactcgacacgtccgagccaggtagttcgttttacgttccggaccccaactaaactaacctaacttacgttacgtcgttacggtaccagacaaaggaaacggtacgaccacgtccctaacctaactccgtgtactttacggtcggtaccttacccggtacccgggacgtaccgggttaccccgggttacctaaccgttattaccgtagtttcgggaccgtacggggtccgggttccggtacggggtaacccttacgtttaccgaaccctttcgtaccccaacgtacggtaacctcggacctaccggtacccgtacggaccggtaccggtagttaaccgggaaaggttaccggttaggtttaccgggttacgtttaacggtttttaacgttacggtaccggtactaacggtaacccgttaactttaacgtttaaccttttacgttttccccgtttaccggttaccgttaccgggttaacccgggggtaccggtaacggggtaaccggtaaggggtaacgggtacgtaaacgttaaaccggaaaccggttaggtacgggttccggtaaccgtcctaacccggtacttacgttcccttccgttaccttccgttaccccgg

SEQ ID NO: 64668 - DNA, 856 bp, Homo sapiens
  misc_feature: GYAE6OF01B5D9T.31.78.H01.1.454.CMB.1.raw
  modified_base (619)..(619): a, c, t, g, unknown or other
  misc_feature (619)..(619): n is a, c, g, or t
tcagcagtagacgtcacgaccggtgctcgatttagtgtgagtagtttgggtttgggggagctacaaacaggcaggcaggggcagcaagatggtgttgcacgacccgaggtcttcatttctctgttgctctggatctctggtcgccgtacgggacatcgtgatgacgccgtagttccagacctcccgtggcttgtcgtccgtcggtcgggacgaggaccggcccaaccgtacgtactaaaccgtcgaaccgaacgtcccgaacgccgtaaaggttagttttacggtttttacgttaccccggacccctaaaccgtaaaacttaaaccctaaaccgttaacgttacgtacccgtttaacggtaacccacggaaccgaaggtaaaaggtaccggtaacaaccgtaccccttaaccctaaaccgttccgttagttaacgtttaccggtcgggtaccctttaacccggacccggtaccgtaaccggttccccgggttaaccctaaaccgtctttacgtagtacggtccgtaccggggtaggtccgtacgggtaaccctttacgttaccgacttccctacgtaacccgtacgtaccgacgtacccgacgtccctaggtaacccgngtaccgttaagaaggttacgttcgtacggttacgtttaagtttacgtacgtcgttaacaacgttaaacctaacgtttattaaacccgttttcctttaccggtttaccgtaccggtttacggttaccggggaacgttacccgggaagttaaccgggtagtaacgaaaccgttaagaaacccggttagtcggtacgtaccgacgaacttacgtacttacctggttacctccgttacccg

SEQ ID NO: 64669 - DNA, 867 bp, Homo sapiens
  misc_feature: GYAE6OF01AUAGR.31.78.H01.1.454.CMB.1.raw
  modified_base (161)..(161): a, c, t, g, unknown or other
  misc_feature (161)..(161): n is a, c, g, or t
tcagcagtagacgtcacgaccggtgctcgatttagtgtgagtagtttgggtttgggggagctacaacaggcaggcagggcagcaagatggtgttgcagacccaggtcttcatttctctgttgctctggatctctggtgccgtacggggacatcgtgatgancctagtttccagactccctggctgtgtcctcgtgggcgagacgggccaccagtcaactgacaacgtccagccagtcgttgttttacgttcggacccctaactaaactaaacctaacttacgttacgccgtttacggaacccgagaccgaacggaaaacggttacggacctaacgtacccgtaccttaaaaccgtccgttagtacgtttacgtcgggtaccttacccgtacccgggactaccgggttaccccggggtttacctaaccggtactttaccgtacggtttcggaccgtacgggtccggggtaaccgtccggggtaacccgttaagtttccgaaccttcgttaaccaaccctacttaccgacgtccaccggtccgtagcccggtaaggtcgtaacggaaacgggttcttacgggtacggttacgtttaacgttttaacgtacccgtttacgtaccgtaacgtactaaaccgtttatttaaccgtttaccgttttacccggtttccgttaacccggttaccgggttttaccgggggtaacccgggtaagggtaaaccccggttaaggggtaccggtaccggttaaaccgttaaaaccggaaaacggtttacccgggtaggttacccgggtaccgtttacccggacccgttaaaccggttacttaccccgggtttagttaaccctttacccgttaaccccggg

SEQ ID NO: 64670 - DNA, 866 bp, Homo sapiens
  misc_feature: GYAE6OF01EHV2T.31.78.H01.1.454.CMB.1.raw
  modified_base (186)..(186): a, c, t, g, unknown or other
  misc_feature (186)..(186): n is a, c, g, or t
tcagcagtagacgtcacgaccggtgctcgatttagtgtgagtagtttgggttgggggagctacaacaggcaggcaggggcagcaagatggtgttgcacgaccaggtcttcatttctctgttgctctgactctcgtggtcgccgtacgggacagtcgtgatgacgtcctagtttccagtacctccgnggtctgtcgtctcggcgggacgaggacgccacatacaacgtcgacaaggtcccagaccgagttacgtttacgttttactacccggacccctaaactaaactaaactaaccttacgttacgtcgttacggtaccagtagaaagtaacgtacgactaaccgtaccctaaccgtaaactccgttaagttaacgttccggtcggttaccgttacccggtaccggtacgttaaccgggttacccccggggtttaacctaaccgtttacgttacttacggtccgggacgtaacggggcccggggttacgtaccggggtacttaccgtttcacccgttcccgtaacccacgtaaccgttcgaccgtaccggtaccgtaccggtctaccggacgggttaccgtaaggtaaacggtcgttagggtacgttaccgtttaagtttacccgttagttacgtaccgtaaacgtaccctaaagttttacgttaaccgttttccgtttacctttacccggtaccgtttaccgggttaacgggtaacccggtaacggtaacggtaaacccgggttaggtagggaaaaccgttaaccggtaaaaggttaaacccgttacggttaccggtacgggttaccgaacccgttaccggtttaacttaacccggtttgttaaaccccgttccgttaaccccgg

SEQ ID NO: 64671 - DNA, 855 bp, Homo sapiens
  misc_feature: GYAE6OF01CDXWT.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacagtcgtgatgagcctagtttccagacctcccgtggcttggtcgtcgtcgtgggcgaggaccgggcccaacctatcaacgtcgacaacgtccagtccaggtagtttgttttacgttaccggaccccaaacctaaactaaacctaaccttaacttacggtccgtttacggtacctacgacgaaacggaaaggtacgggaaccacgtacccttaacccgtaaacttccgttagttaacttttacggtcgggtcctttaccgtacccccgggtctaacccggttccggggtttaaccctaaccgtgttaccgtagttcggaccgtcggtccggggtacgttcggggtacccgtttacgttaccctaccgtcctccgaacctacgtaccacggtactacgtcccgtacgaccggtaggtaccgtaggaaacgttcgtaggtcggttacctttaacgggttttacttacggtgtaccgaagtaaccttaaacttcgtttaacgtttaccctttccgttttaccggtttaccggtaccgttttaccgggggaaccgggtaaccggggttaacccggtaaagggggtccggttaaaaggtaaccgttaacgtaaaacccgggttaagttaaccgggttccggtaccttaacccggacccggttaacccttaacgtttacccggtaccgtttttcccgttacttaaccccccg

SEQ ID NO: 64672 - DNA, 693 bp, Homo sapiens
  misc_feature: GYAE6OF01EX68W.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagttccagacctccctggctgtgtctcgtgggcgaggacgggccacatcaactgacaacgtccagccagtagttgttttacttcggaccccaacaataaccaacttacttagtcttacggtaccagacaagtaaacggtacggacacgccctacctaaaccgtccttagtacttacgtcgggtaccttccgtacccgggtctacggttccgggttaccctaacggtattacgtagtcggacgacgggtcgggttcgtacggggtacctagtttccacgttctaccgactatcgacgactacgtccgtcgacgtacgacgtagtaagacgttggtacggtacgttaagttttacttaccgttacgtacgaacgtacctaaagttactttaacttaccgtttccttacgtcgttaaccggttcgggaccggtaacgggtacgtaacggtcggaacgtaacgtaacgtaaaacgtacgttacggtacgtccgtaacgaccgtaacctactccgttcgttaccgtcttaccg

SEQ ID NO: 64673 - DNA, 810 bp, Homo sapiens
  misc_feature: GYAE6OF01CANA4.31.78.H01.1.454.CMB.1.raw
  modified_base (762)..(762): a, c, t, g, unknown or other
  misc_feature (762)..(762): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctcgtggtcgccgtacggggacagtcgtgatgacgcctagtttccagactccgtggctgtcgtctcgtgggcgaggacggaccacataccaacgtgaccaacgtccgacgaccgagtagtttagtttttacgtaccgaccccaacaaactaaacctaacttacgttacgtcgtttacggaaccaggacgaaaggtaaacggtacggaaccacgtaccctaactaaccttccgtagttactttacggtcggtccttccggaccccgggtctaccgggttccccggggtttaacctaaaccgttgttccgtaaggttcggtaccgtaggggtcccggggttacgtacggggtaaccctttcgtttacccgacttacctacccgtaacctaacggttaccgacgtaccgaccggtcccgtaggaccggtacggtacgttaaagggaacgtcggttaacgggtcggtaaccgtttaagtttttacgttaaccgtacgttccgaacgttaactaaccgtttaattttccgttaacccgttttcgttacgttacccgttacgggttccgggagggtaccggtaaccggtagggtacgtaaacgaacgtaaccggtaaaccgtggttcggtcggtacnccgtaaccgtaactacggtccttttacgggtccctttacggtaccccg

SEQ ID NO: 64674 - DNA, 761 bp, Homo sapiens
  misc_feature: GYAE6OF01CN1GX.31.78.H01.1.454.CMB.1.raw
  modified_base (553)..(553): a, c, t, g, unknown or other
  misc_feature (553)..(553): n is a, c, g, or t
  modified_base (744)..(744): a, c, t, g, unknown or other
  misc_feature (744)..(744): n is a, c, g, or t
tcagcagtagacgtcacgaccggtgctcgatttagtgtgagtagtttgggtttgggggagctacaacaggcaggcaggggcagcaagatggtgttgcacgaccctaggtcttctatttctctgttcgctactggatctcgtggtgccgtacggggacatcggtgatagacgcctagttccagtacctccgtggctggtcgtacgtcggtggggacgaggaccgggaccctacctaactaccaaacgtggacctaacggtcccgaacgtccgaagggttactttttcggtttttaacgtcccggaccccctaaactaaactaaacctaacttacgttacgtacgtttacgggaccaacgtacgaaggtaaaacggtcggaccacgtacccttaaccgtaacctcgttagttaaccgttttacgggcggtacctttacccggtacccgggagttacccgggttacccgggttaccctaacggttactacgtaggttacggctaacgggtccggttacggtacgggtaccctacgttcctactaccgtacaccgtntaccgacgtccacgtcgtacgacgacggacgtaggaacgtacgtgagtacgttatttaactacgtacgtactactactaacttacgtttaacttaccgttccgtttacgttcgttacggttaccggaggtacggacggtaggtagacgtacgtaagtaacgtggtacgtcggactccggacgtcttacgtnttaccgttctcgtaccg

SEQ ID NO: 64675 - DNA, 781 bp, Homo sapiens
  misc_feature: GYAE6OF01ACMRD.31.78.H01.1.454.CMB.1.raw
  modified_base (129)..(129): a, c, t, g, unknown or other
  misc_feature (129)..(129): n is a, c, g, or t
  modified_base (667)..(667): a, c, t, g, unknown or other
  misc_feature (667)..(667): n is a, c, g, or t
  modified_base (770)..(770): a, c, t, g, unknown or other
  misc_feature (770)..(770): n is a, c, g, or t
tcagcagtagacgtcacgaccggtgctcgatttagtgtgagtagtttgggtttgggggagctacaacaggcaggcaggggcagcaagatggtgttgcagacccaggtcttctatttctctagttgctgnggatctgtggtcgccgtacggggactagttcgtgatgacgtcctaggtttccaacggtccctcccgtggtccgtggtcgtccgtcggtagggaccgaggaccggaccacctagtaccaacgttcggaaccgtacgtcccgacgtaccgtaaggttacgttttacgtttttaccggtacccggaaccccctaaagttaaaactaaccttaaccgttacgttacggtcccgtttaaccggaaccacggaacctaaaagggtaacggtaccgtacggacctttacccctaaaacgttaaaccccgttcgaacgtttaccgtttaaccgggtcggttacccgtacccgggtaaccccgggtcgttaccccgggtttacccggggttaacccaacgttacgttcgtacgggttacggacccgtggggttccgggtaacgtacggggtaccttaacgtttcaaccgttccgaactaacctcgtacgaacgccgtacgtcgacgcgtacgtcgtagaacgtgcgtagttcgttattacgcgtacnaccgtattacgtatttccgtacttcgtactacggttacgtcggacgcgaacgtagacgtaagtcgaaagtcgtagtcgcgacgtacctacgaccttgtccgtnttccaactccg

SEQ ID NO: 64676 - DNA, 756 bp, Homo sapiens
  misc_feature: GYAE6OF01BDXCQ.31.78.H01.1.454.CMB.1.raw
  modified_base (719)..(719): a, c, t, g, unknown or other
  misc_feature (719)..(719): n is a, c, g, or t
tcagcagtagacgtcacgaccggtgctcgatttagtgtgagtagtttgggtttgggggagctacaaaaggcaggcaggggcagcaagatggtgttgcagacccaggtcttcatttctctgttgctctggatctctggtcgccgtacggggacagtcgtgatgacgcctagttccagacctcccgtggtctgtgtctcgtgggcgagcggaccacgatcaactcgactacgtccagaccgagtaggtttgttttacgttccggacccctaactaaacttaaccaacttacttaggtccgtttacggtaacccagaccgtaaaggtaaacgtagaccacggtaccctaccttaaactccgtagttaacgtttaccggtcgggtccttaccgtaacccgggtctaccgggttacccgggttacctaaccgtacttcgtaacgttcggcgtacggtccgggtacgtacgggtacgttactttcccgcgttacctacccgaactaccgtacgaccgtacgtaccgtccgtacgtacgacgggtacgtaacggtaaggtacgttacgggtacggttaacgtttacggtttaacttacgtcgtaacgtacgtaactaacttaagtttacttaacgtttccgtaccgttacgtacgggtttccgggacggtacggtaaccggtagggtagaccgtaacgtaacgtaacgtacgtgggcgtccgtacncgtaacgtctacgttacgttcctcggtacttccccgg

SEQ ID NO: 64677 - DNA, 852 bp, Homo sapiens
  misc_feature: GYAE6OF01BJKXR.31.78.H01.1.454.CMB.1.raw
  modified_base (159)..(159): a, c, t, g, unknown or other
  misc_feature (159)..(159): n is a, c, g, or t
tcagcagtagacgtcacgaccggtgctcgatttagtgtgagtagtttgggtttgggggagctacaacaggcaggcgaggggcagcaagatggtgttgcagacccaggtcttcattttctcttgttgctcgtggatctcgtgggtcgccgtacggggacngtcgtgatggacgtccttagtttccagtcccttcccgtggtctggttcgttctcgggttcgggcgacgggacggacccaaccattacaaaccgtgacctaagtcccgagacccgtaaggttacgttttcgtttttacgttcccggaaccccctaaacgtaaacttaaacctaaacttacgttaggtccgttaggtaaccagaacgaaagtaaacggtacggtaccacgtacccctaaccgttaacctccgttaggttacttttacggtacgggttcccttacccgggtaccccgggtacgttaacccgggtttccccgggttaaccttaaaccgtcttacgttcggttacgggcgtaccggggttcccggggtacggttacggggtaacccgttaccgttttacccaacccgtttcgtaaccccctacgtaacgtcgtaacccgaccgtacggtacccgttcgaccggtacgtcgtaaaggtaacgttcggttaggttacgtacgtttagtttactccgttagtacgtacgacttaacttagttacttttaccgttaccgttttacgttcttaccggttacgggtacgggtacgggtaaccgagggtacgtaagtaccgaaacggttaaccgtagtcgggtcaaccgtcgtaaccgtacgtttacctgtttcccgttacttcccggttacccg

SEQ ID NO: 64678 - DNA, 699 bp, Homo sapiens
  misc_feature: GYAE6OF01B0E5J.31.78.H01.1.454.CMB.1.raw
  modified_base (390)..(390): a, c, t, g, unknown or other
  misc_feature (390)..(390): n is a, c, g, or t
  modified_base (656)..(656): a, c, t, g, unknown or other
  misc_feature (656)..(656): n is a, c, g, or t
  modified_base (668)..(668): a, c, t, g, unknown or other
  misc_feature (668)..(668): n is a, c, g, or t
  modified_base (688)..(688): a, c, t, g, unknown or other
  misc_feature (688)..(688): n is a, c, g, or t
  modified_base (693)..(693): a, c, t, g, unknown or other
  misc_feature (693)..(693): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagacctcccgtggctgtgtctcgtgggcgaggacggccaccatacaactgaccaagtccaagccagtagttgttttacttcggaccccaactaaactaaaccaacttaacttacggtccttaggtaacccagacctaaagaaaaggtacggaaccacgtacccttaacctaaacctccttagtaacttttacgtggtacctttaccgaaccccgggtntaccggttcccgggtttaccaaaccgtatttacagtttggcgtacgtccggggttacgtcgggaaccgtatttccgtaacctcgttacccaacgtattaccgaacgtccgaacgtccctaggaccgaacggtcgtaaggaaacgtaagttcggtacggtccttaaagttttactaacgtgtaacccgaagtaacaattaactttactttaccgtttcttccgttaccgtacgtttcgggaaggacggttaaccgaggtagacgtanaacgaaacgtgngtgctagcgactacgttctnttccngtaccg

SEQ ID NO: 64679 - DNA, 794 bp, Homo sapiens
  misc_feature: GYAE6OF01DBNBW.31.78.H01.1.454.CMB.1.raw
  modified_base (142)..(142): a, c, t, g, unknown or other
  misc_feature (142)..(142): n is a, c, g, or t
  modified_base (653)..(653): a, c, t, g, unknown or other
  misc_feature (653)..(653): n is a, c, g, or t
tcagcagtagacgtcacgaccggtgctcgatttagtgtgagtagtttgggtttgggggagctacaacaggcaggcaggggcagcaagatggtgttgcagacccaggtctcatttctctgttgctcgtggattctcgtgggtnccggtacggggactatcgtagtagtgacgcctagttccagtacctccgtggtctgtcgtctacggtgggacggagacggccctaccatacgaacgtcgactaaacgtccgaagtaccgaggtaacgttttcgttttaacgtcccggacccctaaccgtaaaattaaaaccaacttttaaccttaagaccgtttacgggtaaaccccgtagaaccgtaaaggtaaaaccggttacggaaccgtaccgtaacccttaaacccgtaaaccgttaccgtaggttatttaccggtacgtcccgttaccgacccgggtacgtaacggttccccgggttacctaaaaccggtattacgtagttcggacctaggggttacctacggtcgggtaacctaagttccaacccgtccgtaaacaccgttaatccgaacgcgtaaccggtcctacggaacgtagtaaccgataagggattacggtcgtacttaagtttacttagtacgaactaggaccttaatnttaacttccgtttacttacgtacctacgggttaccgagggaccggtaggaaacggttcggatacgtaaacgtaaaccggtattagggaccgttaccacggtaaacctaccgtttaactcgtacgttcgtacccgttaaccg

SEQ ID NO: 64680 - DNA, 837 bp, Homo sapiens
  misc_feature: GYAE6OF01DB1ZJ.31.78.H01.1.454.CMB.1.raw
  modified_base (568)..(568): a, c, t, g, unknown or other
  misc_feature (568)..(568): n is a, c, g, or t
  modified_base (800)..(800): a, c, t, g, unknown or other
  misc_feature (800)..(800): n is a, c, g, or t
tcagcagtagacgtcacgaccggtgctcgatttagtgtgagtagtttgggttgggggagctacaacaggcaggcaggggcagcaagatggtgttgcagacccaggtcttcatttctctgttgctcgtggatctcgtggtcgccgtacggggacagtcgtgacgtgacgcctagttccagtcctcccgtggctggtcgtcgtcgtgggacgacggacgggccacctactaccgaacgtcgactaacgtccacgaccgaggttacggtttagtttttacgttacccggaccccctaaactaaaattaaaaccctaaccgtttaacgtttacggtaccgtttaaccggtaaccgaacgaaccgtaaaggtaaaagttacggaacctaccggtacccttaacccttaaaaccgtcccttaaggttacttttaaccggtccgggttcctttacccggaaccccggggttctaaccggtttacccggggttaaccctaaacggttcttacgtagtcggactacgggtcgggtcgtacgggtaccttattccgactccgtaccaacgtctaacgngtccgaacgtccgtgaaccgtacggtacgtaacggtaatacggtacgggttacgtaccgtttaagtttaccgttaacgtcggttaaccaacggtacttaaacgttaacttttaacccgtttcgttttacccgtttacgtaaccggtttaccgggttaccgggaacggtaaccgggtaacggaaggttacgggaacttaacggaaccgtaaaacggttaggtcgtacggtacncgtaacccgtactacgttctttacgcttccgtacccg

SEQ ID NO: 64681 - DNA, 847 bp, Homo sapiens
  misc_feature: GYAE6OF01AWD83.31.78.H01.1.454.CMB.1.raw
  modified_base (420)..(420): a, c, t, g, unknown or other
  misc_feature (420)..(420): n is a, c, g, or t
tcagcagtagacgtcacgaccggtgctcgatttagtgtgagtagtttgggtttgggggagctacaacaggcaggcaggggcagcaagatggtgttagcagacccaggtcttcatttctctgttgctctggatctctggtgccgtacgggacatcgtgatgagccagtttccagctcccgtggctgtgtctcgtgggcgaggacgggccaaccataccaacgtgaccaacgtccagccaggtagtttgttttacgttccggacccccaactaaataaaccaaaccttacgtttacgtcgtttacgggtaaccacgtacgaaaggaaaacggttacgaacctacggtaccccttaaccccttaaaaccgtcctacggtaacttttaaccggtcgggtacctttacccggtaaccccggggtntaacccggttccccggggttacccctaaaccgtagtttaccgaaggtttccggaccgtacggggtcccggggttcccggttaacgggggtaccccgttaacgttttaccgacccgtttaccgtaccctaaccctaacgttccaacggtacccgttacggacccccgttagggtacccgaaggtcccggtaaggtaaaaccggtgttcggtacggttccgttaaaggttttccttaaggtcgtaaccgtacgtacctaaaccgttatttaaccgtttacctttacggtttacccgttacggttccgtttagggacccgggtaacgggttaccgtaagggttggtaacaacggttaaccgaaaacggttacggtggtccgggactacggtaccctaacgtacgttccgttctaacccgttcgtaacccg

SEQ ID NO: 64682 - DNA, 721 bp, Homo sapiens
  misc_feature: GYAE6OF01D7NZE.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagtttccagactcccgtggctagtgtctcgtcgggcgagacgggccaccatcaatgacaagtccagccagagttgtttattcggccccacaaataacaactactagcttaggtaaccagcaagaacgtaggacagcctactaaactccgtagtatttacgcgggctttacccgacccgggctaagttccccggggtttaccctaaaccggtattcccgaagtttcggactacggccggggttacgtacggggaaccgtaattttccaaccgttactaccgaaccaacgttccgaaaggtcccgaacgacccttcggaccgtagggtaccctaggtaaaggaattcggtcggaacgttagttttaaacgttattcgtagtaacgtaccaaacgtaactttaatttaacctttaccgtttacgtacccttaccggtttaccgggaccggtacggggtaaaccctaagggtacggtagtaacttaacggaaaaaccgtacgtacggttcgggaccctacgaccggtaaccttactacgttacgtttcctaacgttacccg

SEQ ID NO: 64683 - DNA, 845 bp, Homo sapiens
  misc_feature: GYAE6OF01CLXH2.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggactctcgtggtgccgtacggggacatcgtgatgagcctagtttccagtacctccgtggctgtgtctgtcgggcgaggacggccacatacgaactgactaacgtccagcctagtagtttgttttactccggacccaacaaataaccaacttactagtccgttaggtaccagacgaagtaaaggtacggacctacgtcccttaaccgtaaacctctaggttactttaccggtcggttacccttaccggtaaccccgggtcttaaccggggttccccgggtttaaccgaacgttacgttacgtacgtcggtaccgtacggggtaccggttcggtacggggtaaccttcgttaccaaccgttctaaccgtacctacgtcgaagtccgtaccgtccgtcggtacggtacggtaccgtaagggtaagttaccggttagggtacggtacgttttaacggtttaacgtttaccgtacggtacgtaacgtaacgttaaaactttacgttttaaccgtttaacgtttccgttttaaccgggttaccgttttaccgggttaaccggggttaaccgggtaacggggtaaaacccggttaacggggtccggaaaagggttaaccggtaaaccggttaaaaccggttacggtaccggggtagttacccgggtaacccgttaacgtaaaccctttggttacccgtttacgttcccgtttacggttaacccc

SEQ ID NO: 64684 - DNA, 1051 bp, Homo sapiens
  misc_feature: GYAE6OF01D0UOZ.31.78.H01.1.454.CMB.1.raw
  modified_base (136)..(136): a, c, t, g, unknown or other
  misc_feature (136)..(136): n is a, c, g, or t
  modified_base (142)..(142): a, c, t, g, unknown or other
  misc_feature (142)..(142): n is a, c, g, or t
tcagcagtagacgtcacgaccggtgctcgatttagtgtgagtagtttgggtttgggggagctacaacaggcaggcaggggcagcaagatggtgttgcaacgacccaggtcttctactttctcgtgttgcctgtagnttcctntgggtcgaccgtacgggactagtcgagtagtcgcgtaccttagttccgaacgtccgttccgtaggtccttggtcgtccgtcgggtcgggacggacggaccggccctaaaccgtataccgtaccgttacggacctaaacggtcccagaacccgttaggtttacggtttttacgtttttacccgggaccccgtaaaccccctaacgtaaaaacttaaacccgttaaacgttttaacccgggtttaacggttccggtttaaacccggggtaacccaaacggttaacccggaaaaaaggggttaacggttaaaccgggaaccccttaacccggtttaaccccctttaaaccggttaaacctttccccgggtttaaagtttaaccggtttttacccggggtcccgggtttaaaaccccgtttcccggttaacccccggggtacgtttaaaccccgggggtttttacccccgtttaacccggttaaaaaccgtccggtttttcgacggggttttacccgggaaacgggttacccggggtttcccgggggttaaaccgttccgggggtttaaacccttttaacggttccccctaaacgtacccccggtttaaacctaaaccgttccgtaaccgggttaaccgcccgtaaccgtacgttccgggaacgtacggtaccgtaaggtaggttacggtgttaccggtacgttacgtttaacgtcgttacgtacctacgtaacttaaccgtttaacgttccgtttacgtttactttaccggttccgttaacgggtcccgggtaacgggtacggtaacggtaacggttaacggtagtaaccgtaaccgttaaaccgggtcgttaacggtccgtaccgtacggacccttaccgttacgttcgtaacgttccgtactttaccccg

SEQ ID NO: 64685 - DNA, 783 bp, Homo sapiens
  misc_feature: GYAE6OF01BLGAX.31.78.H01.1.454.CMB.1.raw
  modified_base (123)..(123): a, c, t, g, unknown or other
  misc_feature (123)..(123): n is a, c, g, or t
tcagcagtagacgtcacgaccggtgctcgatttagtgtgagtagtttgggttgggggagctacaacaggcaggcaggggcagcaagatggtgttgacagacccgagtcttcatttctctgttnctctaggctctcgtggtgaccgtagggacagtcgtgatgacgccgtagttcaagtactcccgtggtctgtcgtctacgtgggcgacggacggccctacagtcaaactgaacgtaactccgaacgccgtagttagtttcgtttaattccggaccccctaaacgaaataaccgtaacttaacgtcgtcctacggtaaccaagtaccgaaagaaacgtaggaccacgtaccctaaccgtaactaccttggtaacctttacggtcggtaacgttcccgtaaacccgggtcgtacccggtttaccccggggttaacccctaaacgggttcttacccggattaccgggacttaacgggtccccggggtagttacggggtaccccttaaagtttcccgaacccgtttcaaccctaacgtacggttacacggtaaccgtcgtacgacgtacgtacggtacgtagaacgtacgttaggtacgtaccttaagtttactaacgttccgtaacgtaagtacctaattaacgtttacttaaccgttttcttaaccgtacgtttaccggtacggttacggggaacggtacggtaaacgggtagtaacgtaacgtaccgtaaacgtacgaggtacgccttacgacgtaaccgtcttcgttaacgtcctacgtacc

SEQ ID NO: 64686 - DNA, 777 bp, Homo sapiens
  misc_feature: GYAE6OF01BQB65.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacgggacatcgtgatgagcctagtttccagacctcccgtggctggtgtctcgtggcgaggcggccacgatcaactgcaagtccagccagtagtttcgttttattccggaccccctaactaaactaaaccgtaaacttactttaacggtccgtttaacggtaacccgaagaaccgtaaagggtaaaaaggttacggaacctaaccgtccccttaacctaaaaccgttccttaggttaacttttacgggtcgggttcctttacccggacccgggtacgttaccggttaccccggggtttaacctaaaccgttagttaccgtagttcgggaccgacggggtccggggttacggtcggggtaacccgttacttttccaccgttccctacgaacccctagaccctaacggccctacggtccgtacgacggacggtacgtaaggaagtacgttggtacggtattagtttacctagtcgtacgtaacgtactaacttacttactttacgtttcgtttaccgtcgttacgttaccgggacggtaacggtacgtaagggtacggtagtaccgtaacggtaaaaccgtgttacggcgttaccgaacggtacctacgttacgttcttacttcgtaccttaccccg

SEQ ID NO: 64687 - DNA, 710 bp, Homo sapiens
  misc_feature: GYAE6OF01DIB8P.31.78.H01.1.454.CMB.1.raw
  modified_base (214)..(214): a, c, t, g, unknown or other
  misc_feature (214)..(214): n is a, c, g, or t
  modified_base (243)..(243): a, c, t, g, unknown or other
  misc_feature (243)..(243): n is a, c, g, or t
  modified_base (472)..(472): a, c, t, g, unknown or other
  misc_feature (472)..(472): n is a, c, g, or t
  modified_base (486)..(486): a, c, t, g, unknown or other
  misc_feature (486)..(486): n is a, c, g, or t
tcagcagtagacgtcacgaccggtgctcgatttagtgtgagtagtttgggtttgggggagctacaacaggcaggcaggggcagcaagatggtgttagcagacccaggtcttcatttctctgttgctcgtggatctcgtggtcgccgtacggggacatcgtgatgacgcctacgttccagactcccgtgctgtgtctcgtggcgaggcggccacntacagtgactaacgtcagcgagtagtttnttttacgtccgacccctaacaagtaacctacttacttacgcgttacggaccagacgaaggtaaaggacgacctacgtacccgtaactaaaccttccgtacgtttagtttaccggcggtaccttacccggtacccggtacttaccggttacccggggtttaaccaaccggtattcgtagttcggcgtacgggtcgtacgtcgggactcttcactctacactatcaggtcncgtcgcgacgacgngtaagacgtacgtggacgtacgttaagtttacgtacgtcgtacaacgttactaaacgttacttactttaccgtttacctttccgtaacgttccgggttacggaccggggtaaccggttaacggaacgggttacggtaacggtaactaccggtaaaaccgttggtaacgggttcggtcctaggaaccccttacgtagttaacccgttgttccccgttacgtaccg

SEQ ID NO: 64688 - DNA, 735 bp, Homo sapiens
  misc_feature: GYAE6OF01EK7O3.31.78.H01.1.454.CMB.1.raw
  modified_base (458)..(458): a, c, t, g, unknown or other
  misc_feature (458)..(458): n is a, c, g, or t
  modified_base (699)..(699): a, c, t, g, unknown or other
  misc_feature (699)..(699): n is a, c, g, or t
  modified_base (729)..(729): a, c, t, g, unknown or other
  misc_feature (729)..(729): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtaggggactagtcgtgatcgagccagtttccagtactccctggctgtgtcctgtgggcgaggacgggccaaccgtaatacaaactcgaactaaggtccacgtaccgagtagtttacgttttactttacggacccctaaacctaaacttaaaccaacttacgtttaacgtaccgtttacggtaacacggataaacgtaaagtaacggaacaccgtcctaaccctaaacctccgtagttactttaacggtcgggtaccgtttaccgtacccgggacgtacgttcccggggttaacctaaccgtattacctagtcgganacggtacgggtcgtcgggaacgttagtttacacgtctaccgaacactacgacgtacgacggtctcggtagacgtctaaggaaacgtagttacgggtcgtacgttaggttttaacttacttgtactacggtaacctaaagttaactttattaaccgtttccgtttacgttacttaccggttttacgggacgggtaacgggacgacggggttaacgaagtaacgtaacgaaacgtagtacggnggtactagacctaccagttacgctttcgtntacccg

SEQ ID NO: 64689 - DNA, 807 bp, Homo sapiens
  misc_feature: GYAE6OF01B4IB5.31.78.H01.1.454.CMB.1.raw
  modified_base (60)..(60): a, c, t, g, unknown or other
  misc_feature (60)..(60): n is a, c, g, or t
tcagcagtagacgtcacgaccggtgctcgatttagtgtgagtagtttgggtttggggganctacaacaggcaggcaggggcagcaagatggtgttgcagacccaggtcttcatttctctgttgctcgtggattctcgtggtcgccgttacggggacatcgtagatcgacgcctagtttccagtaccttccgtggactgtacgtctcggtgggacgaggacggacccacgtatacgaacgtcgactaacgtccagtaccgagttagttttcgttttacgtccggacccctaactaaataacctaacttacgttacggactttacggaccgagacctaaaggtaaacggtacgaacaccggtaccctaaccgtaactccgttagtacgttacgtcgggtccttaccgaccggcttaccggttaccgggtttaaccaacgtcttacgagttcggacgtacgggttcggtacggtacggtaacctacttccaccgtacctaccactacgtacgaacgtcgtaccgtccgtgaacgacggtactaagggaactaggtacgtggttactttacggtttaactcgtacgaactacgttaacaacgttttacttacggttttacccttacggttaccggtttacggttaaccggtttacggggaccggtttaacggaaccggttaagggtaaccggttaaataacccggtaaaccggttaaagttcccgggtaaggttcccgggtaaacttcccggaacctttaaccgtacgggttttaaccctacggttttaaccccgtatttaaccccccggg

SEQ ID NO: 64690 - DNA, 847 bp, Homo sapiens
  misc_feature: GYAE6OF01AQV6N.31.78.H01.1.454.CMB.1.raw
  modified_base (662)..(662): a, c, t, g, unknown or other
  misc_feature (662)..(662): n is a, c, g, or t
tcagcagtagacgtcacgaccggtgctcgatttagtgtgagtagtttgggtttgggggagctacaacaggcaggcagggcagcaagatggtgttgcagacccaggtcttcatttctctgttgctcgtggatcgtctggtcgaccgtacgggactagtcgtgatgacgcctagtttccagtacctcccgttggcttggtacgttccgtcggtacgggcgagggtaccgggaccctaccgtagttaccgaaacgttcgaccgtaaacggttcccaacgcccgtaaggtagtttgtttttaaccgtccggaccccctaacgtaaaactaacgtaaaccttaccgtttacggaccgtttacggtaaccgacgtacgaaacggtaaagtcgggaacctaccggacccttaccgttaaacctccgttagtaacgtttaccggtcgggtaccgttccgtacccgggataacggttcccggggttaccctaaacggtcttaacgtacgttccggacgtacgggttacgggacccgttaggggtacccgttactttccgtaacccgtttccgaaccttacccgacgtttaccgaacggttccgtaacgtccgttaggaccgtacggtacgagtacgttagcgttacggtatttaacgtttactacgttacncgtaactcgaactttaggttacttactttccgttaacgtcgttaaaccggttcgggaacgggtaccgaacggtacgggttacgaaacgttaccgtaaacggaaaccccggttagttcgggtaaccgtacggtaacctacccgtaacttacccggttaactttaccgttcggttaacttacccggg

SEQ ID NO: 64691 - DNA, 693 bp, Homo sapiens
  misc_feature: GYAE6OF01CSXVJ.31.78.H01.1.454.CMB.1.raw
  modified_base (139)..(139): a, c, t, g, unknown or other
  misc_feature (139)..(139): n is a, c, g, or t
  modified_base (639)..(639): a, c, t, g, unknown or other
  misc_feature (639)..(639): n is a, c, g, or t
  modified_base (657)..(657): a, c, t, g, unknown or other
  misc_feature (657)..(657): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtncctacggggacatcgtgatgagccagtttccagactccctggctgtgtctcgtgggcgaggacgggccaccatcaactgcaagtccagccagtagttgttttactcggccccacaataactaactactagcttaggtaccagtacaagaaaggtacggacacgtccctacctaaacgttcctagtacttttacgcgggtcctttcgacccgggctaacgttcccggggttaccctaacggcttccgatttgggaccagggtccggggttctacggggaccgttaatttccgaactccgtacacctagtccagccaacggtcccttgaccgagtaccgtaggaaagtcttaagggtcggttacgtaagttttaacgttaccgtaggttcccgaaaggtaaccttaaacttacgtttaacttttaccgtttacgtttttcccgacgtttaccggtttcgggaacgggtcggaacgtacgggtgaagtacctacggaaaacgngttacgggtcgtaccgtntacccgaacttagtcctttacgtccgttctaacccg

SEQ ID NO: 64692 - DNA, 802 bp, Homo sapiens
  misc_feature: GYAE6OF01A52XA.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccgaggtcttctatttcttcttgttgctctggatctcgtggtcgccgtacgggactacgtcggtagagtacgacgtccgtacgtttaccaggtacccgttcccgtgggtccttggttcgttccgttcggtacggggacgacgggacggaccctacgtactacgaacgtcgacgaacgtcacgactaaggtacgtttagttttaccgtccgaccccctaaactaaactaacctaaccttacgttacgtacgttacgacgagacaaggtaaacgtacgacgacgtacccttaaccgtaactcgttattacgttacggtacggtccgttaccggaccggtacgtacccggtttaccgggtacctaacgttacttacgtaggttcggacgtcgggttcggtacggtacggtactttaccgtttaccaccgttccctacgaaccgttacgtaccgacgtaccacggtccgtaccggacgtacggttagtacggtaaagtcggttcggtacgttacgtttacgtttacgtcgtacgtacgaacgtaacttaacttttacgttactttacccgttttccgttacgttaccttacgggtacgggacggtaacggtaacggtaggtacgtaacgtaaccgtaaacgtacggtacgttcgggacgtccgtacgacttaaccgttcttacgttacgttcccttcggtacccg

SEQ ID NO: 64693 - DNA, 779 bp, Homo sapiens
  misc_feature: GYAE6OF01AZLTO.31.78.H01.1.454.CMB.1.raw
  modified_base (420)..(420): a, c, t, g, unknown or other
  misc_feature (420)..(420): n is a, c, g, or t
  modified_base (482)..(482): a, c, t, g, unknown or other
  misc_feature (482)..(482): n is a, c, g, or t
  modified_base (711)..(711): a, c, t, g, unknown or other
  misc_feature (711)..(711): n is a, c, g, or t
tcagcagtagacgtcacgaccggtgctcgatttagtgtgagtagtttgggttgggggagctacaacaggcaggcaggggcagcaagatggtgttgcacgacccgaggtcttctatttctctgttcgcttcgtgacttcctcgtggtcggtacccgtacggggactaagtccgtagtatggacctaccgttacgttaccaacgtcccgtcccgtggtccgttgtcgttaccgtccggtgggacggaaacggccgggaaccctaaccgtaacgttaccaacgtacgaaccgtaacggtaccccaaggtaccgtaggtacgttttagttttaccgtacccgaaccccaactaaaactaactaacttactacgtcgttacggacagacgaagaacgtacgacaacgtccctaactaactacgtnttaccttcggtcgtacctaccggaccgctaggttcccgttaacgtactagtactagtacggngtaacgggttcggaccgtacgggtaccttacttccaccgttaccaaccgttaccgaataccgacgtaccgacgtaccgtacgacgtaacgttacgtagtaacgtacggtagtacgttacgtttacgtttaacgtcgtaccgataaccgtaactaacttaattaccgttacttaccgttaccgttccggtggttaacccggtacgggaacggtaaccgtaggtaacgaanaagtaacccgtaaagtacgtacgtacggtgtaaacctcgtactactacggtactccgttaagtccccg

SEQ ID NO: 64694 - DNA, 785 bp, Homo sapiens
  misc_feature: GYAE6OF01BD4UU.31.78.H01.1.454.CMB.1.raw
  modified_base (418)..(418): a, c, t, g, unknown or other
  misc_feature (418)..(418): n is a, c, g, or t
tcagcagtagacgtcacgaccggtgctcgatttagtgtgagtagtttgggtttgggggagcctacaacaggcaggcaggggcagcaaggatggtgttgcagacccaggtcttcagtttctctgttgctctggatctctggtacgcctacggggacatcgtagagtgagcctagtttccagacctccgtaggctgtgtctcgtgggaccgaggacgggtcccaccgtagtaccaacgttcgactaacggtccagaccaggtagtttcgttttacgttcggacccctaactaacgtaactaactacgttagtcgttaggaccaggacaacgtaaggtaggacctacgcctaacctaaactcctagtactttacgtggtccttaccgacccggtctacggttacccgggttactaaccgtnttacacgttcgcgtacggtcggtacgtacgggtaccttacgttccgacgtacctaccgaaccgtacgtccgacgtaccgacgtccggtacgtacggtacggtacgtaacggaaacggttcgtacgggttaccggacgtttaacggtttacgtaagttccggtaacgaacgttaccgtaaacttcgtttaactttaccgttttcgttacccggttaccgtttacggttacccgggaaccgggttaccgggaaccgttaggggtacgttaaccggtaacgttaaaccggaacccggttaggtaacggtccggtaccgtacgtaacccgtacttaccggttaccttacggttaccttaccgttaacccgg

SEQ ID NO: 64695 - DNA, 822 bp, Homo sapiens
  misc_feature: GYAE6OF01A18V2.31.78.H01.1.454.CMB.1.raw
  modified_base (445)..(445): a, c, t, g, unknown or other
  misc_feature (445)..(445): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctcgtggtcgccgtacggggactagtcgtgtatggagcctagtttccaagtcctcccgtggctgtcgtctcgtggcgaggcggtaccacatcaacgtcgacctaacgtccgaacgccgtaaggtcgttttgtttttacgttccggacccctaaacgtaaactaaacctaaccttacgtttacgtaccttaggtacccagaccgaaaggtaaaagtacggtactacgtaccccttaactaaaccgttccgtagttaaccgtttacgtcggtacctttccggacccgggtctacccggttccgggtacctaacgtnttcgagtcggctacggtcgggtctacgggtaccttacttcgtaaccctgtacccactaacgtcgacgccgtacggtcctcggacggtacggtacgtaagggtaagtaggtaccggtaggttagttttaaccggttttacgtaacggttccgttaaaccggaaccggttaacctaaacggttttaacttttaccgttttaacccgttttaccggttttcccgttaccgtttaaaccccggggtttgggtaaaccccggggaacggttaaccgggtaaagggtagtaaccgtaaacgttaaccggtaaaaccggtgttaacggttaccgggtactacggtactaaccttggttaccgttccgttccgtaacccgttccg

SEQ ID NO: 64696 - DNA, 739 bp, Homo sapiens
  misc_feature: GYAE6OF01BWNON.31.78.H01.1.454.CMB.1.raw
  modified_base (215)..(215): a, c, t, g, unknown or other
  misc_feature (215)..(215): n is a, c, g, or t
  modified_base (530)..(530): a, c, t, g, unknown or other
  misc_feature (530)..(530): n is a, c, g, or t
  modified_base (731)..(731): a, c, t, g, unknown or other
  misc_feature (731)..(731): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctcgtggactctcgtggtcgccgtacggggacatcgtgatgagcctagttccagcctccgtgctgttctctcgtgggacgagtcggccaacnctacgaacgtcgactaacgtccacgtccgagttacgtttcgttttacgtaccggaccccaacttaaactaaccgtaaccttaccttaggtccgtttacggtaccaggtacgaaagtaaacggtacgaccgtacgtacccttaaccgtaaacgttccgtagtaccgttttacggtcgggtacctttacccggacccggtacgttaccgggtttaccccgggttacctaaccgtatttccgagttcggaccgagggccggttcggtacgggtaaccttacgtttaccaccgtcctaccacgtactacgcgttaaccncgtccgtacgacgccgtagtacgtaagtcgtcggttagtacgtttaagttttacgctacggtatacccgattaccgttaattaccgtttcttacccgtttgttacccgttacgggttcggtaacgggacgtaacgtacgggtataccgtaacgtacggtactaggtcgtaggtcacgtgtaccgttagttcccacgtttcncgttaccc

SEQ ID NO: 64697 - DNA, 670 bp, Homo sapiens
  misc_feature: GYAE6OF01APFXP.31.78.H01.1.454.CMB.1.raw
  modified_base (426)..(426): a, c, t, g, unknown or other
  misc_feature (426)..(426): n is a, c, g, or t
  modified_base (461)..(461): a, c, t, g, unknown or other
  misc_feature (461)..(461): n is a, c, g, or t
  modified_base (468)..(468): a, c, t, g, unknown or other
  misc_feature (468)..(468): n is a, c, g, or t
  modified_base (473)..(473): a, c, t, g, unknown or other
  misc_feature (473)..(473): n is a, c, g, or t
  modified_base (502)..(502): a, c, t, g, unknown or other
  misc_feature (502)..(502): n is a, c, g, or t
  modified_base (632)..(632): a, c, t, g, unknown or other
  misc_feature (632)..(632): n is a, c, g, or t
tcagcagtagacgtcacgaccggtgctcgatttagtgtgagtagtttgggtttgggggagctacaacaggcaggcaggggcagcaaggatggtgttgcagacccaggtcttcatttctctgttgctctggatcctctggtcgccgtacggggacatccgtgactgacgcctacggttttccaggtaccttcccgtggtctgtcgttcgtcgttgggaccgaggacgggcccaccactccaacgtcgacgtacgtaccacgcctaacgtagtttcgtttttacgttccggaccccaactaaacttaactaaccttacgttagtccttacggtaccgagaccgtaagaaaggacggactacgtcctacctaacgtcctagtactttacggcgtcctacgtacccggataccgtccgggtacctacgtntctgtcgtcgacgcggtcgtcggacctactctacnctacacncgtcncgtacacgctgcgacgcgtagagtagtgnggtacttacgttacgtacgtactacgacgtactaattacgttactttacgtttcgttacgttcgttccgtacgggtaccggtacggacggtagggtacgtacacgtacgtaacgtacggtgcgggtaccncgttaacctacgtagttaccttacttccgttactcccg

SEQ ID NO: 64698 - DNA, 757 bp, Homo sapiens
  misc_feature: GYAE6OF01CCVHX.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacgggacatcgtgatgacgacctagtttccacgtactcccgtggctgtcgtctcgtgggcgaggacggccaccgatacaacgtcgactaacgccagccgaggtagtttcgttttacgtccggaccccaactaaataaaccgtaaccttacgttaacgtcttacggtaaccagacgaaggtaaacgtacggtaccgacgtaccctaccttaaacctcttacgtactttacggtcgggtaccttccggtaccccggacgttaccggttacccgggttacctaaccgtattcgtaacgttcggacggtaccgggtccgggttaccgtacgggtaccgttacttaccgccgttacctaccgtaactaacgttcgacgtacgacgtccgtacggcgaacggtactaggaaaggtacggtggtaccggtacgtttaagtttactacggtcgtactaagtactaacttaacgtttcttacgtttaccgttccgtaccttaacgggttcggaccggttaacggaaccgtacgggtagtaaaccgtacgtaacccgtaaggtacgttcgggtgaccgttacgaccgtaacgttcgttaccgtcttaaccgtcgtttaccccgg

SEQ ID NO: 64699 - DNA, 754 bp, Homo sapiens
  misc_feature: GYAE6OF01BLGTE.31.78.H01.1.454.CMB.1.raw
  modified_base (440)..(440): a, c, t, g, unknown or other
  misc_feature (440)..(440): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtcgccgtacggggacagtcgtgagtgacgtcctacgtttccagtaccctccgtggtctgtcgtctcggtcgggcggaggacggacccaactactaccaacgtgacctaacgtccacgcccgtaaggttacgtttaggtttttacgttcccggaaccccctaaaacctaaaactaaacctaaaccttacgttacgtaccgttacggtaacccagtaacgaaggtaaaacgtcgacacgtccctaacctaactctagtacttcggtcggtacctccgtaccggctccggtccggttacctacgtnttctagtcgcgtggtcgggtcgtacggtaccttattccacctaccgacctacgtactccgtacgccgtaccgtccgacggtaccgacggttacgtaaggaacggttcgttcgggttacgttaacgttttagtttaccacggtttcgaactcggtaaccctaagtttacttaaccgttttctttaccgttcgttaacccgttggggttaacccgggagggaaccgtagggtaacggtacgaacgttaaccgaaacggttacccgtaggtcgggctcgtactacctgtacgttaccggttctccgttccgtacccg

SEQ ID NO: 64700 - DNA, 817 bp, Homo sapiens
  misc_feature: GYAE6OF01EH739.31.78.H01.1.454.CMB.1.raw
  modified_base (789)..(789): a, c, t, g, unknown or other
  misc_feature (789)..(789): n is a, c, g, or t
tcagcagtagacgtcacgaccggtgctcgatttagtgtgagtagtttgggtttgggggagctacaacaggcaggcaggggcagcaagatggtgttagcagaccaggtcttcatttctctgttgctctgatctctggtgccgtacgggacagtcgtgatcgacgccgtacgtttccacgtacctccgtcggcgttggtcgttctcggtgggacggaggacgggccacgactacgaacgtcgacgtaacgtccgacgaccgtaaggttaggttttacgtttttacggtttacccggaaccccctaaaacgtaaaaccttaaacctaaaccgtttaaccgtttacggtaccgtttaacgggtaaccaacgtacgaaaagggtaaacgtacgggaacctaaccgttacccttaacccttaaccgtccgttagttaacgtttacggtcggtacccgttacccgggtacccggtacgttaccggttacccgggttaaccctacgtacttcgtagtcggcgacgggtcggtacggtacggtacgttacgttacaccttccgtaccactactacgtacgacgtcgtccgtcgacggtacggtacgtaacggagtacggttcggtacgggttactttaacggttttacgttacgttcgaaccggtataaccttaatttactttaccgttttacctttcgtttccgttaccggtttacgggttaccggggtacgggtaacgggtacgggtaaggtacgggtaactaacgtaaacgaacgttacggtgtacgtccgtacnccgtacttcgatttctcgttactacccg

SEQ ID NO: 64701 - DNA, 765 bp, Homo sapiens
  misc_feature: GYAE6OF01CK877.31.78.H01.1.454.CMB.1.raw
tcagcagtagacgtcacgaccggtgctcgatttagtgtgagtagtttgggttgggggagctacaacaggcaggcaggggcagcaagatggtgttgcagacccaggtcttcatttctctgttgctctggatctcgtggtgccgtacggggacatcgtgatgacgcctagtttccagacctcccgtgggctggtcgtcgtcgtgggcgaggacgggccacgatccgaagtcgacgaacgtccaggcctaggtacgttgtttttacgttccggccccctaaacgtaaataaaccaaacgttacgttacgtaccgtttagggtaacccaggtaccgaaaggtaaaaggtacggaaccgacgttaccccgtaacctaaaacgttcccttaggtacttttaacggtcgggtaccttacccggtacccgggtactaccggttacccgggggttaccctaaccggtacttcgtaacggtttcggacgtacgggtccgggtcgtacgggaccttacgttacaccgttctccgtacacttcgaacgcgtacgcctggacgaggtcgtagtaacgagtcggtaggcttaagtttacgtacgttgtacgaactactaacgtactttaacgtacctttcgtttaccgtccgttacggtttcgggacgggtaacggaccggttaggtaccggtagtaacgtaaccgaaacggtacgtcggttacggaccgtacggtaccgtacccgttagttacggttaccgttcctttcgttaccccg

SEQ ID NO: 64702 - DNA, 454 bp, Homo sapiens
  misc_feature: GYAE6OF01DQ348.31.78.H01.1.454.CMB.1.raw
  modified_base (166)..(166): a, c, t, g, unknown or other
  misc_feature (166)..(166): n is a, c, g, or t
  modified_base (392)..(454): a, c, t, g, unknown or other
  misc_feature (392)..(454): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtcgccgtacggggacattcgtgatggacnctagttccagacctccctggctgtgtctgtgggcgaggacgggccacctatacaactcgactaagtcccagcctaaggtagtttacgtttttacgttacccggaccccctaaactaaaataaaccctaaaccgttaaccgtttacggttaccgtttacggttaaccaacggaaccgaaaaggtaaaaacggtaacgggaaccaccggtacccctttaaaaccccgnnnnnnnnnnnnnnnnnnnnnnnnnnnnnnnnnnnnnnnnnnnnnnnnnnnnnnnnnnnnnnn

SEQ ID NO: 64703 - DNA, 599 bp, Homo sapiens
  misc_feature: GYAE6OF01BJWCG.31.78.H01.1.454.CMB.1.raw
  modified_base (333)..(333): a, c, t, g, unknown or other
  misc_feature (333)..(333): n is a, c, g, or t
  modified_base (348)..(348): a, c, t, g, unknown or other
  misc_feature (348)..(348): n is a, c, g, or t
  modified_base (370)..(370): a, c, t, g, unknown or other
  misc_feature (370)..(370): n is a, c, g, or t
  modified_base (418)..(418): a, c, t, g, unknown or other
  misc_feature (418)..(418): n is a, c, g, or t
  modified_base (422)..(422): a, c, t, g, unknown or other
  misc_feature (422)..(422): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagctccctggctgtgtctcgtgggcgaggacgggccaccatacaactgacaagtccagccaggtagttgttttacgttcggaccccaacaaataacaactacttagcttaggtaccagacaagaaagtaggacacgcctacctaaactcctgtatttacgnggtctcgtacccggntacgttccgggttacctaacgntcagttggacaggcgggtctgggtaccgtatttcactctaccacctanaccnacgacgtcctggacaggctagaagtgtcgtcgacgtagtttacttacgtgtaccagtacaactattaacttacttcctttacgtacttacgttcggacgggtacggaaccgtagggtaggatacgtacgaaacgtacgtggtcggacctgaccgacctagttactctctcgtacccg

SEQ ID NO: 64704 - DNA, 677 bp, Homo sapiens
  misc_feature: GYAE6OF01EAKJR.31.78.H01.1.454.CMB.1.raw
  modified_base (60)..(60): a, c, t, g, unknown or other
  misc_feature (60)..(60): n is a, c, g, or t
  modified_base (385)..(385): a, c, t, g, unknown or other
  misc_feature (385)..(385): n is a, c, g, or t
tcagcagtagacgtcacgaccggtgctcgatttagtgtgagtagtttgggtttggggganctacaacaggcaggcaggggcagcaagatggtgttgcagacccaggtcttcatttctctgttgctctggatctctggtcgccgtacgggacatcgtgatgagcctagttccagacctccctggctgtgtctcgtgggcgaggacggcccacatacaatcgacaacgtccagccagtgttgttttacttccgaccccaacaataactaactacttagcttacgaaccagacaagaagtacgacacgtccctacctaaactcctagtactttacgtcgggtaccttcccggacccggataccgggttccccgggttacctaaccgtnttccgagttcggcgtagggtccgggttcgtacgggtacccgttatttccgacttccctacaacctactccagtccaccgtccgagccgacggtactaggaagtgtcggtcgtaacgtttagttttaacgtacgttcgtacacgtaacttaattactttaaccgttactttccgtttacgttaccgttaccggtttcgggaccggtacggtacgtaagggtgaaactagtaaccgtaaacgtacgtggtaccgcgtacgaccctacgtacgttactacgttccttactacccg

SEQ ID NO: 64705 - DNA, 793 bp, Homo sapiens
  misc_feature: GYAE6OF01C9484.31.78.H01.1.454.CMB.1.raw
  modified_base (167)..(167): a, c, t, g, unknown or other
  misc_feature (167)..(167): n is a, c, g, or t
  modified_base (187)..(187): a, c, t, g, unknown or other
  misc_feature (187)..(187): n is a, c, g, or t
  modified_base (521)..(521): a, c, t, g, unknown or other
  misc_feature (521)..(521): n is a, c, g, or t
tcagcagtagacgtcacgaccggtgctcgatttagtgtgagtagtttgggtttgggggagctacaacaggcaggcagggcagcaagatggtgttgcagacccaggtcttcatttctcttgttgctcgtggatctcgtggtcgccgtacggggacagtcgtgatgacncctagttccaagtcctcccnggctgtgtcctcgtgggacgacggacggaccaccataccaacgtcgacgaacgtccgagaccgaggttagttttacgttttacgttacccggaccccaaaccaaacttaaaactaacctttacgttacgtacgttacggtaaccctagaacgaaggaaaaggtacgactaccgtacccttaaaccctaaccttcgttacgttacttttaccggtcgggttacccttccggaccccggtattacccgggttacccgggttacctaaccgtattaccgtaggtcgcgacgggttcgggtacggtacggtacgttacttcgacctcgtacccaactntacacgcgtaccgcgtcgacgtacggtactaggacgtagttacggtgtaacctttagtttaccgtacgacttacgaaattaaccctaattttacttaaacttttcccttttaccgttttaccgaccgtttacggggttaccgggtaacggggtaccggtaaggtaaaacgggttacggaaaccgtaagtaaaccccgggtaaaagttacggttggaccgttaaccgtcgaacctaccgtttagttcgtttaaccgtctttaacccggtcccg

SEQ ID NO: 64706 - DNA, 913 bp, Homo sapiens
  misc_feature: GYAE6OF01A2S5B.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatggacgcctagtttccagacctcccgtggctgtgtctcgtgggcgaggacggccaccatcaactgacaagtccacgccaggtagtttgttttacgttccggaccccctaactaaactaacctaaaccttacttacgtccgtttaggtaacccaggaccgaaaggtaaaaacggttacgggaacctaacggtacccccttaacccgtttaaaaaccttcccgttaaggttaacgttttttaacccggtcggggttaccttttacccggtaacccccggggtactttaacccgggtttacccccgggggtttaaccccttaaaacccggtagttttaccgtacggtttacgggacctaacggggtcccggggtttaccgtacgggggtaacccgttaacttttcccgaactttcccgtaccgtaacccagttcccgaagacccgtaacgccccgttaggaccgacggtacgtaacgaaacggttacgttgggtacggtactttaacggtttttaacttaccgtagtaccgtaacggtaacctaaacgttaactttaaccgtttaaccgttttccggtttaaccgttaccggttaaccgggttttcggggaaccggggtaacgggtaacccgggttaaggggttacggtaaaccggtaaacggttaaccggtaaaaaccgggttacgttacgggttccggtaccgtacggaccctaaccgttagttaccgtttacggttacccgtttcgttaaccccgg

SEQ ID NO: 64707 - DNA, 757 bp, Homo sapiens
  misc_feature: GYAE6OF01CID4E.31.78.H01.1.454.CMB.1.raw
  modified_base (272)..(272): a, c, t, g, unknown or other
  misc_feature (272)..(272): n is a, c, g, or t
  modified_base (463)..(463): a, c, t, g, unknown or other
  misc_feature (463)..(463): n is a, c, g, or t
  modified_base (524)..(524): a, c, t, g, unknown or other
  misc_feature (524)..(524): n is a, c, g, or t
  modified_base (684)..(684): a, c, t, g, unknown or other
  misc_feature (684)..(684): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctcttggttgctcgtggatctcgtggtgcccgtaacggggacagtcgtgatggtacgaccgtagtttccaaggtacccttcccgtggtctgtcgtcgtcgtcgggacgacggcgggcccaaccatacaacgtgacgaacgtccagccagttagtttnttttacgtcggccccaaactaataaacctaacgttcgttaacgcttacggaaccgtacgaacgtaagaaaggtacggactacgccccttacctaaacctcgttacgtaacgtttccggtaggtccgtttacccggacggtcctaccgggtttacccgggtacccttaacgggtacttacgtagttccgganccggggtaccggtgtaccgggtccttaactcgactcctacgaccagtcagccagtccgtancgagtagagtaagcgtacggcgttactaggttttccttagtccgtacaactacgtaaactgtttaaactttcgtttaccgtttactccgggttaaacgttcgggaacggacggtaaaccgttaggtgtaaaccggaaccttaaccgtaaacgggtttacnggtttaaccgcccggttaacaccgtaacccgttcttaacccggtttcgttaaacccttcggtttaaacccccg

SEQ ID NO: 64708 - DNA, 730 bp, Homo sapiens
  misc_feature: GYAE6OF01BHYXA.31.78.H01.1.454.CMB.1.raw
  modified_base (723)..(723): a, c, t, g, unknown or other
  misc_feature (723)..(723): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagtttaccagacctccctggctggtcgtctcgtgggcgaggcgggaccaccatacaactgacaacgtccagccgagtagttagtttttacgttcggaccccaacgaaactaaacctaaactaacttaagtaccgttaggtaaccaagtacgaaaggtaaaaggtaacggaacacggtaccctaacctaaaccttacctagtacgtttacgtcgggtacccttacggtacccggactacggttacccgggttaccctaaccgtattcctagtacggcgacggtcggtacgtacgggtaaccgtactttacgaccttcgtacacctatacgacgtcacgctcgagacgtcaagaagtgtagtacgtagttaatttagttaccgtacgactaagacgtaaacttacgttaacttaacctttccttttacgtaacgtttaccgggttacggaaccgggttacgggtaaaccgtaacgggtacgggaaattaaaccgtaacgtaaacgttacggtacggtacgtaccgtacgtaacaccgttaaacgttctacgttacccgttntaacccg

SEQ ID NO: 64709 - DNA, 889 bp, Homo sapiens
  misc_feature: GYAE6OF01B5N40.31.78.H01.1.454.CMB.1.raw
  modified_base (168)..(168): a, c, t, g, unknown or other
  misc_feature (168)..(168): n is a, c, g, or t
  modified_base (651)..(651): a, c, t, g, unknown or other
  misc_feature (651)..(651): n is a, c, g, or t
  modified_base (838)..(838): a, c, t, g, unknown or other
  misc_feature (838)..(838): n is a, c, g, or t
tcagcagtagacgtcacgaccggtgctcgatttagtgtgagtagtttgggtttgggggagctacaacaggcagggcaggggcagcaagatggtgttgcagacccaggtcttcatttctctgttgctctaggatctcgtggtcgccgtacggggacatcgtgatcgacncctagtttccagtacctccgtggtctgtcgtctcggtgggacgaggacggcccacataccaactgacctaacgtccaacgaccgtaggttagtttcgtttttacggtccggacccccaaaactaaacttaaacctaaaccgtttacttacggtaccgtttacggaaccgtaacggacgtaaaaggtaaaacggtacgggaacctaaccggtaccccttaacccgtttaaaaccgtcccgttaagttaacgtttttaccggggtcgggtttcccctttaaccgggtaaccccggggtcgtttaacccgggtttacccccggggtttaacccttaaacccggttacttttaccggtaggtttcggaccgggtaccggggttaccggggggttaccgtaaccggggtaacccgtttactttaaccccgtactttaccccggaaaccctacgttaacgtacgaaccgggtccctaacggttcccggngttaaccggagttacgtaacggtaaagttacggtgggtacgttaactttaacggttttaactcggtaactcgaacttactaaccgtttattttaccgttacgtttccgtacggttaccgttacgggttacgggaacgggaacgggtaccgtaggggtaactacggtaacgtaaaccggtaacgggtnttacgggtcgttacctcgggaacctacgttacttgaccgttcttactcccg

SEQ ID NO: 64710 - DNA, 851 bp, Homo sapiens
  misc_feature: GYAE6OF01BULHX.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttctatttctctgttgctctggatctcgtggtcgccggtacggggactacgttcggtagtagtgacgtcccgtaacgttttcccaacgtacccttcccgttcgggtcttcggttcgttccgttacggtcggggacggacgggaccgggaccctaacctacgtaccaacgttcggaccgtaaaccggtacccaaccggacccgtaaggttacggttttcggttttttaaccgtttacccggaccccctaaaaccgtaaaacttaaacccttaaaccgttaccgtttaccgtaccggtttaaccggaacccgagaacctaaaagggtaaacgtaacggacctaacccgtaccttaacccttaaaccgttccgttaagttacgtttacggtccggttaccttacccggtacccgggtcgtaccgggtttaccccgggttaaccctaaccgtacgttacgtaacggttcggacgtacgggtcgggtaccggttacggtacccgttactttcccactccgtaacctaccgtactaccgacgtcgacgtccgtagaccgtagtacgtagtaagtacgtgggtactacgtttagttactacgtacgtactagtacttaagttaacttagtttccgttaccgtttcgttaacgttacggtcgggtacggaacggtaccgagggttacgacgtaactacggtaacgtaggtcgtcgaccgtagaccgtacgtactatcgttcctagttcccg

SEQ ID NO: 64711 - DNA, 852 bp, Homo sapiens
  misc_feature: GYAE6OF01CAR3S.31.78.H01.1.454.CMB.1.raw
  modified_base (753)..(753): a, c, t, g, unknown or other
  misc_feature (753)..(753): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtcgccgtacggggacagtcgtgatggagcctacgtttccacgacctccccgtggtctgtcgttcgtcggttgggacgacgggacgggacccaccagtccaactcgaccgtaacgtccgacgaccgagtaggtttacgtttttacgttccgggacccctaaccaaactaactaacttacgttacgttcgttacggtaccgagacaacggtaaaggtacggactaccgtaccttaacctaacgttccttagtactttacggtcggtacgttaccgtcccgggtactaaccgggttcccggggtttaccctaaccgtcgttcgtacgttcggacggtacgggtcggggtacgtacgggtaacccgttacttaccgtaccgtctacctactaagtccaccggtacgacccggtcctacggtcgacgggtaacgtacggtaaaggttacgtacgggttacggttaacgtttacgttttaagtacccgtttaacgttaccgtaacccgtagtttaaacttaaaccttttccgttttaccgttttaccccgtttaacggttcccgttaaccgggtttcccgggaaccggggaacgggttaacccggggtggtaaaccggttanaacggtaaaccggttaacccgttaagggtcggggttacgaacccgttggtaaccccttacggttacttccggttaccgtttaccgttccgttaaccccg

SEQ ID NO: 64712 - DNA, 191 bp, Homo sapiens
  misc_feature: GYAE6OF01EM3F3.31.78.H01.1.454.CMB.1.raw
  modified_base (126)..(126): a, c, t, g, unknown or other
  misc_feature (126)..(126): n is a, c, g, or t
  modified_base (133)..(134): a, c, t, g, unknown or other
  misc_feature (133)..(134): n is a, c, g, or t
  modified_base (136)..(138): a, c, t, g, unknown or other
  misc_feature (136)..(138): n is a, c, g, or t
  modified_base (140)..(141): a, c, t, g, unknown or other
  misc_feature (140)..(141): n is a, c, g, or t
  modified_base (143)..(191): a, c, t, g, unknown or other
  misc_feature (143)..(191): n is a, c, g, or t
tcagcagtagacgtcacgaccggtgctcgatttagtgtgagtagtttgggtttgggcacagcagccctgggctgcctggtcaaggactacttccagttctactgctggagcgggctggacaaggcncataggnngnnngnngnnnnnnnnnnnnnnnnnnnnnnnnnnnnnnnnnnnnnnnnnnnnnnnnn

SEQ ID NO: 64713 - DNA, 701 bp, Homo sapiens
  misc_feature: GYAE6OF01BH6X0.31.78.H01.1.454.CMB.1.raw
  modified_base (634)..(634): a, c, t, g, unknown or other
  misc_feature (634)..(634): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgacgcctagtttccagacctcccgtggctgtcgtctcgtgggcgaggacggccaactagtcaacgtgacaacgtccagacgtagtagttagtttttacgttccggacccctaaactaaacgttaaaccaacttaaccgtttagtcctttacgggtaacctagaactaaaggtaaaagtaccggaactacggtacccttacctaaactcctagtactttacgcggtacttccggaccgggtctaaccggttcccggggttacctaacggtacttacgtagttcggcacgggtcggtcgtacgggtcctaagttcaccgtcaccactacgtacacgactacgtcctgtaccgagtcgtaaggaagtcgtggtagtacttagtttacgtcgttcgtacgagaactaacttagttaacttacttttcgttaccgtaccgttacggttacgggacggtaacgggacgtagggtacggtanaacgtaacgaaacggtagttacggtcggactacgacctaacgtcttaccgttctacgttccgtaccg

SEQ ID NO: 64714 - DNA, 921 bp, Homo sapiens
  misc_feature: GYAE6OF01CGNTP.31.78.H01.1.454.CMB.1.raw
  modified_base (204)..(204): a, c, t, g, unknown or other
  misc_feature (204)..(204): n is a, c, g, or t
tcagcagtagacgtcacgaccggtgctcgatttagtgtgagtagtttgggtttgggggagctacaacaggcaggcaggggcagcaagagtggtgttgcagacccgaggtcttctattttctcgttgttcgctctggtactctcgtggtcgaccggtacgggactatcgtgactgacgtacctacgtttccgacgaccgttccgnggtcgttgtcttcgtcggtacgggacggacggaccggacccacctaacgtaccgtaacgtacgtaccgtaacgttacccgacggtaccgtaggttacgtttttacgtttttaccggtaccccggaaccctaaacctaaaccttaaaccgttaaccgttaaccgttacggtaccgtttaacggaacctaacgggacgtaaaagggtaaccggtacggaccgttaaccggtacccttaaaccgttaaccgttcgttacgtttaacggtttacgtcggttacccggttaccggaccgtacgttaccggttcccggtaactaccgtatacgtacgtcgacggtacggtcggtccggtagtacccgttatttaccgtaccgtcctaccgtaacgtacgtacgaccggtactccggtacaccggtaggtaccgtacggtaacgtaacggttacgcggttaaacccgttagttttaacgtttacgaccgtttaataaccggtaacttaaccgttaaacgtttttcttaaccgtttccgttttacgtaacccgttccggttaccgggtttacccggaagggtaacccgggttaagttaacggggcccgttaaaaaccggacgttaaaacccgggttaacgttagggtacccgggtaccgttaccgtaccggtaccctaaacggttttccgtcccgttacttaacccggtttaccccgtaaccccg

SEQ ID NO: 64715 - DNA, 892 bp, Homo sapiens
  misc_feature: GYAE6OF01AN24T.31.78.H01.1.454.CMB.1.raw
  modified_base (210)..(210): a, c, t, g, unknown or other
  misc_feature (210)..(210): n is a, c, g, or t
tcagcagtagacgtcacgaccggtgctcgatttagtgtgagtagtttgggtttgggggagctacaacaggcaggcaggggcagcaagatggtgttgcagacccagtcttcatttctctgttcgctctggatctcgtggtcgccggtacgggactacgttcgtagatgacgtccgtacgtttccgagtcctccgtgtctgtcgtcgtccgnggcgacggcggccactatcgactgcaacgtcgacgccgaggttacgtttagttttacgtcccgacccctaaacgtaaacttaaccgtaacgttacgtttacggtaccgttaccggtaccgtaacgtaacgtaaacggtaaacgggtaccggaccgtacccgttaccctaaacccgttttaaccgtccggttaacgtttaacgtttacgggaccgggttacccgttaccggtacccgggtaccgttacccgggtttaccccggggttacctaaccgttcgtttaccgtacggttcggaaccgtacgggttccgggttacccggttacggaacccgttttaccgtttaccgaccttacccggtccctaaccgttaacgttacccggaaccgtacccgtaccggttacccggaacggttacccggtacgggttaacggtaacggtaaacgggttaactcgggtttaaaccgttacgtttaccgttttaacggtaccgtttcggaactaccgttaacgttacgtttaactttccgtttaccgtttcgttaccggtttaccgacggggtttacccggaacgggttaaacgtccgggtaaagtcgtaaaccgtaaccgtaacggtaactcgggttactcggtaccacggtacctacgttcgtaacgtttccgtccttacggtaccccg

SEQ ID NO: 64716 - DNA, 906 bp, Homo sapiens
  misc_feature: GYAE6OF01AVO3V.31.78.H01.1.454.CMB.1.raw
tcagcagtagacgtcacgaccggtgctcgatttagtgtgagtagtttgggtttgggggtaggctacaaacaggcaggcaggggcagcaagatcggtgttgcagacccaaggtcttcatttctccttgttgctctaaggtatctcgtggtcgccgtacggggactagtccgtgatgagccagttccaagacctccgtggctgtcgtcctcgtggcgaggtcgggacccactaccgtcaaactcgacaaacgtccgacgccgtagtaggttacgtttttacgttccggacccccaaacctaaacgtaaaccgtaaccttaacgtttaacggtccgtttaggtaaccccgtaagtaccgaaagggtaaaacggtacgggaactaccggtacccccgttaacctaaaaccgttccttaggttaacgttttacggtcggggttaccctttacccgggtaccccgggacgttaacccggttccccgggggtttaacccttaacccggtactttaccgtaggtttccgggaccgtaacgggggtccggggttaccggtacggggtaacccgttagttttcccgaccttacccgtaaccaaccctagtacctacggaccgtaccggtaccgtcggtacgacgggtcgtaacgtaaacggtgttacggttcgggtactttaaacggttttacgttaccgtacgtacgaacgtaaccttaaacccgttaattttccgttttaacctttccggttttacccgttaccggttaccggtttacgggggaacccggggtaggtaacccggtagggggttacgtaacgggtaacccgttaaccggtaaaaccgtccgggttggttcgggaccctacgtacccgtaaccttcgttaccgttccgttaccgttccttaacccg

SEQ ID NO: 64717 - DNA, 856 bp, Homo sapiens
  misc_feature: GYAE6OF01CMCQS.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacgggacatcgtgatgagcctagtttccagtacctcccgtggcttagtgttcctcgtgggacgaggtacgggcccaccgattccaaacgtgtacgaacgtccacgcagtacgtttgttttaacgtccggaccccaactaaactaactaaaccgttacgttaacggtacgtttacggtaacccgtaacgtacgtaaacgtaaaaggtacggtaaccgtacggtaccccgttaacccgttaaaacccttacccgttacgtacgttttaaccggtcgggttacccttacccggtaccccgggtacttaaccgggttccccggggttaccctaaaccggttacttccgaaacggtttcggacgtaacggggtcgggttccggtaacgggtaccgttaacgtttacccgacgttccgtacctaaccgacgttccgtaagcccgtaacgtcccgtaacggtaccgagggtaccgtaaggaacggtacgttacggttacggtacttaccggtttttaacgtttaccgtccgttaacggtaacccgtccgtaaaacttacgttttaaccgtttaaccgtttaccgttttaaccgtccggttacggtttaccgggacggggtaacggtaaccgtaaacgggtacgtaaaccggtacgtaaccgtaaacgtagttcggtacgtccggtactacctaacgttactgttacgtttctccgtaccg

SEQ ID NO: 64718 - DNA, 889 bp, Homo sapiens
  misc_feature: GYAE6OF01C7CHG.31.78.H01.1.454.CMB.1.raw
  modified_base (421)..(421): a, c, t, g, unknown or other
  misc_feature (421)..(421): n is a, c, g, or t
  modified_base (470)..(470): a, c, t, g, unknown or other
  misc_feature (470)..(470): n is a, c, g, or t
tcagcagtagacgtcacgaccggtgctcgatttagtgtgagtagtttgggtttgggggagctacaacaggcaggcaggggcagcaagatggtgttgcagacccaggtcttctatttctcttgttgctctggatctctggtcgccgtacggggacattcggtgagtgagcctaacgtttccgaacgtaccttcccgtgggtccttgtcgttcctcggtgggacgagggacgggcccaacctagtacaacgtcgacctaacgtccaacgccaaggtagttttagtttttacgttacccggaccccctaaccaaagttaaaacctactttaaccgttacgtaccgttacgggtaacctagacgtaaaggaaaacggtacggaccacgtaccccttaacctaaaccttcctagttactttacggnggttaccctttaccggaccggtctacgggtccccggttacctaaccgtnttcaaggtttcggacgtaccgggttcgggtcttaccggggtacgtttaaccttccaccgttccttacccgaaacctatacccggtaccggcgaacccgtccgtacggtaaccgtacggacgttaacgtaaacggtagttacgggtaggttaccctttaaggttttaacgttacgtccggtacctaacggtaacctttaaacgtttacgttttaaacttttcccgtttacgttttacccggttaccgtttaaccgggtttaccggggtaaccggggtaacggggttaaccccggtaaaggggttaaccgggaacggttaacgtaaaccccggttaaaaccggtacggttagggtaccgtccggacgttaacccgtaaccgtttaacgttccgtttaccgttcccgtttcccttaccccgg

SEQ ID NO: 64719 - DNA, 762 bp, Homo sapiens
  misc_feature: GYAE6OF01CQQ74.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtctccatttctctgttgctctggatctcgtggtcgccgtacggggacatcgtgatgagcctagtttccagcctccgtggctgtcgtctcgtgggcgaggacgggcccaaccataccaacgtcgacaacgtccacgtaccaggttagtttcgttttacgttccggacccctaacaaacttaaacctaacttacttacgtcgttacggtaaccagacgtaaggaaaagtacggacacgacccttaacctaaacttcctagtacgtttaccgcggtaccttaccggaccggtctacggttcccgggtacctaaccgtatcgagttcggacgtacggtcgggtcgtacggtaccgttacttccgaacttcacctaccagtcacgactacgtcgtacggacgacggtacgtaaggaagtacgtcggtaggtacctttaaggtttaacttcgtacgtacgaacgaacttaaagtttaacttacgtttaccgtttccgtttaccgttaccgttaacgggtttccgggaacggggtaaccggtaaccgtaggggtaacggaacgtaaaccggttaaaaccggaaaccggttaaggttcgggtaacgttccgaccggttaacctaccgttacgtttaccgttcgttaccctttacggtaaccccg

SEQ ID NO: 64720 - DNA, 869 bp, Homo sapiens
  misc_feature: GYAE6OF01AXBW4.31.78.H01.1.454.CMB.1.raw
tcagcagtagacgtcacgaccggtgctcgatttagtgtgagtagtttgggtttgggggagctacaacaggcaggcaggggcagcaagatggtgttgcacgacccaggttcttcatttctcttgttgctcgtggatctcgtggtcgccgtacgggacagtcgtagatcggacgtcctacgtttccgaacgtcccttcccgtggtcttggtacgttccgtcggtcgggcggaagggaccggccctaactaacctacaacgtcgaaccgtacgtcccgacgaccgtaggtttaacgtttttcggttttacgttccccggaacccctaaactaaaactaacctaacttaacgttacgtaccgtttacggaccagacgaaaggaaggtcgacacgttcccgtaaacctaccgtccgtagtactttacggcggttaccgttaccggaccggtacttaccgggtttacccgggttaacccttacgttacggttacgtacgttccggtaccgtaacggggtccggttccggttaaacgggtacctttacgtttacccgtaccgtttaccctaacgacccgttaacgccggtaaccgtcccgtacggtcccgtcggtaaccggtacggttacgtaacggtaacggtacggtttacggttacggtttaaccgttttaacgttttaacgtttaccgtacgtaccgtaactaaccgttaaactttacgtttactttaccgttttacgttaccgttaccggtttaccgggttaccgggacggtaccgggttacgtaacgggtagtaaccgtaacgtaacggtaaccggtatacgggtcgtcgtaaacggtcctaccttcgttccgttcttccgttcgtcccg

SEQ ID NO: 64721 - DNA, 802 bp, Homo sapiens
  misc_feature: GYAE6OF01AZP5I.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagacctccctggctgtgtctcgtgggcgagagggccacatcaactgcaagtccagccagtagttgttttattcggccccaacaataacaacttacttagcttaggtaccagacaagaaagtaggacacgccctacctaaactcctagattttacgtcgggtccttaccgtaccccgggatacggttcccggggttaccctaaaccggtactttaccacggtttacgggaccgtaacgggtccgggggttaccgttacgggggtaacccgtagtttttacccaaccctttcccgtaccctaaaccctaaccgttaccgaaaccggtacctaccggaccccgttacggacccggaacgggttacccgtaacgggtaaacggtaacgtttacgggtacgggtacgttaacgtttttaaacgtttaaccgtttacggttacctaacggtaacccgtaaaccttaagttttaaacctttaccttttaccgttttaccgtttaccgttaccggttttaccgggaccgggtaacggggaaccgtaacgggttaggaaacgtaacgtaacgtaaaaccgtaacgttacgggtcgggtacgtacgtaccgtactagttaccttcgtttccgttactaccg

SEQ ID NO: 64722 - DNA, 745 bp, Homo sapiens
  misc_feature: GYAE6OF01BOTY1.31.78.H01.1.454.CMB.1.raw
  modified_base (722)..(722): a, c, t, g, unknown or other
  misc_feature (722)..(722): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctcgtggtgccgtacggggacatcgtgatggacgcctagtttccagtacctcccgtggctgtcgtctcgtgggcgaggacggccaccatcaactgacaacgtccgagccagtgtttgttttacgttccggacccctaactaaataaacaacttacgttacgtcgttcggaaccagacaaaggtaaaggtacgaccacgtaccctaacctaacctccttagtactttacgtcgggtcctaccggtacccggtctaccggttcccgggttacctaaccgtattcgtacggttcgacggtcggtacggggttctcggggtacctttctttaccgtactccgtaacctaaccgtacgtacgcgaccgtacgtccgtacggaccgtacggttacgaaggtaacggtggttacgggtacggtcgtttaaagttttaacgttccgtacggtaacctaccgtacttaaaccttacgtttaactttccgtttacgtttccgttaccgttacgggttaccgggaacggggtaccggtaacgttaaggggtacgtaacgtaacgtaacgaaacggttaggtcggtccgcctcggactacgtnttctttcgttacttccgttaccg

SEQ ID NO: 64723 - DNA, 827 bp, Homo sapiens
  misc_feature: GYAE6OF01C48MI.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgacgcctagtttccagacctcccgtggctgtgtctcgtgggcgaggacggcccaccatacaactgactaacgtccacgccaagtagtttgttttacgtccggaccccaactaaataaacctactacttacgtcttacggtaccagacaaggaaagtacgacacgacccttacctaaactcgtagtatttaccggcggtaccttccgtacccgggctaccggttacccgggttacctaaccggtacttcgtaacgttcggacgtacgggtcgggtccgtacggggtaaccttacttccgtacctcctacgaaccctagtaccgacgtaccgaacgtcccgcggtacgtacgggtacctaaggtaacgtacggttcggtacggtacttaaggttttaccttacgtcggttaactaacgtaacctaaacgtttaacttttaacccgtttaccgtttttacccgttttccggttaaccgtttaccggggtttaccccgggggtaaccggggtaacccgggtaacgggttaaacggggttacggtaaaccgttaaacggtaaacccggtaaaaacccggttcgggttacgggtaccgggttaccgttaccggtaaacccctacggttaaacgtttccggttaacccgttttaccgtttccgttaaacccccgg

SEQ ID NO: 64724 - DNA, 748 bp, Homo sapiens
  misc_feature: GYAE6OF01BJTO5.31.78.H01.1.454.CMB.1.raw
tcagcagtagacgtcacgaccggtgctcgatttagtgtgagtagtttgggtttggggggagctacaacaggcaggcaggggcagcaagatggtgttgcagacccaggtcttcatttctctgttgctctggatctctgggtgcctacggggacatcgtgatgagcctagtttccagacctccctggctgtgtctcgtgggcgaggacgggcccaccatcaatgacaagtccagccaggtagttgttttattcggccccaacaataacaactacttagcttggtaccagcaagaagtaggacacgccctacctaaactctagtactttacgtgggtccttccgtacccgggctaccggttcccggggttaccctaaccgtcttacgtagtttcggaccgagggtccggggttaccgtacggggacccgttatttccaccgttcctaccgaaccctagtccagtaccacgtacccgtcgccgtagggtccgtaggaaacgtacgtgggtacggtaccgtttagttttaacgttacgttcggtacgaacggtaacctaacgttacttttaactttaccttttccgttttacgttacccgttacggttttaccggggaccgggggtaaccgggtaaccggtaaggggttaggtaccggtaaacgttaccggtaaaaccggtaacgtttcgggtcgggacccttacggaaccctaccgtagtttacccttacggttcccttaaccttaccccgg

SEQ ID NO: 64725 - DNA, 697 bp, Homo sapiens
  misc_feature: GYAE6OF01BG0WU.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagacctccctggctgtgtctcgtgggcgaggacgggccaccatcaactgacaagtccagccagtagtttgttttattccggaccccaactaaactaactaacttacttagcttcggtaccagacaagaaagtaggacacgtccctactaaactcctagtactttacgtcgggtccttccgtacccggctacgttcccggggttacctaaccgtattcgagttcggactagggtccgggttcgtcggggtacccgtatttccaccttctacctaacctatccgacgacgacgtcccgtgaccgacggtacgtacggaaagtgtggtcgtacgttagttttactacgtacgtacacgtactaacttattaacttacctttcgtttaccgttaccgttacggtttccggggacgggtacgggtaaccgtaaggggttaggaacgtaacgtaaccggaaaccgttaggtcgggtacggtccgtacggaccctaacgttacgttacgttcgtttaccgttccgttacccg

SEQ ID NO: 64726 - DNA, 732 bp, Homo sapiens
  misc_feature: GYAE6OF01AKWT9.31.78.H01.1.454.CMB.1.raw
  modified_base (528)..(528): a, c, t, g, unknown or other
  misc_feature (528)..(528): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgacgtcctagtttccagacctccctggctgtgtctcgtgggcgaggcggccaccatcaactgacaacgtccagccagtagttgttttacgttccggacccctaacaaataacctaaccttacttacgtccgtttacggtacccagacgaaaggtaaaggtacggacacgtaccctaacctaaaccttccgtagtactttacgcgggtccttaccggtacccgggcttaccggttcccggggttaccctaacgtcttcgtagttcggacgtacgggccgggttacgtaccgggacctaagtttccaccgttctacctactactccgacgccgacgtccgtaggccgagtacgtagaacggtacgtacggnggtacgttacgtttagtaccgtacgtactaacggactaacttaacgttaccgtttacctttccgttacgttacggttacggtttacgggaaccgggtaacgggtaaccgtaggggtacgtaccgtaagtaacccgtaaacggtcgttcggtcggtacgtacgtaaccgtaccgttactacgtttcggttacttcccgtaacccg

SEQ ID NO: 64727 - DNA, 730 bp, Homo sapiens
  misc_feature: GYAE6OF01EU470.31.78.H01.1.454.CMB.1.raw
  modified_base (408)..(408): a, c, t, g, unknown or other
  misc_feature (408)..(408): n is a, c, g, or t
  modified_base (414)..(414): a, c, t, g, unknown or other
  misc_feature (414)..(414): n is a, c, g, or t
tcagcagtagacgtcacgaccggtgctcgatttagtgtgagtagtttgggttgggggagctacaacaggcaggcaggggcagcaagatggtgttgcagacccaggtcttcatttctctgttgctctggatctctggtcgccgtacggggacatcgtgatggagcctagtttccagacctcccgtggctgtcgtctcgtgggcgaggacgggcccaaccataccaacgtcgacaacgtccaagaccaaggtagtttcgtttttaacgttccggacccccaactaaactaaccaacttacgttagtcttacggtaccagacaagaaagtacggacacgtccctacctaactctagacgtttacgtcgggtccttccggacccggctacggttcccgggttacctaacgtnttacgngttacggcgtacgggtcgggttcgtaccggggtaccttacgtttaccacttcccaccgaacctacgtaccgacgaccgcgtcccgttcgaccgagggtactaggaaacgtgttggtaacggtacgtttaagttttacttacgttacgtactaacggtaacctaacgttaatttaacctttacgtttcccgtttacgtaccgttacggtttacgggaccgggtaacggtaccgtagggtacggtacgtaacgtaaccggtaaacgtagttggtcgccgtacgtaccctacgttacttacgttcgtcttccgtaaccc

SEQ ID NO: 64728 - DNA, 934 bp, Homo sapiens
  misc_feature: GYAE6OF01DG2AH.31.78.H01.1.454.CMB.1.raw
tcagcagtagacgtcacgaccggtgctcgatttagtgtgagtagtttgggtttgggggagctacaacaggcaggcaggggcagcaagatggtgttgcacgacccaggtcttctatttctctgttgctcgtggatctcgtggtcaccggtacgggacagtcgtgatgacgacctacgttccaacgtccgtcccgtggtcgtggttcgttcgtcggtacgggacggaacgggaccgggacccaacctacgtacctaacgcgtaacgaaccgtaccacgaccgtagttaagtttcgttttaacgttcccgaccctaacctaaataaacctaacgttacttacgtacgttacgtaaccagacgaaagaacggtaacgactaccgtacccttaaccgtaaacgtcttagttacgttacgtcggttaccgttcccggtaccggtacgttacccgggttacccggttaaccctacgtacgttactacggttcggacgcgggttacggttacggacggttaacccgtttacttacccgtacttcccgtaccaccttaagtaccgacgtaccgacggtaccgtacgaccgggtactaagggtacggtaaagtacggtttcggaccgggtttaaactttaacgggtttttaaccacgtttaccggtaaccgttaaacgttaaacgttaaacttttaacgtttttaaacctttacccggtttttacccgtttaccggttttaacccgggtaccggggtttttaccggggaaaccgggggttaaaccgggttaaccggggttaaacgggtaaacgggttctaaaaacccggggttaaacccaaaccggggtttagggtccggtacgggtttaaccccctacgttaaaccccgtacttttacggttacccgttttacgtttcccccgtacccgttttaaccccccgg

SEQ ID NO: 64729 - DNA, 830 bp, Homo sapiens
  misc_feature: GYAE6OF01CBHK3.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccctagtttccagtacctcccgtggctgtgtctcgtgggcgaggacgggccaccatcaactgaccaagtccagccagtagtttgtttttagttccggaccccaaccaaataacctaaccttacgttagccgtttaggtaaccagacgaagtaaaaggtacggactacgaccctaacctaaaccgtccttagtaactttaccggtcggtacctttaccgtacccggggtctaccgggttcccggggttaccctaaccgtacttcgtacgttcggaccgtacgggtccgggtcgtacggggtacccttagtttccgacttcctaccaccgtactccgaagcccgtacggtcctacggccgtaagggtctaacgggaaagtacggttggtaccgggtacctttaaggttttaccttaggttccgtaacgtaagaaccctttaaagtttaacctttactttttacccgttttacccgttttaccgggttacctttaacccggggtttgggggtaacccggggtaaccggggtaaacccgggtaaggggttacggtaacgttaaaccgttaaacccgggtaaacggtaacggtttcggggtacggtaccctaccggtaaccccgttaacttcccggtttaccgtacgtttttcccggtaccctttacccccgg

SEQ ID NO: 64730 - DNA, 646 bp, Homo sapiens
  misc_feature: GYAE6OF01BWSL9.31.78.H01.1.454.CMB.1.raw
  modified_base (139)..(139): a, c, t, g, unknown or other
  misc_feature (139)..(139): n is a, c, g, or t
  modified_base (167)..(167): a, c, t, g, unknown or other
  misc_feature (167)..(167): n is a, c, g, or t
  modified_base (445)..(445): a, c, t, g, unknown or other
  misc_feature (445)..(445): n is a, c, g, or t
  modified_base (500)..(500): a, c, t, g, unknown or other
  misc_feature (500)..(500): n is a, c, g, or t
  modified_base (506)..(506): a, c, t, g, unknown or other
  misc_feature (506)..(506): n is a, c, g, or t
tcagcagtagacgtcacgaccggtgctcgatttagtgtgagtagtttgggtttggggggagctacaacagggcagggcagggggcagcaagatggtgttgcagacccaggtcttcatttctctgttgctctggatctcnggtgccgtacggggacatcgtgatgacnccagtttccagtacctccctggctgtgtctcgtgggcgaggacggccaccatacaatcgacaacgtcacggccagtagttgttttatccggaccccaaactaataaacaacttactagtcttacggtaccagacaaagaagtaggacagtcctacctaaactctagtacttagtacgggtcttaccgaccggacgtacggtaccggggttacctaacgtattacgagttcggcgtaggcgggtcgtacgggactactttacgactctaccacacgtanacgcacgctacgcgtagcgtagaagtatgtacggtacgttaagttacttaacgtntacganaactaactaagttacttacttacgttacttacggtacgttcggacgggtaggtaacccggtaaggtacgtacgaacgtaacgaaacgtaggataccgggactacgacctacgtacgtacgttcgttacgttcgtaacccg

SEQ ID NO: 64731 - DNA, 819 bp, Homo sapiens
  misc_feature: GYAE6OF01D6I0F.31.78.H01.1.454.CMB.1.raw
  modified_base (482)..(482): a, c, t, g, unknown or other
  misc_feature (482)..(482): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacagtcgtgatggagcctagtttccagacctccctgggcctggtcgtctcgtcggggcgaggagggcccaccatacaacctgactaaaggtcccagacccgagtaggtttggttttaactttccggaccccctaaataaacttaaaacctaacttaaccgtttacgacgtttacgggtaaacccaggaacctaaggaaaaccggtaggaacctacggccctttaaccccgtaaaaatccccgttaggtaattttacccggtcggggtacctttaccccgtacccccgggggtactaacggggtttcccccggggtttacttaaaaccccggtntttaccgttaacgtttcgggccgttaagggcccggggtaccttacggggtaccgttaactttccgaacccttaccgtcgacccgttaatcgaccgcgaacgtccgacggttacaacgggtcgtaacggaacgtaagtcgggttaggtacgttaggttttaaacctacgttgtaacctaggtaaccaaactatttaacgtttacctttagttccttacgtttaccggttacgaccggggtacggaacgtagggttacgacgtataacccggtaaacgaagttgggtaacgtccgtaacgaccgaaacctgtaaccgtttcgtaaccctttgtaaaccc

SEQ ID NO: 64732 - DNA, 907 bp, Homo sapiens
  misc_feature: GYAE6OF01CIUTY.31.78.H01.1.454.CMB.1.raw
  modified_base (132)..(132): a, c, t, g, unknown or other
  misc_feature (132)..(132): n is a, c, g, or t
tcagcagtagacgtcacgaccggtgctcgatttagtgtgagtagtttggggtttgggggagctacaacaggcaggcaggggcagcaagatggtgttgcagacccaggtcttcatttctctgttgctcgtggntctcgtggtcgccggtaacggggactgtgtgactggacgtcctacgtttaccgagtcctcccgtggcttgtgtctcggtgggagaggacggacccaacctactacaactacgaaccgtaacgtaccgacgtaccgaaggtttaggttttacgttttaaccggttaccccggaaccccctaaaactaaaacttaaaaccgtaaaccttaaccgtttacggtacccggttaacggtaacccgaaacggaaccgtaaaaggggtaaacggtaacggaacccgtaactacccccttaaaaccgttaaacctttccgttaacggtttaaccgttttcccgggacgggttaacccgtttacccgggtaccccggtaccggttacccgggtttaccccgggttacctaaaccgttcgtacgtacggtcggaccgtacgggtccggggttaccggtacgggtacccttagttaccctacgttacccgtcctaaacctcgactacggtaccggtccggtaccggtcgtacgaacggtacggtaaggtaacggtagtacgggtccggttaacgtttaacttttaaccgttacgtacgtaaccgtaacgtaaccctaaagttacttttaaccgtttaccgtttccgtttaacggttacgttccgggtacgggtaacgggtacggaacgttaacggggtagtaacgtaaacgtaaccggaaaccgttgggtaccggtcgtaaccgacgaacgttccgtaacttcggttacgttacctccggttaccc

SEQ ID NO: 64733 - DNA, 842 bp, Homo sapiens
  misc_feature: GYAE6OF01DO6GF.31.78.H01.1.454.CMB.1.raw
tcagcagtagacgtcacgaccggtgctcgatttagtgtgagtagtttgggtttgggggaggctacaacaggcaggcaggggcaggcaagatggtcgttgcagacccaggtcttcatttctctgttgactctggactctctaggtcgccgtacggggacatcgtgatgagccagtttccagacctcctggcttgtgtctccgtgggacgagacgggcccacccgatccaacgtcgaccgtaagtccgagaccgaaggtagtttaggtttttaagttccgggacccctaacgtaaacttaaacggaacctttaacgttaagacgtttcggaaacccgagtacggaaacgtaaaacggttacggaaccaacgggtaccctaaccgttaaacctccgtacgttaacgtttacggtacggtacctttaccggacccgggtataccggttacccggggtacctaacccgtagttaccgtagttcgccgtaggtcccgggttactcgggtaacccgtagtttcccagttcccgtaccgtaccaagtttacccggagtacccgacgttacccgtcggacgtaccggtagaggtacggtaacgttggtaccggtacgttaggtttttacgttaacgtcggttaaccgtacgaaccgttacgtttaaagtttaactttacccgtttttacgttcccggtttaacttaacccgggtttcggggtaaccgggttaaacgggtaccccggtaaaaggggttccgacggttaaccgaaccgttaaaaccggaggttttagacccggttacgtacgtaaccctaccggttactacggttcttaccgttctaacccgg

SEQ ID NO: 64734 - DNA, 760 bp, Homo sapiens
  misc_feature: GYAE6OF01CTKZI.31.78.H01.1.454.CMB.1.raw
  modified_base (585)..(585): a, c, t, g, unknown or other
  misc_feature (585)..(585): n is a, c, g, or t
  modified_base (721)..(721): a, c, t, g, unknown or other
  misc_feature (721)..(721): n is a, c, g, or t
  modified_base (727)..(727): a, c, t, g, unknown or other
  misc_feature (727)..(727): n is a, c, g, or t
  modified_base (735)..(735): a, c, t, g, unknown or other
  misc_feature (735)..(735): n is a, c, g, or t
  modified_base (742)..(742): a, c, t, g, unknown or other
  misc_feature (742)..(742): n is a, c, g, or t
  modified_base (746)..(746): a, c, t, g, unknown or other
  misc_feature (746)..(746): n is a, c, g, or t
tcagcagtagacgtcacgaccggtgctcgatttagtgtgagtagtttggggtttgggggagctacaacaggcaggcaggggcagcaagatggtgttgcacgacccgaggtcttctatttctctgttgctcgtggatctcgtggtcgccgtacggggactagtcggtgtagtacggacgtaccctacggtttaccgaacgtcccgtcccgtgggtcttggttcgttccgtcggtcggggacggacgggacgggacccaaccgtaactaccaacgtcgacgtaaccgtaccgacggaccgtaaggttagttttacgtttttacgtaccccggaacccctaacctaaataaaccgtaacttaacgttacgtcgttaccggaacgacgaagaaacggtaacggtacgacctaccgtaacccttaaccctaacctcgtagttacgttacggcggttccgttacccggccggtaccgttaccgggttaccccgggtaactaaccgtactcgtacgtggtaccgacgggtccggtcggtacggtacttctaccgacctctacgactacgtcgacgcgtccgcgtcgcggtancgtaagtacgtgtcggtagtacttaagttacgtcacgtacgtacgtaacttaacttactttccgttaacctttcggttaaccgtggttaccggttacggggacgtacgggaggtacggtagacctaacgacgtagnggtacncaccgtancgttctnttcnctaccggtctcccg

SEQ ID NO: 64735 - DNA, 835 bp, Homo sapiens
  misc_feature: GYAE6OF01ARJ7P.31.78.H01.1.454.CMB.1.raw
  modified_base (390)..(390): a, c, t, g, unknown or other
  misc_feature (390)..(390): n is a, c, g, or t
  modified_base (413)..(413): a, c, t, g, unknown or other
  misc_feature (413)..(413): n is a, c, g, or t
  modified_base (781)..(781): a, c, t, g, unknown or other
  misc_feature (781)..(781): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctcgtggtcgccgttacgggacatcgtgatggacgcctagtttaccagtacctcccgtggcctgtcgtctcgtcgggcgaggacggccaacagtacaactgacaacgtccacgaccgaggtagtttcgttttacgtccggacccctaacaaacgtaacctaacttacgttacgtacgttacggtaaccagaccgtaaaggtaaaacggtcgaaccgacgtcccttaaccgttaaacctccgttagtaacttttaccggngggttccttaccggtacccgggntaccggttacccgggttacccaacgtgttacgtaggttcggactacgggtcgggtaccgtcgggttaacccgtatttacccacgtacctaccaacccgtagtccgtacgaccgtaccgtcccgttacgcggtaacggttccgtaagtaaaccggttggttcggtaacgtaccgtttaaggtttttaacctccggttagtaccgaaacggtttcctaaacttaccgttttttacgttacccgttttcccggttttaacggttaccctttaccggggttttaccggggacgggaaaccgggttaacggaaacggttggtaaaaccgaacgttaaaccggtaaaaccggtccttggggttaacccggtaancccggttaacgtacccttagttacccgttacgttcccgtttagtaaccccccgg

SEQ ID NO: 64736 - DNA, 776 bp, Homo sapiens
  misc_feature: GYAE6OF01AVTOF.31.78.H01.1.454.CMB.1.raw
  modified_base (152)..(152): a, c, t, g, unknown or other
  misc_feature (152)..(152): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctgatctcgtggtcgccgtacgggacntcgtgatgacgcctagtttccgagacctcccgtggctgtcgtctcggtgggcgacggacggcccaccgtactacaacgtgacctacgtaccgacgacctaggtagtttgttttacgttccgacccctaacaaactaacgaacttagttacgtaccgttaggtaccagaccgaaggaaacgtacggaaccacgtacccgtaacctaacctccgtagttaacgttaccggtcggtaccttacccggtaccccggtgtaccggttaccccgggtttaccctaaacgttacttcgtcgttggacgtacgggttcgggtaacggtcggtaccttacttaccgtaccttaccctaacgccctaacgtacgtacgaccggtacgtcccgtacgacggaacccgttggtaaccgaggtaagttcggtaggtacgtttagtttaacgtctagtaccgtacgtaacttaaattctttaacgtttacctttccggttaccgttacccgttacgggtttacgggcggtaaccggtaacggtacgggtagaccgttaaacggaaccgtaaccggttagtccgggacgttccgaccgtaaccttaccgtgttaccgttctttacccgacctttccccg

SEQ ID NO: 64737 - DNA, 891 bp, Homo sapiens
  misc_feature: GYAE6OF01DBPHZ.31.78.H01.1.454.CMB.1.raw
  modified_base (217)..(217): a, c, t, g, unknown or other
  misc_feature (217)..(217): n is a, c, g, or t
  modified_base (544)..(544): a, c, t, g, unknown or other
  misc_feature (544)..(544): n is a, c, g, or t
  modified_base (587)..(587): a, c, t, g, unknown or other
  misc_feature (587)..(587): n is a, c, g, or t
tcagcagtagacgtcacgaccggtgctcgatttagtgtgagtagtttgggtttgggggagctacaacaggcaggcaggggcagcaagatggtgttgcacgacccaggttcttctatttctcttgttgctctggatctcgtggtcgaccgtacggggactagtcgtgatggacgtcctagtttccgacgtaccttccgtggtctggttcgtcgtcggngggacgaggacggccacgatacacgtcggactaaacgtccgacgaccgtagttacgttttcggtttttaccgtccccggaacccctaaacgtaaaacttaaaccgttaacctttacggttaccggtacgtttaccggaacccagaacgtaaacgggaaagttaccggactaaccgtcccgttaactaaaccgtccgttaagttacctttacggtccggtcctttacccgggaccggtaccttaccgggttcccgggttaaaccctaacgtctttaccggtaggttccggaacggtcgggtaccggtagtcgggtaacttcctttacnccgttctaccgacttcgacgtacggacaacgttccgaggtacncggtactagggtactacggttacggttaacgttagttttacgtttaacgtacgtacgtaacgtaaccttaacttaaagtttcttttaccgttccgttttacccgttttaacgtaccgggttaccgggttaacccggggaacgggttaaacgggtaacgggtaaacgggtttcgaaaacgggtaaaacccgttaaacgggtaaaaccggttacccggttcggggttacgtaaaacccgtcgtaaacccgttttaacgttaccgttttacccggtttacccgttaccttttaccgggtttaccccc

SEQ ID NO: 64738 - DNA, 727 bp, Homo sapiens
  misc_feature: GYAE6OF01EB3LN.31.78.H01.1.454.CMB.1.raw
  modified_base (344)..(344): a, c, t, g, unknown or other
  misc_feature (344)..(344): n is a, c, g, or t
tcagcagtagacgtcacgaccggtgctcgatttagtgtgagtagtttgggtttgggggagctacaacaggcaggcaggggcagcaagatgggtgttgcagacccaggtcttcatttctctgttgctctggatctctggtcgccgtacggggacatcgtgatgagcctagtttccagactccctggctgtgtctcgtgggcgaggacgggccaccgattcaactgacaacgtccagccagtagttgttttattcggaccccacaataacaactacttgcttagaccagacaagaacgtggacagtccctacgaactctgtactttacgcggtcttaccgccgganacggttccgggttaacctcgtacttcgagttcggcgacggtcggtcgtcggacctgttccaccgttcaccgaaacctctacgacgtaccgtacgcccgttacggactacgggtacttaagggaaacgtcggttcgggtacggtaccgttttaaaggttttaacttaccggttcgtaaccgacgtaacctaaactttaacttttacgtttaaccctttccggtttaccgtaaccgttttaccggggtttccgggaccggggtaaacgggtaaccggttaaggggtaacggttagtaaccgtaaaccggtaaacgttacggtgggttaacgccttacggaccctaaaccgttcgttaaccggtttcttaccttccgttaaccccg

SEQ ID NO: 64739 - DNA, 766 bp, Homo sapiens
  misc_feature: GYAE6OF01D5NBA.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagacctcccgtggctgtgtctcgtgggcgaggacgggccacatacaactgacaacgtccagaccagtagttgttttattccggaccccaactaaactaaacaacttacttagtcgttacggtaaccagacaaaggtaaagtacggacaacgaccctaacctaaaacctccgttagtaactttacgtcgggtacttaccggtacccgggtataccgttccgggttaccctaacgtattcgtaacgttggacgtacggtacgggtcgtacggggtacccttacgtttaccaccgttacaccaacctaactaccgaaggcctaacgtcccgtagaccggtaggtacgtaaggtaaacggtagttcgggtacggtactttaagttttactacgttacgtacaacggtaacctaacgttaatttaacctttccgtttccgtttaccgttaccgttaacccgggttcgggtaaccgggaacggggttaaccgtaaaggggttaggaacctaaaccgtaaaccggttaaacggttacggtacggtccgtacgtacccgaacttaccgttacgtacgtttccttaccgttaccttaccccgg

SEQ ID NO: 64740 - DNA, 905 bp, Homo sapiens
  misc_feature: GYAE6OF01DT71F.31.78.H01.1.454.CMB.1.raw
tcagcagtagacgtcacgaccggtgctcgatttagtgtgagtagtttgggttgggggagctacaacaggcaggcaggggcagcaagatggtgttgcagacccaggtcttcatttctctgttgctcgtggatctcgtggtcgaccgtacggggactagtcgtgatggacgtcctacgtttccagtacctccgtggccgtgtcctgtacgggcgaggacgggcccactactacgaactgaccgtaacggtcccacggacctaggttacgttttacggtttttaccgttcccgggaaaccccccctaaacgtaaaacttaaaacccgttaaaccttaaccgtttaaccggtcccgttttacgggtaaccccaaggaacccgtaaaggtaaaacggttacggaccgaaccggtaacccccttaacctaaaacccgtttcccgtaaggtttacctttaaccgggtcgggttacccctttcccggtaaccccggggcttaaccggggtttaccccgggttaccctaaaccggtacttcgtaacggttcgggacgtacgggtaccggggttaccgtacggggtaaccctttcgtaaccgtaccggttaccctacctaaccggtactaccgacggaccgtacgtcccgtacggcgtacggtacgtacggtaaaggtcgtcgggtacgtactttacgggtttaactacgttccggtaactaaccggaacttaaacgtttactttacgtttaaccggttttcccttacggttaccgtttcccgggttacgggaccggggttaaccaacgggtaacggtaggtaaacttaccgaaaccgtaaacggtcgttagggaccttcggacccgtaaccttcttaaccgttctttccggtaaccttccggtaacctcccccg

SEQ ID NO: 64741 - DNA, 790 bp, Homo sapiens
  misc_feature: GYAE6OF01CSO5Z.31.78.H01.1.454.CMB.1.raw
  modified_base (208)..(208): a, c, t, g, unknown or other
  misc_feature (208)..(208): n is a, c, g, or t
  modified_base (407)..(407): a, c, t, g, unknown or other
  misc_feature (407)..(407): n is a, c, g, or t
  modified_base (466)..(466): a, c, t, g, unknown or other
  misc_feature (466)..(466): n is a, c, g, or t
  modified_base (525)..(525): a, c, t, g, unknown or other
  misc_feature (525)..(525): n is a, c, g, or t
  modified_base (527)..(527): a, c, t, g, unknown or other
  misc_feature (527)..(527): n is a, c, g, or t
tcagcagtagacgtcacgaccggtgctcgatttagtgtgagtagtttgggtttgggggagctacaacaggcaggcaggggcagcaaggatggtgttgcagacccaggtctcatttctctgttgctcgtggactctcgtggcgccgtacggggacatcgtgacgtgacgtcctagtttccaacgacctcccgtggctgtcgtcgtcggngggcaggaccggaccacgtactacaacgtcgacgtaaacggtcccagtacccgaggttacgttttcgttttacgtacccggacccctaaactaaacttaaaccgaacttacgttacgtcgtttacgaaccgaagtacgaaagtaaacggtacgaactaccgtaccttaaccgtaaacctccgtattaaccgtttacggngttacccgttacccgacccggttacgtaacccggttacccgggttaccctaaacggttntccggtacgttccggacgtaggtcccggtacggtacggtacctagttccacctcttacncngaccggcacctacgccgtcgaggtacgcgtaagaccgttggacgtacgtcttaagtttcgtaacgtcgtaactacgtaacctaaagttacttttaaccttagttttcccgttaccgtttaccggtaccggttacggggaacggtaaccgggtaacgtaacgggtggaaaaccgttaacgtaacccgtaaacgtaacggttgtaaccccggacgtacccgtacgtaccccttagttacgtttacccgttccgtaccttaccccg

SEQ ID NO: 64742 - DNA, 935 bp, Homo sapiens
  misc_feature: GYAE6OF01CEH2L.31.78.H01.1.454.CMB.1.raw
  modified_base (546)..(546): a, c, t, g, unknown or other
  misc_feature (546)..(546): n is a, c, g, or t
tcagcagtagacgtcacgaccggtgctcgatttagtgtgagtagtttgggttgggggagctacaacaggcaggcaggggcagcaagatggtgtgcagaccaggtcttctattctctgttgcctgtggatctcgtggtcgccggtacggggacagtcggtgagtcgacgccttacgttaccagtacctcccgtgggtccttggtcgtccgtcggtagggaccgaagggaccggtccaaccgtataccgaacgtacggaactaacgtaccgagtaccgtaaggttacgttttaggttttaccgttaccggaacccctaaactaaaactaacctaaacttacgttaacggtacgttacggaaccaacggaacgtaaaggaaaaccggtacgaacgtactaccccttaacctaaaccgtcgtacgttaccgtttaccggacgggtcccttaccgggtaaccgggtaccgttaccgggttacccggttaaccaaccgttcgtacgtagggttcgaccggacggggttcgggtacggtacggggttaacctnttaccctaccggtacctaaccgtaccgtagtaccgaaccgtccggaaccgttcgtacggacggtaaccgtaacgtagggtaaaaccggtcggttaaggttcgggtaacccttttaaaggtttaaccggttacccttaagggtcccgtaaaaccgtaactaaaacggtttacgtttaaaccttttacccggttttacccgttaacccgggttacgttttaaaccgggtacccgggggtaaagggttaacccggtaaaccggggtttaggaaacggttaaaccggtaaaccgggtaaaccgtaaacggggttaacgttcggggtcctaaaccggggtaccctttaccgaaaccggttacgttccgttacgttacccttaacccggttaccc

SEQ ID NO: 64743 - DNA, 727 bp, Homo sapiens
  misc_feature: GYAE6OF01BFYE7.31.78.H01.1.454.CMB.1.raw
  modified_base (165)..(165): a, c, t, g, unknown or other
  misc_feature (165)..(165): n is a, c, g, or t
  modified_base (445)..(445): a, c, t, g, unknown or other
  misc_feature (445)..(445): n is a, c, g, or t
  modified_base (550)..(550): a, c, t, g, unknown or other
  misc_feature (550)..(550): n is a, c, g, or t
tcagcagtagacgtcacgaccggtgctcgatttagtgtgagtagtttggggtttgggggagctacaacaggcaggcaggggcagcaagatggtgttgcagacccaggtcttcatttctctgttcgctctggatctcttggtgccgtaggggacatcgtgatgacnctacgttccagtacctccgtggctgtgttctcgtgggcgaggacggacccactagtactaactggacgtaagtaccagccaggtgtttagttttaccgttcggaccccaactaactaacgtaactactagtcgttagaccagtacaaggaagtacgacacgccttaacaaccgttctagttaacttcggtcggtaccttccggacccgggtatacccgggtttccggtaacctaacgtcttcgtaggtacgcgacgggtcggtcgaccggggtacctttnttaccgtaacctcgtaccacgtataccgacgtacgcgtactggacgagtcgagtaacgtcgtaggtcgtacgttatttacgtagtctacgacgtactaacgtttnttactttaccgtttcgtttaccgttacgttaccgggtttaacggggtccgggtaacgggtaacggtaacggggtacgtaaaccgtaacggttaaaccgaaacgttaggttagggtccgtaccggttaccgaacccgtaaccttacgttaccgttaccgtttaaccgtcgttaccccg

SEQ ID NO: 64744 - DNA, 724 bp, Homo sapiens
  misc_feature: GYAE6OF01B0MAZ.31.78.H01.1.454.CMB.1.raw
  modified_base (185)..(185): a, c, t, g, unknown or other
  misc_feature (185)..(185): n is a, c, g, or t
  modified_base (314)..(314): a, c, t, g, unknown or other
  misc_feature (314)..(314): n is a, c, g, or t
  modified_base (349)..(349): a, c, t, g, unknown or other
  misc_feature (349)..(349): n is a, c, g, or t
  modified_base (371)..(371): a, c, t, g, unknown or other
  misc_feature (371)..(371): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacgggacatcgtgatgagccagtttccagactccctggctgtntctgtgggcgagagggccaccatcaactgcaagtccagccagagttgttttattcggccccacaataacaactactagcttggtaccagcagaaacgtaggacagcctacctaaactcctgattttacnggcttcaccggtcacgttccggggttcctaaacgnttacgagtggcaggtcgggtcnggggtaccgtactttcaaccgttctaccgaacctataccgaacgccgacgcccgttacgcgtaacggcctaggtaaagacgttacggttggacttaacgttttacgtttaactacgttacgaagtaccaaacgttaactttaagttaccctttaccttttaccgtacccgttaaccgtttttccgggaacgggtaaccgggtaacccggttaaagggtacgggtaacggtaaacgttaaccggtaaaaacccgtaaggtttaccgggtttacgggaccgttacccggtaacccggtaacccctttaaacggttacccgttttaccgtttccccggtttaccgtttaacccccg

SEQ ID NO: 64745 - DNA, 674 bp, Homo sapiens
  misc_feature: GYAE6OF01EMU06.31.78.H01.1.454.CMB.1.raw
  modified_base (390)..(390): a, c, t, g, unknown or other
  misc_feature (390)..(390): n is a, c, g, or t
  modified_base (514)..(514): a, c, t, g, unknown or other
  misc_feature (514)..(514): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagttccagacctcccgtggctgtgtctcgtgggcgaggacgggccaccatacaactgacaagtccacgaccgagtagttgttttattccggaccccaacaataaacctaacttacttacgtcttacggtaccagacaaagaaagtaggacacgaccctacctaaactcctagtacttacgtcggtccttccgtacccggctacggttccgggttacctaaccgtnttcgagttcgcgacggtcggtcgtacgggacctactttcaccgttcctaccaactactcgacgccgtacgtccgtgaccgtagggtctaggaagtagtggtacggtacttagtttacttacgtntacgacgtaactaacttacgtttactttacgtttcctttcgtacgttaacggttccggggacgggtaacgggtacgtaaggggtacgaacgtaacgtaaccgtaaacggacgttcggccggtcaggaccctacgtataccgttcttacctcgttaccccg

SEQ ID NO: 64746 - DNA, 917 bp, Homo sapiens
  misc_feature: GYAE6OF01E4PHJ.31.78.H01.1.454.CMB.1.raw
tcagcagtagacgtcacgaccggtgctcgatttagtgtgagtagtttggggtttgggggagctacaacaggcaggcaggggcagcaagatggtgttgcacgacccaggtcttctatttctctgttgctctggatctcgtggtcgccgtacggggacatcgtgatgacgcctacgtttccacgtacctcccgtggcttggtcgtcctcggtgggacggacggaccgggacccaaccactaccaacgtcgaccgtaacgtcccacgtacccgtaaggttacggtttttacgtttttaccgttaccccggaaccccctaaaccgtaaaacttaaaccctaaccgtttaacgttaaccgttaccggttaaccggtaaccaagaaccggaaaaggtaaacggtacggaacctaccgtaccccttaacccttaaacctccgttagtttaccgttaccggtccgggttccctttacccggtaccccgggtaccgttaacccgggttcccgggtttaacccgtaaccgtacttacggtacggttccggacgtacggggttccggggtaccggtaccgggttaacccttctttacccgccctttacccgacctaacctacgttaccggaaccgtccgtaccggtcccgtaaggccgaaccggggtgttaacggtaacgttgggttcggttaaggttacctttagttttaccgttactacggaccctaacgttaaaccttactttaacgttttccctttaccgtttaccgtttccggttaaccggttaccgggttccggggaaaccgggtaacgggttaaccgggtaaggtaccgtaaaataacccggtaaccgaaacggtcggttacggggtcacccggtttaacccactaccgttctttcccgtacttttcccgcccgtttaccc

SEQ ID NO: 64747 - DNA, 739 bp, Homo sapiens
  misc_feature: GYAE6OF01B45CT.31.78.H01.1.454.CMB.1.raw
  modified_base (625)..(625): a, c, t, g, unknown or other
  misc_feature (625)..(625): n is a, c, g, or t
  modified_base (716)..(716): a, c, t, g, unknown or other
  misc_feature (716)..(716): n is a, c, g, or t
  modified_base (725)..(725): a, c, t, g, unknown or other
  misc_feature (725)..(725): n is a, c, g, or t
tcagcagtagacgtcacgaccggtgctcgatttagtgtgagtagtttgggtttgggggagctacaacaggcaggcaggggcagcaagatggtgttgcagacccaggttcttcatttctcttgttgctcgtggactctcgtggtcgccgtacggggactacgtcgtgagtcggacgtacctacgtttaccgaacgtaccttcccgtcggtcttggttcgttccgtcggtcgggacgacggacggcccaacactacgaactgacctacgcacgccgtagtacgtttgttttacgtaccgacccctaaactaaactaacctaacttacgttacgtaccgttacggtaccagacgaacggtaaacggtacggaacaccgtacccttaactaaccttccgttagttacgtttacggtcggttacccgttaccggaccccgggttacgtaccgggttacccgggttaaccttaaccgttacgttaccgttcggtcggtaccggtacggggtaccgggttacggtaccgggttaacccttcttacctaaccgttcctacctaacgtacctacgacgtaccgtacgccgtacgacggtacgcgtagtaacgtgtcgtagtactttacgttatntcgacacgtactaacttacgttactacgtttcttcgtacgttcggacggacgacggtacagggcactacgtacgacgtagtcgactcgacnctatacgtntcgtacgtcgtccg

SEQ ID NO: 64748 - DNA, 796 bp, Homo sapiens
  misc_feature: GYAE6OF01BOE4S.31.78.H01.1.454.CMB.1.raw
  modified_base (406)..(406): a, c, t, g, unknown or other
  misc_feature (406)..(406): n is a, c, g, or t
  modified_base (433)..(433): a, c, t, g, unknown or other
  misc_feature (433)..(433): n is a, c, g, or t
tcagcagtagacgtcacgaccggtgctcgatttagtgtgagtagtttgggtttggggagctacaacaggcaggcagggcagcaagatggtgtgcagacccaggtcttcatttctctgttgctctggatactctggtcgccgtacggggacatcgtgatgagcctagttccagactccctggctgtcgtctcgtgggcgagacgggccaacagtacaactgtaacgtccgagccgaaggtagtttgttttaacgttccggaccccctaaacgtaaacttaaaccgtaaccttaacgttaacggtcgtttacggtaacccaaggaccaaaggtaaaacggttaggaaccacggtacctaaccctaaaacttcctagttacttaccgtggtccttaccgtacccgggtntaccgttcccgggttacctaaacggtnttacaggttcggaccgtacggtaccgggttcgacggggtaaccgttactttaccaaccgttccgtaccaaccctagttaccgacggtaccaacgtccgtacggtacgtacggtacggtacggtaaagttacggtacgggttacggtacgttaacggttttaacttacggttacgtacgtaaccgtaacttaacttaaacgtttaacttaaccgttttccgtttccggtttaaccttaccgggttttacgggaccgggtaaacggtaccggtaaggttacggaagtaaccgtaaacggaaacgtacggttcgtacggtacgttcgactaccgtacgtcgttacgttcttaccgtcgttaccccg

SEQ ID NO: 64749 - DNA, 869 bp, Homo sapiens
  misc_feature: GYAE6OF01DF3Y0.31.78.H01.1.454.CMB.1.raw
  modified_base (440)..(440): a, c, t, g, unknown or other
  misc_feature (440)..(440): n is a, c, g, or t
tcagcagtagacgtcacgaccggtgctcgatttagtgtgagtagtttgggtttgggggagctacaacaggcaggcaggggcagcaagatggtgttgcagacccaggtcttctatttctctgttgctctggatctcgtggtcgccgtacggggacagtcgtgatgagcctagtttccagacctccctggctgtgtctcgtgggacgaggacgggcccaccgatacaactgacaaacgtccagaccgaaggtaggttttgtttttacgttcccggacccctaaccgtaaactaaaccaaactttaacgttacggtctttacggtaacccagactaaaggaaaggtacggacacgtacccttacctaaactccgtagtacgtttaccgtcgggttccttccggtaccccgggtactaccggttcccgggtaccctaaaccgtnttactagttcggacgcggtcgggtcgtacgggacctactttccacctcctacacctaacgtcacgtcgaacgtcccgtaggaccgtacggtaaccgtaggtaaacgttacggttacgggttacgggttaacctttaacggtttttaaccgttaaccgtacgttaacccggtaaaccggtaaccctttaaaacgtttaacccgtttttaaactttaccccggttttttacggttttaacccgtttaccggtttaacccggggttttacccgggggaaccggggtttaaccgggggtaaccgttaaacggggggttaaacggaacgggttaaccgttaaaacccggtaaaacggttaaccggtttgggtaacccggtaccgttacgaacccgttacccgaacgttccgtttaccgttcttacccttacccg

SEQ ID NO: 64750 - DNA, 924 bp, Homo sapiens
  misc_feature: GYAE6OF01ANRQ6.31.78.H01.1.454.CMB.1.raw
tcagcagtagacgtcacgaccggtgctcgatttagtgtgagtagtttggggtttgggggagctacaacaggcaggcagggggcagcaagatgggtgttgcagacccaggtcttcatttctctgttgctcgtggatctcgtgggtcgaccggtacggggacagttcgtagagtagacgcctagtttccacgtaccctcccgtgggtccttggtcgttcttcggtggggcgagggtaccgggcccaaccgacgttacctaacgtcgaccgtaacggtacccacgaccgtaaggttacggttttacgtttttaccggtttaccccgggaaccccctaaccttaaaaaccgttaaacctaaacccgttttaccgttaacggttcccggtttaaccggtaaccgtaacggtaaccggaaaacggttaaaacggggtaccggaaccgtaacccggtacccccttaaccgtttaaaaccccgttcctttaggttaaccgttttaaccgggttccgggttaccgttaccccgggtcccgggtacgttaccccggggttacccgggtttaacccgtaacggttctttacggtacggtttccgggaccggtacgggttaccggggtaccgggttaccgggtaaccctttacgttacccgtacgttcccctaccctaaccggtacccttacggaccgggtccacgggtttcccacggggacggtacggttcgtaagggacgttgtcgggttacgctttaagttcgcgttgacggtcgaataacccttgtaacgtttccttacttccgtttacgtaccggttacgggttcccgggaagggtaccgtaaccggtacggtacggtaaccgtaacgtaaccggttaccggtagtcggttcgccgttaacgccgttactagttccgttaccttcgtcccg

SEQ ID NO: 64751 - DNA, 719 bp, Homo sapiens
  misc_feature: GYAE6OF01BAH30.31.78.H01.1.454.CMB.1.raw
  modified_base (461)..(461): a, c, t, g, unknown or other
  misc_feature (461)..(461): n is a, c, g, or t
  modified_base (512)..(512): a, c, t, g, unknown or other
  misc_feature (512)..(512): n is a, c, g, or t
  modified_base (517)..(517): a, c, t, g, unknown or other
  misc_feature (517)..(517): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctcgtggtgccgtacgggacagttcgtgatcgacgcctaacgtttccacgtaccttcccgtggtctggtcgttcgtcgtcgggacggaggacgggacccaccagtaccaacgtcgacgtaacgtccgacgacctaggttagtttagttttacgttccgacccccaactaaacgtaacctaacttaacgttacgtcgttacggtacctagaaccgtaaggaaacgtacggacctacgacccttaacctaacctcgtacgttacgttacgtcgggtccttaccgtacccggacgtacggttcccggttacctacgtacttctacgtcggacncgggtacggtcggtacggtccgttatccgtactccgtacacctatcacgcncgtcncgactggtactaagagtacgtgtagtcgttaacgtttcgtactacgtagaccttaagtaacttagttactttaccgtttctttaccggtccgtttaacggtcggtaccggggaagtacgggtacggtaggtactaacggtaaacgtacgtaccgtaggtcgttacgactaccgtacactttctacgttccttcgttaacccg

SEQ ID NO: 64752 - DNA, 881 bp, Homo sapiens
  misc_feature: GYAE6OF01A3FCN.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgttacggggacatcgtgatgacgcctagtttccagacctcccgtggctgtgtctcgtgggcgaggacgggccaccgtatcctaacgtgacctaacggtcccacggaccaggtagtttagtttttaacgttcccggaccccctaacctaaactaaacctaaacttacgtttacgtaccgttacggtaaccgaaggtacgtaaacggtaaaggttacggaacctacgtaccccttacctaaaccgttcctagtaacttttaccggtcgggtacctttacccggtaacccgggtcttaccgggttaccccggggtttaccctaaaccggttacttacgtaggtttcgggaccgtacggggtacccggggttaccggttaccggggtaacccgttacgttttacccgtaccgttaccttacccaacccgtacgtaccgtaccggtaccgtacccggtccgtacgggaccgtaacgggtaccttaagggaacgttacggttcgggttaacggttaccgttttaacggttttaacttaccggtcggtaaccgtaaccggtaacttaaacctttaagttttaacccgtttaacccgtttttacccgttttaccggttaccgtttaccgggtttaccgggggacgggttaacgggaacccgtaggggttacgaccgttaacgtaaaccgtaaacggtcgtacgggtcgtccgtacgacctaacgtcgttacgtcgtcgttacgtcccg

SEQ ID NO: 64753 - DNA, 947 bp, Homo sapiens
  misc_feature: GYAE6OF01BEC2E.31.78.H01.1.454.CMB.1.raw
  modified_base (927)..(927): a, c, t, g, unknown or other
  misc_feature (927)..(927): n is a, c, g, or t
tcagcagtagacgtcacgaccggtgctcgatttagtgtgagtagtttgggtttgggggagctacaacaggcaggcaggggcagcaagatggtgttgcagacccaggtcttcatttcctctgttgctctggatctctggtcgccgtaacgggacatcgtgatgagcctagtttccgagacctcccgtggtctgtgtcgtcgtgggcggaggacgggacccacctataccaaacgtcgaccgaaacgttccgacggaccaaggtaggttttacgttttttacgtttcccggtaacccccctaaacccgtaaaaactaaaaccgtaaacctttaaaccgtttaacggtaccgtttaaccggggttaaccaacggtaaccgaaacgggtaaaaaaggtaaccgggaacctaaccggtaacccccttaacccgttaaaacccttacccgtttaacggttaacttttaaccggttccggggtttaccccttttacccgggtacccccggggtaccgttaacccgggttttacccccgggggttttaaaccccttaaaacccgggttactttacccgtaaggtttacccgggccgtaacggggtcccggggttacggttcggggtaacccgttacgtttaccctaacctttccctacccgtaacctactcccgtaacggccgtaacgtcccggttacgaccggacggtaccgtaggtaacgagtttcgggtacgtaaccggtttacgttttagttaaccgttagtaccgtaacgtaactaaaccgttaatttaaccgtttaacgttttaccgtttaccgttaccgtttacgggtttaaccgggtaccggggtaacgggtaaccggttaagggtacgtaacggaactaaacgtaaacgtaacgtcgggttacgtccgtacgcctaacgtaccttntccggttcttcgttaacccg

SEQ ID NO: 64754 - DNA, 714 bp, Homo sapiens
  misc_feature: GYAE6OF01A2FH1.31.78.H01.1.454.CMB.1.raw
  modified_base (154)..(154): a, c, t, g, unknown or other
  misc_feature (154)..(154): n is a, c, g, or t
  modified_base (475)..(475): a, c, t, g, unknown or other
  misc_feature (475)..(475): n is a, c, g, or t
  modified_base (511)..(511): a, c, t, g, unknown or other
  misc_feature (511)..(511): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctcgtggtcgccgtacggggacngtcgtgatgacgcctagtttccacgtacctcccgtgggctggtcgtctcgtgggcgaggacggccaactactcaaactcgacaagtccgagccaagtgtttgttttacgttcgaccccaactaactaaactaacctactttagcttacggtacacgtacaaaggtaaacgtacgacgacgtacccttaaccgtaaaccgtccgtagttaacgttttccggacggttacccttccggtaacccgggtctaacggtttcccggggtacctaaaccgtcttcgtaagttcggacctcgggtcggggttacctgggtaacccttntttacgaccttctaccgacctacacgtacgccgtanccgtcgacggtacgcgtaggaaacgtgtcgtagtacttacgtttactacgtgtaccaacgactaatactttaacgttctttcgttactcgttaccgttacgggacggtaacggtacccgtaagggttcgaaacgttcgtaaaccggtaactaacgggttggccgtacgcggtaccacggttcttacgtcgtcgttcccgtacg

SEQ ID NO: 64755 - DNA, 909 bp, Homo sapiens
  misc_feature: GYAE6OF01B6QKF.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctgggtgccgtacggggacatcgtgatgacgcctagtttccagacctcccgtggctgtgtctcgtgggcgaggacgggcccaccatcaactgaccaacgtccacgccaggtagtttgtttttacttccggacccccaacctaaataaacctaaaccttaccttacgtcttacggtaaccagacaaaggaaaacgtaggaccaccgtaccctaacctaaaaccttccgttagtacgtttacgtcgggttaccttacccgtacccgggtacgtaccggttaccccggggttaaccctaaccggtacttacctaggtttcggaccgtacggggtccggggttccggtacggggtaacccgtttacgttttaccgaaccgtttaccctacccgtaaccctacgtaccgaacgcccgtacggtccccgtacggtaccgacgggtaccgtaacggtaaacggtacgttacgggtacgggttaacgttttaaacggttttttaaccgttaaccgtacggttaacccgtaaacgtaacccgttaaaacctttaacgttttaactttttaaccccgttttacctttttacccggtttaccccggtttaaccggttttacccgggggtaacccggggtaaaccggggttaaccggttaaagggggtacggttaaaccgtaaaccgttaaaccggtaaaaccggttaaccgttacgggttcggtaacccgttaccgaccccgttaaacccttacgttaccgttcccgtttacgttacccgttacccg

SEQ ID NO: 64756 - DNA, 701 bp, Homo sapiens
  misc_feature: GYAE6OF01E3JU6.31.78.H01.1.454.CMB.1.raw
  modified_base (442)..(442): a, c, t, g, unknown or other
  misc_feature (442)..(442): n is a, c, g, or t
  modified_base (689)..(689): a, c, t, g, unknown or other
  misc_feature (689)..(689): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggcttgtcgtctcgtcgggcgtagacggggaccctaaccgataccaaactggacctaacgtccagcccagtagttgttttacttcggacccccaacctaataacaactacttagtcgttaggtaccagcaagaaagtaggacacgaccctacctaaactcctagtacttacgtcgggactttccgtacccggtctaccgttcccggggttacctaaccgtattctacgttggcgtacggccgggttacgtacgggacccgtntttaccgacctcgtaccaaaccattaccgacggacctacggtacccttacggccgtaagggccgttaggaaacgttaagtgggttacggacctttaaggttttaacttacgtcggttaacgaacgtacctaactaagtttacttaccgtttctttcggtacttaaccggtttcggacggacgggtaacgaaggtcggtaagactaccgaaacgtatacggtcggcgttagaccgtactacgttcctnttccgtcgtacc

SEQ ID NO: 64757 - DNA, 680 bp, Homo sapiens
  misc_feature: GYAE6OF01B8UGO.31.78.H01.1.454.CMB.1.raw
  modified_base (468)..(468): a, c, t, g, unknown or other
  misc_feature (468)..(468): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctgggtcgccgtacggggacatcgtgatgagcctagtttccagactccctggctgtgtctcgtgggcgaggacgggccacataccaactggaccaacgtccagaccagtacgtttgtttttacgttccggaccccaacctaaataacctaaacttacttacgtacttacggtaaccagacgaaaggtaaacggtacggacacgccctacctaacctcctagtacttacgtggtccttccgaccgggtctacggttcccgggtacctacgtacttacgtagttggactacgggtcgggtcgtacgggtaccgtacgttcctcgttactaccactancacggcaccgtacctgacgtaggactagaagtacgtggtcgtagttacgtttactcgtagtacgtaacgactatattactttactttcctttacgtaccgttacggttccgggagggtaacgggtacggtaagggtacggtaagtaaccgtaacgtaaaccggtaggttggaacgtccgtacgaccctactagttcttcgttctactacccg

SEQ ID NO: 64758 - DNA, 832 bp, Homo sapiens
  misc_feature: GYAE6OF01CJPOC.31.78.H01.1.454.CMB.1.raw
  modified_base (61)..(61): a, c, t, g, unknown or other
  misc_feature (61)..(61): n is a, c, g, or t
tcagcagtagacgtcacgaccggtgctcgatttagtgtgagtagtttggggtttggggganctaacaacaggcaggcaggggcagcaagatggtgttgcacgacccgaggttccttcattttctctgttcgcttcgtaggacttctcgtcggtcgaccggtaacggggactactcggtaggtatcggacgtaccctacgtttccgaactcccgttcccgtggtcgttcggttcgtccgtcggttacggggacggacgggacggtaccaacctaactaccgtaactcggaaccttaacggtaccgacggtaccgtaaggtttacggttttacggtttttaccggttaccccggaacccctaaacctaaaacgttaaaccgtaaaccgttacgtttaacgtccgtttaaccggtaaaccacgtaacgaaaaggtaaacgtacgtacgtaccgtaccctaaaccttaaccgtaccgttacgttaacctttacgggtccgttacccgtttaccgggacccggtacgttacccgggttaaccccggttccttaaccgtacgttcgtacggtcggacgtcgggtcggtacgtccggtactttctactccgtacctacaacgtctcgacgacgtcgctacgtcgacgtacgtagagtcgtacggtacgttacttacttaacgttcgtagactacgacttaactactttcttacgtttccgtacgttaccggtcgttaccggacggtaacggtacggtacggtacggtaactaacggtaacgtacgtacggttcggcgttacgtacgaccgttaacttcgtaccttacttctccgtcccg

SEQ ID NO: 64759 - DNA, 659 bp, Homo sapiens
  misc_feature: GYAE6OF01ELTJJ.31.78.H01.1.454.CMB.1.raw
  modified_base (402)..(402): a, c, t, g, unknown or other
  misc_feature (402)..(402): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtcgccgtacggggacatcgtgatgagcctagtttccagacctccctggctgtgtctcgtgggcgaggacgggccaccatcaacgtgacaagtccagccgagtagttgttttacgttccggaccccaacaactaactaactacgttacgcgttacggtaaccagaccgaagaaacggtacggacacgtaccctaaccgtaaactccgtagtaactttacggtcggtccttccgtacccggctaccggttccgggttacctaacgtnttcgagtgcgaggtcggtcgtacggaccgttattccgacttccaccgactactcgacgactacgccgtcgcgtaggctaaggaagtcgttggtacgtacgttaattttactacgttcgtacgagtactaacttacttacgttacctttcgttcgtaccgttaccgttcgggacggtacggtacgaaggtacggaatacgtaacgtaaacgtacgtggtcgcctagaccctactacgtcgttacgttcttcgtacccg

SEQ ID NO: 64760 - DNA, 899 bp, Homo sapiens
  misc_feature: GYAE6OF01CGSZI.31.78.H01.1.454.CMB.1.raw
tcagcagtagacgtcacgaccggtgctcgatttagtgtgagtagtttgggtttgggggaggctaacaacaggcaggcagggcagcaagatggtgttggcacgacccaggtccttcactttcctcttgttcgctctggacttcgtcgtcggtcgtccgtacggggactagtcgtgatgacgcctacgttccacgtaccttcccgtggcgttgtcgttcgtcggtcgggacggacggtacgggacccacctactaccgaactcggaacctaacggtccacggaccgtaaggtacgtttacgtttttacgtacccggaccctaactaaactaaacctaacttacttaacgtacgttacggacctaggacgaaaggtaaacggtacggaaccgtacgtaccccgttaaaccgtaaccgttacgttacggttaacgtttacggtccggggtaccctttacccgggttaacccgggcgtttaaccgggtttccccggggttaaccctaaacgggttaccttacggtaggttcggtaccggtacgggtcggggttacgtaaccggggtactttacgtttaccgaccgtttaccaccgttaaccacgttaccgacggtaccgaccggtacccgtacgtaccggttaacgggcgtaaacgaacgggttacgtacggtagggttactttaaacggttttacctaccgttacggttaccaacggttaaccttaaacgttagttttaactttacccgttttaccgttaaccgtccggtttacgggttacccgggacgggtaaccggtaacggttaaggggtcgaaacggtactaaccgggtaacgacccggttagggtcctaaccgacgtactacccggttacttaccgtactttaccgtcccgttacccg

SEQ ID NO: 64761 - DNA, 824 bp, Homo sapiens
  misc_feature: GYAE6OF01AXZA4.31.78.H01.1.454.CMB.1.raw
tcagcagtagacgtcacgaccggtgctcgatttagtgtgagtagtttgggtttgggggagctacaacaggcaggcaggggcagcaagatggtgttgcacgacccgaggttcttcactttcctcgttgttgcctcgtggactcctgtcggtcgcccgttacggggactacgtcggtgatcggacgtccgtacgtttccacgtcctcccgtgtcgtgtcgtctcggtgggcggaggacggcccaccgtatacgaactcgaccgaacgtccacgccgtagttaggtttcgttttacgttcccggaccctaacctaaactaaactaaccttagtagtaccgttacggtaaccagaccgaaggtaaaggacggtacaaccgtccccttaaccgttaacctcttagtactttacgtggtccttaccggtccggtaccgtccggttaccggtacccgtaacgtcgtaccgtcggtcggacggtcggtcgggtaggtaccgtacgttcttaccgtacctccctacacgtaacgtccaccgtacgtacccgtccgacggtacgtacggtacggtaagtacgttacgtgggtaccggtaaccgtttattagttaaccgtcgttacgaacgttaacttaagttaccttttaccgttaactttcccgttacgttcccgttaaccggggttagggaccgggtaaacgggtacggaagggttaacgaccgttaaaccgtaaaccggtaaaccggcgggtttacgtaccgggtttaccaccgttaacccgtaacccgtttacttacccggtttaccggtttccgtaactttccccccgg

SEQ ID NO: 64762 - DNA, 814 bp, Homo sapiens
  misc_feature: GYAE6OF01BYRI8.31.78.H01.1.454.CMB.1.raw
  modified_base (422)..(422): a, c, t, g, unknown or other
  misc_feature (422)..(422): n is a, c, g, or t
  modified_base (451)..(451): a, c, t, g, unknown or other
  misc_feature (451)..(451): n is a, c, g, or t
tcagcagtagacgtcacgaccggtgctcgatttagtgtgagtagtttgggtttgggggagctacaacaggcaggcaggggcagcaagatcggtgttgcagacccaggtcttcatttctctgttgctctggatctctggtcgccgtacggggacatcgtgatggcgaccctagttttcccaacggtaccttcccgtggtacttggtcgttcctcggtggggacgacgggacgggcccaaccagttccaaacgtcgactaacggtccgacgaccgtaggtagttttcgtttttaacgttcccggaccccctaaataactaaacctaaccttacgtttacgtcgttacggaccagactaaaggaaacgtgaaccacgtccctaactaacctctagtactttcggcggtaccttcccggaccggtntaccgggttccccgggttacctaaccgtnttccgagttacggcggtacggtaccgggtccgtacgggtaccttactttcccacgttacctacccgaacctagtacccaggaccctacgtcccgtaggtaccgtacggtaccgtaggaaacggtcttgggtaccggttacgtttaacgttttacgtaccgttacgtacctaacgtaccttaaacgttaactttaccgttttaaccctttccgtttaccgtaccggttaaccggttttacggggaccgggtaacgggtaaccggtaggggttaccgaacggttaacctaaaccggtaaacgttacggttggtaccgcgttaccggaccttaccgtacgttacttcttacccgttcttaccccgg

SEQ ID NO: 64763 - DNA, 912 bp, Homo sapiens
  misc_feature: GYAE6OF01E12RI.31.78.H01.1.454.CMB.1.raw
tcagcagtagacgtcacgaccggtgctcgatttagtgtgagtagtttgggtttgggggagctacaacaggcaggcaggggcagcaagatggtgttgcacgacccaggtcttcatttctctgttgctctggatctcgtggtcgccgtacggggacacgttcgtagagtagacgtccgtacgtttccacggtacctcccgtggtccgtggttcgttccgttcggtggggaccggaaggccggggacccaaccgtaactacctaaaccgtcggacctaaacggtccaacggccgtaaggtacggttttacgttttacgtttacccggaaccccctaaacctaaaacttaaaccgtaaccttacgttaacggtccgtttacggtaaccacggaacgaaacgtaaacgggggtaacgaccggtactacccttaacctaaaccgttccgttagttaacgtttaccggtaccgggttaccttaccggtacccgggtacgttacccggttaccccggggttaaccctaaccgtagttaccgtacggttacggacgtacgggtccgggttcggtacggggtaacccttacgtttaccaaccgtttacctaccctaaccgtaactccgaacgtaccgtacgtccgttacggaccgtacgggtaactaacggtaaaggttacggtgggtaccggttacgtttaagttttacgttaactacggtactaacgttaacctaaacgtttacgttttaacctttaccgtttaccgtttaccgtttaacccgttaccgggtttacgggaacgggtaaccgggtaacgttacgggagttaaaccgtagtaaacccggaacgttaggttaaccggtcggtaccgttaacgaccttaccgttacgttccttaccgttagtcccgttaacccg

SEQ ID NO: 64764 - DNA, 692 bp, Homo sapiens
  misc_feature: GYAE6OF01CQ6MX.31.78.H01.1.454.CMB.1.raw
tcagcagtagacgtcacgaccggtgctcgatttagtgtgagtagtttgggtttgggggagctaacaacaggcaggcaggggcagcaagatggtgttgcagacccaggtcttcatttctctgttgctctggatctctggtgccgtacggggacagtcgtgatgagcctattccagacctccctggctgtgttcctcgtggggacgaggacgggccaacctatacaaactggacaacgtaccagaccaaggtagttgttttaacgttcggaccccaacaaaataaacctaacttaactaacgtcttacggtaaccaagaacaagtaaaaggtacgacgacgaccttacctaaaactcctagtacgttacgtaggtcttaccgtaccggactacggtccggtaccgtaacgtattctagtcggcgtacggtcgggtacgtcgggacgtacgtttcaactcgtaccaacacgtacgaacgtcgaacgtcctacggaacgtacggtacgtagaaagtacgttaggtacggtacttagtttaacttactaggtactagtctaaacgttattaaccttactttacttacgttccgttaacggtttcgaacgggaggtaacgtaggtacggagtaacgacgtaaaacgtacgtagtacggacgtacgaccgtaccgtattacgtaccgttctcgttaacc

SEQ ID NO: 64765 - DNA, 777 bp, Homo sapiens
  misc_feature: GYAE6OF01A3UZH.31.78.H01.1.454.CMB.1.raw
  modified_base (643)..(643): a, c, t, g, unknown or other
  misc_feature (643)..(643): n is a, c, g, or t
  modified_base (735)..(735): a, c, t, g, unknown or other
  misc_feature (735)..(735): n is a, c, g, or t
  modified_base (757)..(757): a, c, t, g, unknown or other
  misc_feature (757)..(757): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgtgctctggatctcgtggtgccgtacgggacatcgtgatgagcctagttccagcctcctggctgtgtctcgtcgggcgaggacggcccacgataccaactgaccacgtccgacgccgaaggtagtttagttttacgttcggacccccaactaacgtaaacctaacgtacgttacgtacttacggtaccagacgaaacgaaaggtaccggaacctaccgtccctaacccgttaaaaccgtccgttagtaacgttttaccggtacgggtccctttacccggtaaccccgggtacttacccgggtttaccccgggggtttaacccctaaccggttactttaccgtaggtttaccgggaccgttacgggtcccggggttaccgtccggggtaacccgtttactttacccgtaccttaccctacccgaacccgtacgtaccgacgtaccgtaccgtcccgtaggaccgtacggacttaaggaacgttgtacggtgtacgttaaggtttactaccgtagtacacggttanaaccgtttattcttaaccgtttcgtttccggtaccgttccgttacggggaccgtaaggtaccgagggtacgaacgtaactacggaacgttgnggtccgcgtacgaccctacgtnttcccgcttccgttgtaccc

SEQ ID NO: 64766 - DNA, 756 bp, Homo sapiens
  misc_feature: GYAE6OF01D7LRQ.31.78.H01.1.454.CMB.1.raw
  modified_base (369)..(369): a, c, t, g, unknown or other
  misc_feature (369)..(369): n is a, c, g, or t
tcagcagtagacgtcacgaccggtgctcgatttagtgtgagtagtttgggtttgggggagctacaacaggcaggcaggggcagcaagatggtgttgcacgacccgaggtcttcaatttctctgttcgctctggatctctggtcgaccgtacggggacagtggtgatagacgtcctagtttcagacctccgtggtctgtcgtccgtgtgggacgacggacggccaacctataccgaacgtcgaccgaacgtccaacgaccgtaaggtacgtttagttttacgttaccggaacccctaaactaaacttaaacctaacttaacgttcgtaacgttacgtaaccgacgaacaaaaggtaaaacgtacggaacnccgtaaccctaaccttaaaacgtccgttagttacgttaccgtaggtccttaccggtaccggtacgacgtttacccgggtacctaaaccgtagttactaggttcgacgtaacgggtcggttacgacgggtacctacgttacgaactccgtactacctaattcgaacgtccgtacgtacgtacggtacgacgtaacggtagaacgttaaggtcgtacgtaaccgttagttttaaccctacggtataaccggtactaacgtaacttaagtttaacctttctttaacgtcgtaccgttaacggtcgggaagggtaacccgagtaacggagaacgtacgaacgtaaccgtagcgtacgactcaccgtaacttcggattcctgtaccgtaccg

SEQ ID NO: 64767 - DNA, 809 bp, Homo sapiens
  misc_feature: GYAE6OF01CC7TN.31.78.H01.1.454.CMB.1.raw
tcagcagtagacgtcacgaccggtgctcgatttagtgtgagtagtttggggtttgggggagctacaacaggcaggcaggggcagcaagatggtgttgcagacccaggtcttcatttctctgttgctctggatctctggtgcctacggggacatcgtgatgagcctagtttccagacctccctgggcttgtgtctcgtgggcgaggacgggcccaaccatccaaactgacaacgtccagccagtagttgttttatccggaccccaactaaataacaactacttagcttaggtaccagacaagaaagtagacacgacctacctaaactcctagtattacgtgggtcttaccgtacccgggactacggttacccggggtttaccctaaccggtacttacgtaagttcggacgtacgggtccggggtacgtacggggtaaccctactttcgaacctccgttaccaaccctatccgaacggtccaacggtcccgtacggaccgtaacgggtaccgttaaggaaacggtagttacgggtacgggtaaccgtttaacgtttttaacgttaccgttacggttaacctaacggtaacctaaacctttaactttaacctttacccgtttttacccggttttaccgttaacccggtttaccgggttttaccggggaaccgggtaacggggtaacccggttaaagggggtacggtaaacggtaaactaacccggaaaaacggttacggttacgggttacgggaccttaccggaacccttaaccgttacgttaccgtttaccttaccgttccttaaaccccg

SEQ ID NO: 64768 - DNA, 506 bp, Homo sapiens
  misc_feature: GYAE6OF02F7G80.31.78.H01.1.454.CMB.1.raw
  modified_base (504)..(504): a, c, t, g, unknown or other
  misc_feature (504)..(504): n is a, c, g, or t
tcagcagtagacgtcacgaccggtgctcgatttagtgtgagtagtttgggtttgggagctacaacaggcaggcagggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgtttattggccccaccaataacaactacttagcttggtaccagcagaaagtaggacagcctctaaactcctgatttactgggcttctacccgggcatccggggttcctaaccgattcattggcagcgggtctgggaccgatttcactctcaccatcagcagcctgcaggctgaagatgtggcagtttatactgtcagcaacattatacttctttcgtctacttttcggcgaggaccaaggtgagatcgaaacgactgtgctgcaccatctgtcttnac

SEQ ID NO: 64769 - DNA, 514 bp, Homo sapiens
  misc_feature: GYAE6OF02ILBYM.31.78.H01.1.454.CMB.1.raw
  modified_base (512)..(512): a, c, t, g, unknown or other
  misc_feature (512)..(512): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccaccaataacaactacttagcttggtaccagcagaaagtaggacagcctcctaaactcctgatttactgggcttctacccgggcatccggggttcctaaccgattcattggcagcgggtctgggaccgatttcactctcaccatcagcagcctgcaggctgaagatgtggcagtttattactgtcagcaacattatacttctttcgtctactttcggcggagggaccaagggtgagatcgaaacgactgtggctgcacatctgtcttnac

SEQ ID NO: 64770 - DNA, 510 bp, Homo sapiens
  misc_feature: GYAE6OF02GLNLU.31.78.H01.1.454.CMB.1.raw
  modified_base (508)..(508): a, c, t, g, unknown or other
  misc_feature (508)..(508): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccaccaataacaactacttagcttggtaccagcagaaagtaggacagcctcctaaactcctgatttactgggcttctacccgggcatccggggttcctaaccgattcattggcagcgggtctgggaccgatttcactctcaccatcagcagcctgcaggctgaagatgtggcagtttattactgtcagcaacattatacttctttcgtctactttcggcgaggaccaaggtgagatcaaacgactgtgctgcaccatctgtcttnac

SEQ ID NO: 64771 - DNA, 516 bp, Homo sapiens
  misc_feature: GYAE6OF02H2N9F.31.78.H01.1.454.CMB.1.raw
  modified_base (406)..(406): a, c, t, g, unknown or other
  misc_feature (406)..(406): n is a, c, g, or t
  modified_base (513)..(513): a, c, t, g, unknown or other
  misc_feature (513)..(513): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttactgggcttctacccgggcatccgggttcctaaccgattcattggcagcgggtctgggaccatttcactctcaccatcagcagcctgcaggctgaagntgtggctagtttattactgtcagcaactattatacttctttcgtctacgtttcgcggaggaccaagggtgagatacgaaacgactgtggctgcaccatctgtccttntac

SEQ ID NO: 64772 - DNA, 516 bp, Homo sapiens
  misc_feature: GYAE6OF02GANHX.31.78.H01.1.454.CMB.1.raw
tcagcagtagacgtcacgaccggtgctcgatttagtgtgagtagtttgggtttggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgtttattggccccaccaataacaactacttagcttggtaccagcagaaagtaggacagcctcctaaactcctgatttactgggcttctacccgggcatccggggttcctaaccgattcattggcagcgggtctgggaccgatttcactctcaccatcagcagcctgcaggctgaagatgtggcagtttatactgtcagcaacattatacttctttcgtctacttttcggcggtagggaccaaggtggagatcgaaacgaactgtggctgcaccatctgtcttctac

SEQ ID NO: 64773 - DNA, 521 bp, Homo sapiens
  misc_feature: GYAE6OF02IS8VD.31.78.H01.1.454.CMB.1.raw
  modified_base (326)..(326): a, c, t, g, unknown or other
  misc_feature (326)..(326): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgtttattggccccacaataacaactacttagcttggtaccagcagaaagtaggacagcctacctaaactcctgatttactgggcttcacccgggnacgtcccgggttccaaccgattcattggcagcgggtctgggaccatttcactctcaccatcagcagtctgcaggctgaagatgtggctagtttatactgtcagcaactattatactttctttacgtctacgtttcggcggtaggaccaagggtgagtatacgaaacgtaactggtgctgacacatctgtctctac

SEQ ID NO: 64774 - DNA, 533 bp, Homo sapiens
  misc_feature: GYAE6OF02IOQEE.31.78.H01.1.454.CMB.1.raw
  modified_base (312)..(312): a, c, t, g, unknown or other
  misc_feature (312)..(312): n is a, c, g, or t
  modified_base (328)..(328): a, c, t, g, unknown or other
  misc_feature (328)..(328): n is a, c, g, or t
  modified_base (346)..(346): a, c, t, g, unknown or other
  misc_feature (346)..(346): n is a, c, g, or t
  modified_base (529)..(529): a, c, t, g, unknown or other
  misc_feature (529)..(529): n is a, c, g, or t
tcagcagtagacgtcacgaccggtgctcgatttagtgtgagtagtttgggtttggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcaagaaagtaggacagcctacctaaactcctgatttacngggcttctacccgggnatccgggttcctaaccgnttcattggcagcgggtctgggaccgtatttcactctcacccatcagccagcctgcaggctgaagatgtggctagtttatactgtcagcaacattataccttcttcgtctaccgtttcggcggtaaggacctaagggtggagactcgaaaacggatcggtggactgctaccattcctgtccttntacc

SEQ ID NO: 64775 - DNA, 511 bp, Homo sapiens
  misc_feature: GYAE6OF02IAJ1D.31.78.H01.1.454.CMB.1.raw
  modified_base (509)..(509): a, c, t, g, unknown or other
  misc_feature (509)..(509): n is a, c, g, or t
tcagcagtagacgtcacgaccggtgctcgatttagtgtgagtagtttgggtttggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttactggcttctaccgggcatccgggttctaaccgattcattggcagcgggtctgggaccgatttcactctcacccatcagcagcctgcaggctgaagatgtggcagtttattactgtcagcaaacattatacttctttcgtctactttcggcggaggaccaagtggagatacaaacgaactgtggctgcaccatctgtccttnac

SEQ ID NO: 64776 - DNA, 511 bp, Homo sapiens
  misc_feature: GYAE6OF02GO6VH.31.78.H01.1.454.CMB.1.raw
  modified_base (411)..(411): a, c, t, g, unknown or other
  misc_feature (411)..(411): n is a, c, g, or t
  modified_base (508)..(508): a, c, t, g, unknown or other
  misc_feature (508)..(508): n is a, c, g, or t
tcagcagtagacgtcacgaccggtgctcgatttagtgtgagtagtttgggtttggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggcccaccaataacaactacttagcttggtaccagcagaaagtaggacagcctcctaaaactcctgatttactgggcttctacccgggcatccggggttcctaaccgattcattggcagcgggtctgggaccgatttcactctcaccatcagcagcctgcaggctgaagatgnggcagtttatactgtcagcaacattatacttctttcgtctactttcggcgaggaccaaggtgagatcgaaacgaactgtggctgcaccatctgtctntac

SEQ ID NO: 64777 - DNA, 520 bp, Homo sapiens
  misc_feature: GYAE6OF02IXDMT.31.78.H01.1.454.CMB.1.raw
  modified_base (518)..(518): a, c, t, g, unknown or other
  misc_feature (518)..(518): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcaagaaagtaggacagcctcctaaactcctgatttactgggcttctacccgggcatccggggttcctaaccgattcattggcagcgggtctgggaccgatttcactctcaccatcagcagcctgcaggctgaagatgtggctagtttatactgtcagcaacattatactttctttcgtctacgtttcggcggagggaccaaggtggagatacgaaacgaactggtggctgacacatctgtcttnac

SEQ ID NO: 64778 - DNA, 738 bp, Homo sapiens
  misc_feature: GYAE6OF02GTUY2.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactcccgtggctgtgtctcgtgggcgaggacggccaccataccaactgacaacgtccacgaccagtagtttagtttttagttccggacccccaacctaaactaaacctaaaccttaacttacgtcgttacggtaaccagacaagaaagtaggacacgcccttacctaaacctcctagtactttacgtcgggtccttaccgtacccgggctacggttcccggggttaccctaaaccggtacttactacgttcggacgacgggtccgggttcgtacggggaacccgttacttttaccgaccttcctacccaacctacttaccgacgtcaccgtccctggaccgacgggtcctaggaaagtacgttgggtcggacgtttaagttttaactttacgttcgtacgaacgtaccaaacttatttaacttaccttttccgttttccgtaccttacggttttccgggacggggtaaccggtaaccgtaaggggttacggagtaacgtaaccgaaaacggtacgttgggttacggactacggacctacctattccgtagtttcccttactacccg

SEQ ID NO: 64779 - DNA, 528 bp, Homo sapiens
  misc_feature: GYAE6OF02INTVC.31.78.H01.1.454.CMB.1.raw
  modified_base (525)..(525): a, c, t, g, unknown or other
  misc_feature (525)..(525): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgtttattggccccaccaataacaactacttagcttggtaccagcagaaagtaggacagcctcctaaactcctgatttactgggcttctacccgggcatccggggttctaaccgattcattggcagcgggtctgggaccgatttcactctcaacatcagcagccctgcaggctgaagatgtggcagtttattactgtcagcaaacatttaatacctttcttttcgtctaacttttcgggcggagggaaccaagggttggagatacgaaacgaactggtgctgcaccatctgtctntac

SEQ ID NO: 64780 - DNA, 515 bp, Homo sapiens
  misc_feature: GYAE6OF02I2P6L.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttactgggcttctacccgggcacgtccggggttcctaaccgattcattggcagcgggtctgggaccatttcactctcaccatcagcagcctgcaggctgaagatgtggctagtttattactgtcagcaacattatactttctttcgtctacgtttcggcggaggaccaagggtgagatacaaacgactgtgctgcacatctgtctctac

SEQ ID NO: 64781 - DNA, 530 bp, Homo sapiens
  misc_feature: GYAE6OF02JEOHH.31.78.H01.1.454.CMB.1.raw
  modified_base (527)..(527): a, c, t, g, unknown or other
  misc_feature (527)..(527): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttactgggcttctacccgggcagtccggggttcctaaccgattcattggcagcgggtctgggaccgatttcactctcaccatcagcagcctgcaggctgaagatgtggctagtttattactgtcagcaactattatactttctttcgtctacgtttcgggcggtagggtacccaagggtggagtatacgaaacgtactgtggctaggcacatctgtccttntac

SEQ ID NO: 64782 - DNA, 516 bp, Homo sapiens
  misc_feature: GYAE6OF02JG100.31.78.H01.1.454.CMB.1.raw
  modified_base (312)..(312): a, c, t, g, unknown or other
  misc_feature (312)..(312): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccaccaataacaactacttagcttggtaccagcagaaagtaggacagcctcctaaactcctgatttacngggcttctacccgggcatccggggttcctaaccgattcattggcagtgggtctgggaccgatttcactctcaccatcagcagcctgcaggctgaagatgtggctagtttatactgtcagcaacattatacttctttcgtctacgtttcggcggtaggaccaaggtggagatcaaacgactgtggctgcaccatctgtcttctac

SEQ ID NO: 64783 - DNA, 508 bp, Homo sapiens
  misc_feature: GYAE6OF02GWSUM.31.78.H01.1.454.CMB.1.raw
  modified_base (328)..(328): a, c, t, g, unknown or other
  misc_feature (328)..(328): n is a, c, g, or t
  modified_base (505)..(505): a, c, t, g, unknown or other
  misc_feature (505)..(505): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattggccccacaataacaactacttagcttggtaccagcagaaagtaggacagcctcctaaactcctgatttactgggcttctacccgggnatccggggttcctaaccgattcattggcagcgggtctgggaccatttcactctcaccatcagcagcctgcaggctgaagatgtggctagtttatactgtcagcaacattatacttcttcgtcacgtttcggcggaggaccaaggtgagatcaaacgactgtgctgcacatctgtctntac

SEQ ID NO: 64784 - DNA, 520 bp, Homo sapiens
  misc_feature: GYAE6OF02GNQPA.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttactgggcttctacccgggcatccggggttcctaaccgattcattggcagcgggtctgggaccatttcactctcaccatcagcagcctgcaggctgaagatgtggctagtttattactgtcagcaaacattatacttctttcgtctacgtttcggcggtaggaccaagggtgagatacgaaacgtactgtggctgacaccatctgtcttctac

SEQ ID NO: 64785 - DNA, 508 bp, Homo sapiens
  misc_feature: GYAE6OF02INLY1.31.78.H01.1.454.CMB.1.raw
  modified_base (231)..(231): a, c, t, g, unknown or other
  misc_feature (231)..(231): n is a, c, g, or t
  modified_base (341)..(341): a, c, t, g, unknown or other
  misc_feature (341)..(341): n is a, c, g, or t
  modified_base (427)..(427): a, c, t, g, unknown or other
  misc_feature (427)..(427): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccacatcaactgcaagtccagccagggtnttttattggcccacaataacaactactagcttggtaccagcagaaagtaggacagcctcctaaactcctgatttactgggcttctaccgggcatccggggttctaaccgnttcattggcagcggtctgggaccgatttcactctcacatcagcagcctgcaggctgaagatgtgctagtttattactgtcagcaanattatacttctttcgtctacgtttcggcgtagggaccaaggtgagactacaacgactgtggctgcacatctgtcttcatcc

SEQ ID NO: 64786 - DNA, 513 bp, Homo sapiens
  misc_feature: GYAE6OF02IHCEX.31.78.H01.1.454.CMB.1.raw
  modified_base (406)..(406): a, c, t, g, unknown or other
  misc_feature (406)..(406): n is a, c, g, or t
  modified_base (433)..(433): a, c, t, g, unknown or other
  misc_feature (433)..(433): n is a, c, g, or t
  modified_base (510)..(510): a, c, t, g, unknown or other
  misc_feature (510)..(510): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgtttattggccccacaataacaactacttagcttggtaccagcagaaagtaggacagcctcctaaactcctgattactgggcttctacccgggcatccggggttcctaaccgattcattggcagcgggtctgggaccgatttcactctcaccatcagcagcctgcaggctgaagntgtggctagtttatactgtcagcaatnttatacttctttcgtctacgtttcggcggaggaccagggtgagatacgaaacgactggtgctgcaccatctgttctntac

SEQ ID NO: 64787 - DNA, 527 bp, Homo sapiens
  misc_feature: GYAE6OF02HV6HI.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttactgggcttctacccgggcatccggggttcctaaccgattcattggcagcgggtctgggaccatttcactctcaccatcagcagcctgcaggctgaagatgtggctagtttattactgtcagcaacatttatacttctttcgtctactttcggcggtagggaccaagggtcggagagtacgaaacggtaactggtggctgacaccatctgttcttctac

SEQ ID NO: 64788 - DNA, 521 bp, Homo sapiens
  misc_feature: GYAE6OF02IIV8G.31.78.H01.1.454.CMB.1.raw
  modified_base (411)..(411): a, c, t, g, unknown or other
  misc_feature (411)..(411): n is a, c, g, or t
  modified_base (518)..(518): a, c, t, g, unknown or other
  misc_feature (518)..(518): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccaccaataacaactacttagcttggtaccagcagaaagtaggacagcctcctaaactcctgatttactgggcttcgtacccgggcatccggggttcttaaccgattcattggcagcgggtctgggaccgatttcactctcaccatcagcagcctgcaggctgaaagntgtggctagtttattactgtcagcaacattatacttctttcgtctactttcggcggaggaccaagggtggagatacgaaacgaactggtggctgcaccatctgtctntac

SEQ ID NO: 64789 - DNA, 514 bp, Homo sapiens
  misc_feature: GYAE6OF02JE7D1.31.78.H01.1.454.CMB.1.raw
  modified_base (504)..(504): a, c, t, g, unknown or other
  misc_feature (504)..(504): n is a, c, g, or t
  modified_base (512)..(512): a, c, t, g, unknown or other
  misc_feature (512)..(512): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttactgggcttctacccgggcatccggggttcctaaccgattcattggcagcgggtctgggaccatttcactctcaccatcagcagcctgcaggctgaagatgtgctagtttatactgtcagcaactattatacttctttcgtctacgtttcggcggaggaccaagggtgagatacgaaacgactggtcgctgcaccntctgtctnac

SEQ ID NO: 64790 - DNA, 544 bp, Homo sapiens
  misc_feature: GYAE6OF02G37AL.31.78.H01.1.454.CMB.1.raw
  modified_base (311)..(311): a, c, t, g, unknown or other
  misc_feature (311)..(311): n is a, c, g, or t
  modified_base (327)..(327): a, c, t, g, unknown or other
  misc_feature (327)..(327): n is a, c, g, or t
  modified_base (345)..(345): a, c, t, g, unknown or other
  misc_feature (345)..(345): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttacngggcttctacccgggnatccgggttcctaaccgnttcattggcagcggtctgggaccatttcactctcaccatcagcagcctgcaggctgaagatgtggctagtttattactgtcagtcaactattaatactttctttcgtctacgttttcggacggtaggtaacctaagggtggagtagtacgaaaacggtaactggtaggctaggcaacctagttcctgttccttctaccg

SEQ ID NO: 64791 - DNA, 518 bp, Homo sapiens
  misc_feature: GYAE6OF02G1C4Z.31.78.H01.1.454.CMB.1.raw
  modified_base (515)..(515): a, c, t, g, unknown or other
  misc_feature (515)..(515): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttactgggcttcgtacccgggcagtccggggttcctaaccgattcattggcagcgggtctgggaccgatttcactctcaccatcagcagcctgcaggctgaagatgtggctagtttatactgtcagacaactattatacttctttcgtctacgtttcggcggtaggaccaggtgagatacgaaacgactgtggctgcacatctgttctntac

SEQ ID NO: 64792 - DNA, 516 bp, Homo sapiens
  misc_feature: GYAE6OF02HK50F.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttactgggcttctacccgggcatccggggttcctaaccgattcattggcagcgggtctgggaccgatttcactctcaccatcagcagcctgcaggctgaagatgtggctagtttattactgtcagcaaactattatactttctttcgtctactttcggcggaggaccaagggtggagatacgaaacgatgtgctgcaccatctgtctcac

SEQ ID NO: 64793 - DNA, 526 bp, Homo sapiens
  misc_feature: GYAE6OF02GM0K4.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctacctaaactcctgatttactgggcttctacccggggcagtcccggggttacctaaccgtattcattggcagcgggtctgggaccatttcactctcaccatcagcagcctgcaggctgaagatgtggctaggtttattactgtcagacaacattatactttctttcgtctactttcggcggaggaccagggtgagatacgaaacgaactggtggctgcaccatctcgttctctac

SEQ ID NO: 64794 - DNA, 555 bp, Homo sapiens
  misc_feature: GYAE6OF02JMBAD.31.78.H01.1.454.CMB.1.raw
  modified_base (315)..(315): a, c, t, g, unknown or other
  misc_feature (315)..(315): n is a, c, g, or t
  modified_base (355)..(355): a, c, t, g, unknown or other
  misc_feature (355)..(355): n is a, c, g, or t
  modified_base (418)..(418): a, c, t, g, unknown or other
  misc_feature (418)..(418): n is a, c, g, or t
  modified_base (502)..(502): a, c, t, g, unknown or other
  misc_feature (502)..(502): n is a, c, g, or t
tcagcagtagacgtcacgaccggtgctcgatttagtgtgagtagtttgggtttgggggtaggcgtacaacaggcaggcgaggggcgagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactactagcttggtaccagcagaaagtaggacagcctcctaaactcctgatttacngggcttcctacccgggcagttccggggttccctaaaccgnttcagttggccagcgggtctggggaccatttcactctcaccatcagcagcctgcaggctgaanatgtaggctagtttattactggtcagacaactattaactactttcgtttctctacgtttcggcgggaaggacctagggtacggngaatacgaaacggacttggtcggctcgacaccctattccgtgttctttacacg

SEQ ID NO: 64795 - DNA, 512 bp, Homo sapiens
  misc_feature: GYAE6OF02IPHFL.31.78.H01.1.454.CMB.1.raw
  modified_base (502)..(502): a, c, t, g, unknown or other
  misc_feature (502)..(502): n is a, c, g, or t
  modified_base (510)..(510): a, c, t, g, unknown or other
  misc_feature (510)..(510): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccaccaataacaactacttagcttggtaccagcagaaagtaggacagcctcctaaactcctgatttactgggcttctacccgggcatccggggttcctaacgattcattggcagcgggtctgggaccgatttcactctcaccatcagcagccctgcaggctgaagatgtggcagtttatactgtcagcaatattatactttctttcgtctactttcggcggaggaccaagggtggagatacgaaagactgtgctgcacntctgtctnac

SEQ ID NO: 64796 - DNA, 519 bp, Homo sapiens
  misc_feature: GYAE6OF02I0QD2.31.78.H01.1.454.CMB.1.raw
  modified_base (412)..(412): a, c, t, g, unknown or other
  misc_feature (412)..(412): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactcccctggctgtgtctctgggcgagagggccaccatcaactgcaagtccagccagagtgttttattggccccaccaataacaactacttagcttggtaccagcagaaagtaggacagcctcctaaactcctgatttactgggcttctacccgggcactccggggttcctaaccgattcattggcagcgggtctggggaccgatttcactctcaccatcagcagcctgcaggctgaagntgtggctagtttatactgtcagcaacattatacttctttcgtctactttcggcgtaggaccaagggtgagatacgaaacgaactggtgctgcaccatctgtctctac

SEQ ID NO: 64797 - DNA, 519 bp, Homo sapiens
  misc_feature: GYAE6OF02F0LU3.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttactgggcttctacccgggcatcccggggttcctaaccgattcattggcagcgggtctgggaccgatttcactctcaccatcagcagcctgcaggctgaagatgtggctagtttatactgtcagcaactattatacttctttcgtctactttcggcggaggaccgaaggtggagatacgaaacgaactgtaggctgcaccatctgtctctac

SEQ ID NO: 64798 - DNA, 504 bp, Homo sapiens
  misc_feature: GYAE6OF02H5QDX.31.78.H01.1.454.CMB.1.raw
  modified_base (411)..(411): a, c, t, g, unknown or other
  misc_feature (411)..(411): n is a, c, g, or t
  modified_base (434)..(434): a, c, t, g, unknown or other
  misc_feature (434)..(434): n is a, c, g, or t
  modified_base (486)..(486): a, c, t, g, unknown or other
  misc_feature (486)..(486): n is a, c, g, or t
  modified_base (502)..(502): a, c, t, g, unknown or other
  misc_feature (502)..(502): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttactgggcttctacccgggcatccggggttcctaaccgattcattggcagcgggtctgggaccgatttcactctcaccatcagcagcctgcaggctgaagatgngctagtttattactgtcagcaanttatacttctttcgtcactttcggcgaggaccaaggtgagatcaaagactgngctgcacatctgtctnac

SEQ ID NO: 64799 - DNA, 532 bp, Homo sapiens
  misc_feature: GYAE6OF02I52M3.31.78.H01.1.454.CMB.1.raw
  modified_base (369)..(369): a, c, t, g, unknown or other
  misc_feature (369)..(369): n is a, c, g, or t
  modified_base (519)..(519): a, c, t, g, unknown or other
  misc_feature (519)..(519): n is a, c, g, or t
tcagcagtagacgtcacgaccggtgctcgatttagtgtgagtagtttgggtttgggggagctacaacaggcaggcaggggcagcaagatggtgttggcagacccaggtcttcatttctcttggtttggctctggatctctcggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctctaaactcctgatttactgggcttctacccgggcagtccggggttcctaaccgattcattggcagcgggtntgggaccgatttcactctcaccatcagcagcctgcaggctgaagatggtggctagtttatacttgtcagcaactattatactttctttcgtctacgtttcgcggaggaccaagggtgagactacgaaacgtaacgtgtgcgtagcaaccnttctgtcttctac

SEQ ID NO: 64800 - DNA, 519 bp, Homo sapiens
  misc_feature: GYAE6OF02H99KW.31.78.H01.1.454.CMB.1.raw
  modified_base (327)..(327): a, c, t, g, unknown or other
  misc_feature (327)..(327): n is a, c, g, or t
  modified_base (374)..(374): a, c, t, g, unknown or other
  misc_feature (374)..(374): n is a, c, g, or t
  modified_base (379)..(379): a, c, t, g, unknown or other
  misc_feature (379)..(379): n is a, c, g, or t
  modified_base (499)..(499): a, c, t, g, unknown or other
  misc_feature (499)..(499): n is a, c, g, or t
  modified_base (512)..(512): a, c, t, g, unknown or other
  misc_feature (512)..(512): n is a, c, g, or t
  modified_base (516)..(516): a, c, t, g, unknown or other
  misc_feature (516)..(516): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtggacagcctcctaaactcctgatttactgggcttcgtacccgggnagtccggggttcctaaccgattcattggcagcgggtctgggaccgtntttcnctctcaccatcagcagcctgcaggctgaagatgtggctagtttattactgtcagcaactattaatacttctttcgtctacgttttcggcggaggaccaaggtgagatacgaaacgactgngtctgcacatctntctntac

SEQ ID NO: 64801 - DNA, 513 bp, Homo sapiens
  misc_feature: GYAE6OF02GNCGF.31.78.H01.1.454.CMB.1.raw
  modified_base (311)..(311): a, c, t, g, unknown or other
  misc_feature (311)..(311): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttacngggcttctacccgggcatccgggttcctaaccgattcattggcagcgggtctgggaccatttcactctcaccatcagcagcctgcaggctgaagatgtggctagtttatactgtcagcaacattatacttctttctctactttcgcggtaggaccaaggtggagactcgaaacgactggtgctgacaccatctgttctctac

SEQ ID NO: 64802 - DNA, 529 bp, Homo sapiens
  misc_feature: GYAE6OF02INJS6.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgtttattggccccacaataacaactactagcttggtaccagcagaaagtaggacagcctacctaaactcctgatttactgggcttcctacccgggcactccggggttcctaaccgattcattggcagcgggtctgggacatttcactctcaccatcagcagcctgcaggctgaagatgtggctagtttatactgtcagcaacattatactttctttcgtctacgtttcggcggtaggacctaagggtgagtatacgaaacgtaacgtgtcggctagcctaaccgatctgtccttctac

SEQ ID NO: 64803 - DNA, 509 bp, Homo sapiens
  misc_feature: GYAE6OF02GIPO6.31.78.H01.1.454.CMB.1.raw
  modified_base (506)..(506): a, c, t, g, unknown or other
  misc_feature (506)..(506): n is a, c, g, or t
tcagcagtagacgtcacgaccggtgctcgatttagtgtgagtagtttgggtttggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagcccagccagagtgttttattggccccacaataacaactacttagcttggtaccagcagaaagtaggacagcctcctaaactcctgatttactgggcttctacccgggcatccggggttcctaaccgattcattggcagcgggtctgggaccatttcactctcaccatcagcagcctgcaggctgaagatgtggcagtttatactgtcagcaacattatacttctttcgtctactttcggcgtaggaccaaggtgagatacgaaacgaactgtgctgcacatctgtctntac

SEQ ID NO: 64804 - DNA, 514 bp, Homo sapiens
  misc_feature: GYAE6OF02FVUE5.31.78.H01.1.454.CMB.1.raw
  modified_base (511)..(511): a, c, t, g, unknown or other
  misc_feature (511)..(511): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttactgggcttctacccgggcatccggggttcctaaccgattcattggcagcgggtctgggaccgatttcactctcaccatcagcagcctgcaggctgaagatgtggctagtttatactgtcagcaacattatacttctttcgtctacgtttcggcgagggaccaagggtgagatacgaaacgactggtgctgcacatctgtctntac

SEQ ID NO: 64805 - DNA, 550 bp, Homo sapiens
  misc_feature: GYAE6OF02GVIIW.31.78.H01.1.454.CMB.1.raw
  modified_base (546)..(546): a, c, t, g, unknown or other
  misc_feature (546)..(546): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactactagcttggtaccagcagaaagtaggacagcctacctaaactcctgactttacgtgggcctttccgtacccgggcaacgttcccgggggttacctaaaccggattccagtttcggcaggtccgggtctggggacccgtatttcgacttctcaaccatcagcagcctgcaggctgaagatgtggctagtttacttactgtcagcaactattatactttctttcgtctacgtttcggcggtaggaccaaggtgagatacgaaacgtactggtgctgcactatctgttctntacg

SEQ ID NO: 64806 - DNA, 511 bp, Homo sapiens
  misc_feature: GYAE6OF02JGSQ5.31.78.H01.1.454.CMB.1.raw
  modified_base (477)..(477): a, c, t, g, unknown or other
  misc_feature (477)..(477): n is a, c, g, or t
  modified_base (509)..(509): a, c, t, g, unknown or other
  misc_feature (509)..(509): n is a, c, g, or t
tcagcagtagacgtcacgaccggtgctcgatttagtgtgagtagtttgggtttggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgtttattggccccacaataacaactacttagcttggtaccagcagaaagtaggacagcctcctaaactcctgatttactgggcttctacccgggcatccggggttcctaaccgattcattggcagcgggtctgggaccgatttcactctcaccatcagcagcctgcaggctgaagatgtggctagtttattactgtcagcaacattatactttctttcgtctactttcggcggaggaccagggtganatcgaaagaactgtgctgcaccatctgtcttnac

SEQ ID NO: 64807 - DNA, 569 bp, Homo sapiens
  misc_feature: GYAE6OF02HKCD5.31.78.H01.1.454.CMB.1.raw
  modified_base (341)..(341): a, c, t, g, unknown or other
  misc_feature (341)..(341): n is a, c, g, or t
tcagcagtagacgtcacgaccggtgctcgatttagtgtgagtagtttgggtttgggggtaggcgtacaacaggcaggcaggggcgagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttatttggccccaccaataacaactacttagcttggtaccagcagaaaagtaggaacagtccctcctaaaactcctagatttactgggccttctaccccgggnaagtccggggttccaaccgtattcacttggcagcgggtctgggacccagtttcactctcacatcagcagctgcagctgaagatgtggcagtttaattactgtcaagcaaacattactaacttcgttttcgctaaccgtttcggtccgggaaggaacccgtaaagtggagagttacaaaacgaagtcgtagggtcctggactacccgaattccgtgttcccttataacc

SEQ ID NO: 64808 - DNA, 522 bp, Homo sapiens
  misc_feature: GYAE6OF02I81CP.31.78.H01.1.454.CMB.1.raw
  modified_base (510)..(510): a, c, t, g, unknown or other
  misc_feature (510)..(510): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttactgggcttctacccgggcatccggggttcctaaccgattcattggcagcgggtctgggaccgatttcactctcaccatcagcagcctgcaggctgaagatgtggctagtttattactgtcagcaactattattacttctttcgtctacgtttcggcggaggtaccaaggtggagatacgaaacgtactggtagctgcaccntctgttctctac

SEQ ID NO: 64809 - DNA, 543 bp, Homo sapiens
  misc_feature: GYAE6OF02IX4JS.31.78.H01.1.454.CMB.1.raw
  modified_base (312)..(312): a, c, t, g, unknown or other
  misc_feature (312)..(312): n is a, c, g, or t
  modified_base (328)..(328): a, c, t, g, unknown or other
  misc_feature (328)..(328): n is a, c, g, or t
  modified_base (538)..(538): a, c, t, g, unknown or other
  misc_feature (538)..(538): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacgggacatcgtgatgagccagtttccagactccctggctgtgtctctgggcgagagggccaccatcaactgcaagtccagccagagtgttttattggccccacaataacaactattagcttggtaccagcagaaagtaggacagccctacctaaactcctgactttacnggcttctaccccgggnatcccggggttcctaaccgattcattggcagcgggtctgggaccgatttcactctcaccatcagcagcctgcaggctgaagatgtggctagtttatactgttccagcaaactattatacctttctttccgtcttaccgtttcgggacggaggtaccaagggtcgtagatacaaacgaacttggtagctgaccaccgatccgtgtccgttntaccg

SEQ ID NO: 64810 - DNA, 524 bp, Homo sapiens
  misc_feature: GYAE6OF02F7VZ2.31.78.H01.1.454.CMB.1.raw
  modified_base (310)..(310): a, c, t, g, unknown or other
  misc_feature (310)..(310): n is a, c, g, or t
  modified_base (326)..(326): a, c, t, g, unknown or other
  misc_feature (326)..(326): n is a, c, g, or t
  modified_base (521)..(521): a, c, t, g, unknown or other
  misc_feature (521)..(521): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctctaaactcctgatttacngggcttctacccgggnatccgggttcctaaccgattcattggcagcggtctgggaccgatttcactctcaccatcagcagcctgcaggctgaagatgtggctagtttatactgtcagcaactattatactttctttcgtctacgtttcggacgagggtacctaagggtcgagatacgaaacgaactggtacggctgcacctatctgttctntac

SEQ ID NO: 64811 - DNA, 530 bp, Homo sapiens
  misc_feature: GYAE6OF02I3OCS.31.78.H01.1.454.CMB.1.raw
  modified_base (527)..(527): a, c, t, g, unknown or other
  misc_feature (527)..(527): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttactgggcttcgtacccgggcagtcccggggttcctaaccgattcattggcagcgggtctgggaccatttcactctcaccatcagcagcctgcaggctgaagatgtggctagtttattactgtcagacaactattatactttctttcgtctacgtttcggcggtacggaacctaagggtggagtatacgaaacgtactggtagctgacacatctgttctntac

SEQ ID NO: 64812 - DNA, 511 bp, Homo sapiens
  misc_feature: GYAE6OF02F610S.31.78.H01.1.454.CMB.1.raw
  modified_base (508)..(508): a, c, t, g, unknown or other
  misc_feature (508)..(508): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttactgggcttctacccgggcatccggggttcctaaccgattcattggcagcgggtctgggaccgatttcactctcaccatcagcagcctgcaggctgaagatgtggcagtttatactgtcagcaacattatacttctttcgtctactttcggcgagggaccaaggtgagatcgaaacgaactggtgctgcacatctgtctntac

SEQ ID NO: 64813 - DNA, 544 bp, Homo sapiens
  misc_feature: GYAE6OF02I2Q74.31.78.H01.1.454.CMB.1.raw
  modified_base (309)..(309): a, c, t, g, unknown or other
  misc_feature (309)..(309): n is a, c, g, or t
  modified_base (539)..(539): a, c, t, g, unknown or other
  misc_feature (539)..(539): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgtttattggccccacaataacaactacttagcttggtaccagcagaagtaggacagcctcctaaactcctgatttacngggcttctacccgggcatccggggttctaaccgattcattggcagcgggtctgggaccatttcactctcaccatcagcagcctgcaggctagaagatgtaggctagtttatactgtcagcaactattatactttctttcgtcacgttttcggacggtagggtaaccaagggtggagataccgaaacgtaaactggtcggacttggacctaccgtattctacggttccttntaacg

SEQ ID NO: 64814 - DNA, 523 bp, Homo sapiens
  misc_feature: GYAE6OF02H6MX8.31.78.H01.1.454.CMB.1.raw
  modified_base (520)..(520): a, c, t, g, unknown or other
  misc_feature (520)..(520): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttactgggcttctacccgggcagtccggggttcctaaccgattcattggcagcgggtctgggaccgatttcactctcaccatcagcagcctgcaggctgaagatgtggctagtttaatacgtgtcagcaactattattacctttctttcgtctacgtttcgggcggagggaccaagggtgagatacgaacgactgtggctgcacatctgtcttntac

SEQ ID NO: 64815 - DNA, 525 bp, Homo sapiens
  misc_feature: GYAE6OF02GVBD4.31.78.H01.1.454.CMB.1.raw
  modified_base (522)..(522): a, c, t, g, unknown or other
  misc_feature (522)..(522): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttactgggcttctacccgggcacgtccggggttcctaaccgattcattggcagcgggtctgggaccatttcactctcaccatcagcagcctgcaggctgaagatgtggctagtttattactgtcagcaactattatactttctttcgtctacgtttcgggcggtacggaccaaggtggagatacgaaacgactggtcggctgcacattctgtcttntac

SEQ ID NO: 64816 - DNA, 520 bp, Homo sapiens
  misc_feature: GYAE6OF02ITEPO.31.78.H01.1.454.CMB.1.raw
  modified_base (517)..(517): a, c, t, g, unknown or other
  misc_feature (517)..(517): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttactgggcttctacccgggcagtccggggttcctaaccgattcattggcagcgggtctgggaccgatttcactctcaccatcagcagcctgcaggctgaagatgtggctagtttattactgtcagcaactattatactttctttcgtctacgtttcggcggtaggaccaaggtggagtatacgaaacgactggtgctgcacatctgtctntac

SEQ ID NO: 64817 - DNA, 528 bp, Homo sapiens
  misc_feature: GYAE6OF02JTM5L.31.78.H01.1.454.CMB.1.raw
  modified_base (406)..(406): a, c, t, g, unknown or other
  misc_feature (406)..(406): n is a, c, g, or t
  modified_base (449)..(449): a, c, t, g, unknown or other
  misc_feature (449)..(449): n is a, c, g, or t
  modified_base (478)..(478): a, c, t, g, unknown or other
  misc_feature (478)..(478): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggcccacaataacaactactagcttgtaccagcagaaagtaggacagcctactaaactcctgatttactggcttctacccgggcactccgggttacctaacgattcattggcagcggtctgggaccctatttcactctacacctatcagcagcctgcaggctgaagntgtgctagtttatactgtcagctaactattatacttcgtttcnctactttcggcgacggacctaaggtgganacgtacaaacggtatggtcgtactgactaccgatcctagtccttataccg

SEQ ID NO: 64818 - DNA, 554 bp, Homo sapiens
  misc_feature: GYAE6OF02H7JLY.31.78.H01.1.454.CMB.1.raw
  modified_base (325)..(325): a, c, t, g, unknown or other
  misc_feature (325)..(325): n is a, c, g, or t
  modified_base (441)..(441): a, c, t, g, unknown or other
  misc_feature (441)..(441): n is a, c, g, or t
tcagcagtagacgtcacgaccggtgctcgatttagtgtgagtagtttgggtttggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattggccccacaataacaactactagcttggtaccagcaagaaagtaggacagcctcctaaactcctagattactggcttcacccgggnagtccggggttcctaaccgattcattggctagcgggtctgggacctatttcactctcaccatcagcagcctgcaggctagaagatgtggactagtttacttactgtcagcaaactnttatacttctttcgtctacgtttcggcggtaggacctaagggtcgacgtagttaccgaaacggtactggtacggtctaggtccaaccgtagttccgtacgttccttactaccg

SEQ ID NO: 64819 - DNA, 515 bp, Homo sapiens
  misc_feature: GYAE6OF02JFOSB.31.78.H01.1.454.CMB.1.raw
  modified_base (298)..(298): a, c, t, g, unknown or other
  misc_feature (298)..(298): n is a, c, g, or t
  modified_base (308)..(308): a, c, t, g, unknown or other
  misc_feature (308)..(308): n is a, c, g, or t
  modified_base (321)..(321): a, c, t, g, unknown or other
  misc_feature (321)..(321): n is a, c, g, or t
  modified_base (393)..(393): a, c, t, g, unknown or other
  misc_feature (393)..(393): n is a, c, g, or t
  modified_base (498)..(498): a, c, t, g, unknown or other
  misc_feature (498)..(498): n is a, c, g, or t
  modified_base (511)..(511): a, c, t, g, unknown or other
  misc_feature (511)..(511): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaatacaactacttagcttggtaccagcagaaagtaggacagcctctaaacncctgattacnggcttctaccggnatccgggttctaaccgattcattggcagcgggtctggacattcacgtctcaccatcagcagctgcagctganatgtgcagttacttactgtcagcaacattagtacttcttacgtctactttcgcggtaggaccaaggttgagtatacgaaacgatggtgccttaggcctaaccgtntacgtgttccttntacg

SEQ ID NO: 64820 - DNA, 516 bp, Homo sapiens
  misc_feature: GYAE6OF02GUJKK.31.78.H01.1.454.CMB.1.raw
  modified_base (513)..(513): a, c, t, g, unknown or other
  misc_feature (513)..(513): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctctaaactcctgattactgggcttctacccgggcactccggggttcctaaccgattcattggcagcgggtctgggaccatttcactctcaccatcagcagcctgcagctgaagatgtggctagtttattactgtcagcaacattatactttctttcgtctacgtttcggcggtaggacctaaggtgagatacgaaacgaactgtggctgcaccatctgtctntac

SEQ ID NO: 64821 - DNA, 519 bp, Homo sapiens
  misc_feature: GYAE6OF02H352W.31.78.H01.1.454.CMB.1.raw
  modified_base (516)..(516): a, c, t, g, unknown or other
  misc_feature (516)..(516): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcaagaaagtaggacagcctcctaaactcctgatttactgggcttctacccgggcagtccggggttcctaaccgattcattggcaggcgggtctgggaccgtattcactctcaccatcagcagcctgcaggctgaatatgtggctagtttattactgtcagcaactattatacttctttcgttctactttcggcggaggaccaaggtggagatacgaacgaactgtggctgcacatctgtctntac

SEQ ID NO: 64822 - DNA, 556 bp, Homo sapiens
  misc_feature: GYAE6OF02HAP4U.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccaacaataacaactacttagcttggtaccagcagaaagtaggacagcctacctaaactcctagatttacgtgggcttcctacccgggcacgtccggggttcctaaccgattcattcggcagcgggtctgggaccgatttcactctcaccatcagcagcctgcaggctgaagatgtggctagtttattactgtcagcaactattattacctttctttcgtctacgtttcgggacggtacggaaccgaaggtggagtatacgaaaacggtaacttggtcggacctgacctacctattcctacgttccttctacg

SEQ ID NO: 64823 - DNA, 536 bp, Homo sapiens
  misc_feature: GYAE6OF02FLURV.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccagtcaaactgcaagtccagccagatgttttattggccccaccaataaacaactacttagcttggtaccagcagaaagtaggacagcccgtctaaaactcctgatttactgggcttctacccgggcatccggggttcctaaaccgattcattggcagcgggtctgggaccgatttcactctcaccatcaagcagcctgcaggctgaagatgtaggctaagtttattactgtcagcaacattatacttctttcgtctacttttcggcggtagggaccaagggtggagatacgaaacgaacttggtggctgcaccatctggttctctaacg

SEQ ID NO: 64824 - DNA, 512 bp, Homo sapiens
  misc_feature: GYAE6OF02I4NFO.31.78.H01.1.454.CMB.1.raw
  modified_base (347)..(347): a, c, t, g, unknown or other
  misc_feature (347)..(347): n is a, c, g, or t
  modified_base (509)..(509): a, c, t, g, unknown or other
  misc_feature (509)..(509): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctacctaaactcctgatttactgggcttctacccgggcatccggggttcctaaccgnttcattggcagcgggtctgggaccatttcactctcaccatcagcagcctgcaggctgaagatgtgctagtttatactgtcagcaactattatacttctttcgtctacgtttcgcggtaggaccaaggtgagatacgaaacgactgtgctgcacatctgtctntac

SEQ ID NO: 64825 - DNA, 523 bp, Homo sapiens
  misc_feature: GYAE6OF02GU5PV.31.78.H01.1.454.CMB.1.raw
  modified_base (310)..(310): a, c, t, g, unknown or other
  misc_feature (310)..(310): n is a, c, g, or t
  modified_base (485)..(485): a, c, t, g, unknown or other
  misc_feature (485)..(485): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctctaaactcctgatttacngggcttctacccgggcacgtccgggttcctaaccgattcattggcaggcgggtctcgggaccgattcactctcaccatcagcagcctgcaggctgaaagatgtcggctagtttattactgtcagaccaacattatactttctttcgtctacgtttcgcgggaggaacgagtgganactacgaaacgaatggtggctgcacatctcgtctctac

SEQ ID NO: 64826 - DNA, 515 bp, Homo sapiens
  misc_feature: GYAE6OF02FKOX2.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctctaaactcctgatttactgggcttctacccgggcatccggggttcctaaccgattcattggcagcgggtctgggaccgatttcactctcaccatcagcagcctgcaggctgaagatgtggctagtttattactgtcagcaacattatactttctttcgtactacgtttcggcgtaggaccaagggtgagatcgaaacgatgtggctgcaccatctgtcttcac

SEQ ID NO: 64827 - DNA, 537 bp, Homo sapiens
  misc_feature: GYAE6OF02H0S8J.31.78.H01.1.454.CMB.1.raw
tcagcagtagacgtcacgaccggtgctcgatttagtgtgagtagtttgggtttggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctacctaaactcctgatttacgtggcttcctacccgggcacgtcccggggttcctaaccgattcattggcagcgggtctgggaccgtatttcactctcaccatcagcagcctgcaggctgaagatgtggctagtttattactgtcagcaactattatacttctttcgtctactttcggcggtaggaccaagggtggagactacgaaacgtaactggtacggctgaccaccattccgtgttccttctac

SEQ ID NO: 64828 - DNA, 530 bp, Homo sapiens
  misc_feature: GYAE6OF02HLKJH.31.78.H01.1.454.CMB.1.raw
  modified_base (519)..(519): a, c, t, g, unknown or other
  misc_feature (519)..(519): n is a, c, g, or t
  modified_base (528)..(528): a, c, t, g, unknown or other
  misc_feature (528)..(528): n is a, c, g, or t
tcagcagtagacgtcacgaccggtgctcgatttagtgtgagtagtttgggtttggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttactgggcttctaccccggggcacgttcccggggttacctaaccgatttcatttggcaggccgggtctggggaccgtatttcactctcaccatcagcagcctgcaggctgaagatgtggctagtttattactgtcagacaactattatactttctttcgtctacgtttcggcggacggaccaggtggagatacgaaacgactggtgctgcacntctgtcttnac

SEQ ID NO: 64829 - DNA, 515 bp, Homo sapiens
  misc_feature: GYAE6OF02I6BMD.31.78.H01.1.454.CMB.1.raw
  modified_base (326)..(326): a, c, t, g, unknown or other
  misc_feature (326)..(326): n is a, c, g, or t
  modified_base (512)..(512): a, c, t, g, unknown or other
  misc_feature (512)..(512): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttactgggcttctacccggnatccgggttcctaaccgattcattggcagcgggtctgggaccgatttcactctcaccatcagcagcctgcaggctgaagatgtggctagtttattactgtcagcaacattatacttctttcgtctacgtttcgcggtacggacgaaggtggagatacgaaacgtactgtgctgcacatctcgtctntac

SEQ ID NO: 64830 - DNA, 533 bp, Homo sapiens
  misc_feature: GYAE6OF02J03Y0.31.78.H01.1.454.CMB.1.raw
  modified_base (325)..(325): a, c, t, g, unknown or other
  misc_feature (325)..(325): n is a, c, g, or t
  modified_base (409)..(409): a, c, t, g, unknown or other
  misc_feature (409)..(409): n is a, c, g, or t
  modified_base (529)..(529): a, c, t, g, unknown or other
  misc_feature (529)..(529): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgattactggcttctacccgggnactccgggttcctaaccgattcattggcagcgggtctcgggaccgtatttcactctcaccatcagcagcctgcaggctagaagngtgtgcagtttatacgtgtacagcaactattactactttctttcgtactacgtttcggcggtacggaccgtaaggtcgagactacgaaacgtactggtagcgtagcaccagtctcgtctntacg

SEQ ID NO: 64831 - DNA, 518 bp, Homo sapiens
  misc_feature: GYAE6OF02GPZ0W.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctacctaaactcctgatttactgggcttctacccgggcatcccggggttcctaaccgattcattggcagcgggtctgggaccatttcactctcaccatcagcagcctgcaggctgaagatgtggctagtttatactgtcagcaacattatacttctttcgtctacgtttcggcggaggaccaaggtgagactacgaaacgactggtcgctgacaccatctgtctctac

SEQ ID NO: 64832 - DNA, 515 bp, Homo sapiens
  misc_feature: GYAE6OF02GUWYS.31.78.H01.1.454.CMB.1.raw
  modified_base (311)..(311): a, c, t, g, unknown or other
  misc_feature (311)..(311): n is a, c, g, or t
  modified_base (327)..(327): a, c, t, g, unknown or other
  misc_feature (327)..(327): n is a, c, g, or t
  modified_base (512)..(512): a, c, t, g, unknown or other
  misc_feature (512)..(512): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttacngggcttctacccgggnatccgggttctaaccgattcattggcagcgggtctgggaccatttcactctcaccatcagcagcctgcaggctagaagatgtggctagtttatactgtcagcaacattatactttctttcgtctactttcggcggtaggaccaaggtgagatacgaaacgtactggtagctgcaccatctgtctntac

SEQ ID NO: 64833 - DNA, 519 bp, Homo sapiens
  misc_feature: GYAE6OF02INZLE.31.78.H01.1.454.CMB.1.raw
  modified_base (344)..(344): a, c, t, g, unknown or other
  misc_feature (344)..(344): n is a, c, g, or t
  modified_base (403)..(403): a, c, t, g, unknown or other
  misc_feature (403)..(403): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgtttattggccccacaataacaactacttagcttggtaccagcagaaagtaggacagcctcctaaactcctgatttactgggcttctaccgggcactccggggttcctaacgnttcattggcagcgggtctgggaccatttcactctcaccatcagcagcctgcagctgaanatgtggctagtttatactgtcagcaactattatactttctttcgtctacgtttcggcggtaggaccaagggtgagactacgaaacgtaactgtggctgacacatctcgttctctac

SEQ ID NO: 64834 - DNA, 554 bp, Homo sapiens
  misc_feature: GYAE6OF02GZDS5.31.78.H01.1.454.CMB.1.raw
  modified_base (327)..(327): a, c, t, g, unknown or other
  misc_feature (327)..(327): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttactgggcttctacccgggnacgtccggggttcctaaccgattcattggcagcgggtctgggaccatttcactctcaccatcagcagcctgcaggctgaagatgtggctagtttattactgtcagcaatattatactttctttcgtctacgtttcggacgggtacggaccgtaaggtcggagtactacgaaaacgtacgttaggtacggtctaggccaaccgtacttccgtaggttccttacgtacc

SEQ ID NO: 64835 - DNA, 521 bp, Homo sapiens
  misc_feature: GYAE6OF02FPNSR.31.78.H01.1.454.CMB.1.raw
  modified_base (311)..(311): a, c, t, g, unknown or other
  misc_feature (311)..(311): n is a, c, g, or t
  modified_base (518)..(518): a, c, t, g, unknown or other
  misc_feature (518)..(518): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttacngggcttctacccgggcatacggggttcctaaccgattcattggcagcgggtctgggaccgatttcactctcaccatcagcagcctgcaggctgaagatgtggctagtttatactgtcagcaacattatacttctttcgtctacgtttcggcggtaggacctaaggtggagatacgaaacggaactggtggctgcaccatctgttctntac

SEQ ID NO: 64836 - DNA, 531 bp, Homo sapiens
  misc_feature: GYAE6OF02HFHB2.31.78.H01.1.454.CMB.1.raw
  modified_base (312)..(312): a, c, t, g, unknown or other
  misc_feature (312)..(312): n is a, c, g, or t
tcagcagtagacgtcacgaccggtgctcgatttagtgtgagtagtttgggtttgggggagctacaacaggcaggcaggggaagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctacctaaactcctgatttacngggtcttcgtacccgggcacgtccggggttcctaaccgattcattggcagcgggtctcgggaccgtatttcactctcaccatcagcagcctgcaggctgaagatgtggctagtttattactgtcagcaactattatactttctttcgtctacgtttcggcggtacggaccaaggtggagatacgaaacgactgtggctgccacatctgtcttcatcccg

SEQ ID NO: 64837 - DNA, 545 bp, Homo sapiens
  misc_feature: GYAE6OF02HLRCS.31.78.H01.1.454.CMB.1.raw
tcagcagtagacgtcacgaccggtgctcgatttagtgtgagtagtttgggtttgggggagctacaacaggcaggcaggtgcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactactagcttggtaccagcagaaagtaggacagcctcctaaactcctagatttactggccttcgtacccgggcacgttccggggttcctaaccgattcattggcagcgggtctgggacgattcactctcaccatcagcagcctgcaggctgaagatgtgctagtttatactgtcagacaactattactactttctttcgtctacgtttcggacggtagggaccgtaaggtggaagtacgtaacgaaacggaactagttacggctacgaccaacctagtcttgtcttaccg

SEQ ID NO: 64838 - DNA, 789 bp, Homo sapiens
  misc_feature: GYAE6OF02IJ6OZ.31.78.H01.1.454.CMB.1.raw
tcagcagtagacgtcacgaccggtgctcgatttagtgtgagtagtttgggtttgggggatctacaacaggcaggcaggggcagcaagatggtgttgcagacccaggtcttcatttctctgttgctctggatctctggtgcctacggggacatcgtgatgagccagtttccagactccatggctgtgtctctgggcgagagggccaccatcaaaccgtcgaacgtacacgacgacgagtagttttagttttaggtcccgaccccaactaaactaaacctaaactttaacgtacgttcggttaccgtaaccgacgacgaaaagtaaaggtacggaacgaccgtccccttaaaacctaacccttccgaagtttaactttacgggcggttccttaccccgggtacccggataccggggtttccccggttaaccccgtaacgttctacttaggtcgacgacgggtcgtcgggtaccgggacgtttacttactaccttctacccactactacgacgacgacccgtcgtcgacgggaccgtcgtaaaaggaaagtggttggggtaccgaagtttttaaacgtttttaacctacggttcgtaacgaccgaaactaactttaatttaaaccttttcctttttccgtttaccgtaccgtttttaccgggttccgggggaaacgggtacccgtaaaacggttaggggtacgggaaacttccgaaaaacccggtaaaaccggttggttggggtaccgtacgtccgaaaccgtaaccttcgtttcgttccgttcttaacccg

SEQ ID NO: 64839 - DNA, 541 bp, Homo sapiens
  misc_feature: GYAE6OF02I41F4.31.78.H01.1.454.CMB.1.raw
  modified_base (538)..(538): a, c, t, g, unknown or other
  misc_feature (538)..(538): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctacctaaactcctgatttactgggcttctacccgggcactccggggttcctaaccgattcattggcagcgggtctgggaccgatttcactctcaccatcagcagcctgcaggctgaagatgtggctagtttattactgtcagcaaacattattactttctttcgtctacgttttcgggcggtagggtaaccaagggtggagatacgaaacgtaactggtacggctggacaccattcctagttccttntac

SEQ ID NO: 64840 - DNA, 526 bp, Homo sapiens
  misc_feature: GYAE6OF02HXA82.31.78.H01.1.454.CMB.1.raw
  modified_base (309)..(309): a, c, t, g, unknown or other
  misc_feature (309)..(309): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagaggaccaccatcaactgcaagtccagccagagtgttttattggccccacaataacaactactagcttggtaccagcagaaagtaggacagcctctaaactcctgatttacnggcttctacccgggcacgtccggggttcctaacgattcattggcagcgggtctgggaccatttcactctcaccatcagcagcctgcaggctgaagatgtgctagtttatactgtcagcaactattattacttctttcgtctacgtttcggacggtacgggacctaagggtgagatacgaaacgtaactggtgctgacacctatcctgttccttctac

SEQ ID NO: 64841 - DNA, 570 bp, Homo sapiens
  misc_feature: GYAE6OF02HDIUW.31.78.H01.1.454.CMB.1.raw
  modified_base (312)..(312): a, c, t, g, unknown or other
  misc_feature (312)..(312): n is a, c, g, or t
  modified_base (450)..(450): a, c, t, g, unknown or other
  misc_feature (450)..(450): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctacctaaactcctgatttacngggcttcacccgggcagtccgggttcctaaccgattcattggcaggcggtctgggaccatttcactctcaccatcagcagccctgcaggctagaagatgtggctagtttatactgtcagacaactattattacctttntttccgtcttacgtttcgggacggtaggtaacccgaaggtggagtaacgtacgaaaacggtacttggtacggacgttacgacctaaccgtaacgttccgttacggttcttaccgtaaccg

SEQ ID NO: 64842 - DNA, 590 bp, Homo sapiens
  misc_feature: GYAE6OF02JAOFQ.31.78.H01.1.454.CMB.1.raw
  modified_base (420)..(420): a, c, t, g, unknown or other
  misc_feature (420)..(420): n is a, c, g, or t
  modified_base (455)..(455): a, c, t, g, unknown or other
  misc_feature (455)..(455): n is a, c, g, or t
tcagcagtagacgtcacgaccggtgctcgatttagtgtgagtagtttgggtttgggggaggctacaaacaggcaggccaggggcagcaagatgggtgttgcagacccagggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcaagaaagtaggacagcctcctaaactcctgactttactgggccttcgtacccgggcagttcccggggttacctaaacccgatttccaattcggcacggccgggtctgggaaccgattttccaactcctacactatcgaancagcctgcaggctgaagatgtggctagtttatacngttcagcaacattatacttctttacgtctaacctttgggaccgtagggtaaccaaggttcggagtactacgaaaccggtaacttggtacggtactaggaccgtaacccagttaccgttagttcctttactaaccg

SEQ ID NO: 64843 - DNA, 522 bp, Homo sapiens
  misc_feature: GYAE6OF02IQRPT.31.78.H01.1.454.CMB.1.raw
  modified_base (346)..(346): a, c, t, g, unknown or other
  misc_feature (346)..(346): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttactgggcttctacccgggcagtccgggttcctaaccgnttcattggcagcgggtctgggaccgatttcactctcaccatcagcagcctgcaggctgaagatgtggctagtttatactgtcagcaactattatacttctttcgtctacgtttcggcggtaggacctaaggtggagtatacgaaacgactggtcggctgacacatctgttctctac

SEQ ID NO: 64844 - DNA, 591 bp, Homo sapiens
  misc_feature: GYAE6OF02H3Q1N.31.78.H01.1.454.CMB.1.raw
  modified_base (246)..(246): a, c, t, g, unknown or other
  misc_feature (246)..(246): n is a, c, g, or t
  modified_base (298)..(298): a, c, t, g, unknown or other
  misc_feature (298)..(298): n is a, c, g, or t
  modified_base (326)..(326): a, c, t, g, unknown or other
  misc_feature (326)..(326): n is a, c, g, or t
  modified_base (391)..(391): a, c, t, g, unknown or other
  misc_feature (391)..(391): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcagagggccaccatcaatgcaagtccagccagagtgttttattggcccccanaataacaactacttagcttggtaccagcagaaagtggacagcctcctaaacncctagattactggacttctaacccgggnaacgtccggggttacctaaccgattcattacggcagccgggtctgggacctattcactctcaccntcagcagcctgcaggctgaaagtcgtgtggctaggtttacttacgtgtacagcaaactatttaatactttccgtttactcttaccgttttcggcgggaacgggtaacccgtaagggtcggagtagttacccgaaaacggtaaccttgggtaggtcctaagccgaacccgttagttaccgtactttaccgttacctaaccg

SEQ ID NO: 64845 - DNA, 515 bp, Homo sapiens
  misc_feature: GYAE6OF02GISR4.31.78.H01.1.454.CMB.1.raw
  modified_base (413)..(413): a, c, t, g, unknown or other
  misc_feature (413)..(413): n is a, c, g, or t
  modified_base (481)..(481): a, c, t, g, unknown or other
  misc_feature (481)..(481): n is a, c, g, or t
  modified_base (512)..(512): a, c, t, g, unknown or other
  misc_feature (512)..(512): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgactttactgggcttctacccgggcatccggggttcctaaccgattcattggcagcgggtctgggaccgtatttcactctcacatcagcagcctgcaggctagaagatgngctagtttatactgtcagcaactattatactttctttcgtctactttcgggacgtaggaccagtgagntacgaaacgatcgtgactgcacatctgtctntac

SEQ ID NO: 64846 - DNA, 558 bp, Homo sapiens
  misc_feature: GYAE6OF02JCRBG.31.78.H01.1.454.CMB.1.raw
  modified_base (315)..(315): a, c, t, g, unknown or other
  misc_feature (315)..(315): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagtgttttattcggccccacaataacaactacttagcttggtaccagcagaaagtaggacagcctacctaaactcctgatttacgngggtcttctacccgggcagtcccggggttacctaaccgattccatttcggcacggtcgggtctcggggaccgtagttttccactccgtcaccatcagcagccctgcaggctgaagatgtgctagtttatactgtcagacaactattatactttctttcgtactacgtttcgggcggacggacctaagggtgacgatacgaaacgaaccttggtacggctgacacctatcctgttccttctacc

SEQ ID NO: 64847 - DNA, 525 bp, Homo sapiens
  misc_feature: GYAE6OF02HUN87.31.78.H01.1.454.CMB.1.raw
  modified_base (522)..(522): a, c, t, g, unknown or other
  misc_feature (522)..(522): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggcccccacaataacaactacttagcttggtaccagcagaaagtaggacagcctcctaaactcctgatttactgggcttcgtacccgggcacgtccggggttcctaaccgattcattggcagcgggtctgggaccatttcactctcaccatcagcagcctgcaggctgaagatgtggctagtttattactgtcagcaactattatacttctttcgtctactttcggcggtaggaccgaagtggagtatacgaaacgtaactgtggtctgcactatctcgtctntac

SEQ ID NO: 64848 - DNA, 522 bp, Homo sapiens
  misc_feature: GYAE6OF02GBTBR.31.78.H01.1.454.CMB.1.raw
  modified_base (409)..(409): a, c, t, g, unknown or other
  misc_feature (409)..(409): n is a, c, g, or t
  modified_base (436)..(436): a, c, t, g, unknown or other
  misc_feature (436)..(436): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtagacagcctcctaaactcctgatttactgggcttcgtacccgggcagtccggggttcctaaccgattcattggcagcgggtctgggaccgatttcactctcaccatcagcagcctgcaggctgaagntgtggctagtttatacgtgtcagcaanttatactttctttcgtctactttcggcggtaggaccaagggtgagatacgaaacgactggtcgtctgccaccatcgtgttctctac

SEQ ID NO: 64849 - DNA, 523 bp, Homo sapiens
  misc_feature: GYAE6OF02ITBX0.31.78.H01.1.454.CMB.1.raw
  modified_base (310)..(310): a, c, t, g, unknown or other
  misc_feature (310)..(310): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggcccacaataacaactacttagcttggtaccagcagaaagtaggacagcctcctaaactcctgatttacngggcttctacccgggcagttccggggttcctaaccgattcattggcagcggtctgggaccatttcactctcaccatcagcagcctgcaggctgaagatgtggctagtttattactgtacagcaacatttattactttctttcgtctactttcgggcgtacgggacctaaggtgagatacgaaacgtactgtcgctgcactatctcgtctctac

SEQ ID NO: 64850 - DNA, 538 bp, Homo sapiens
  misc_feature: GYAE6OF02GF5QG.31.78.H01.1.454.CMB.1.raw
  modified_base (312)..(312): a, c, t, g, unknown or other
  misc_feature (312)..(312): n is a, c, g, or t
tcagcagtagacgtcacgaccggtgctcgatttagtgtgagtagtttgggtttgggggagctacaacaggcaggacaggggcagcaagatggtgttgcagacccaggtcttcatttctctgttgctctggatctctgggtgcctacggggacatcgtgatgagccagtttccagactccctggctgtgtctctgggcgagagggccaccatcaactgcaagtccagccagagtgttttattggccccacaataacactacttagcttggtaccagcagaaagtaggacagcctcctaaactcctgatttacngggcttcgtacccgggcagtcccggggttcctaaccgattcattggcaggcgggtctgggaccgatttcactctcaccatcagcagcctgcaggctagaagagtgtggctagtttatactgtcagcaatattatactttctttcgtctacgtttcggcggtagggaccaagggtggagatacgaaacgaactggtacggtctgaccacgtatctgttccttcgtac

SEQ ID NO: 64851 - DNA, 514 bp, Homo sapiens
  misc_feature: GYAE6OF02HQG4H.31.78.H01.1.454.CMB.1.raw
  modified_base (340)..(340): a, c, t, g, unknown or other
  misc_feature (340)..(340): n is a, c, g, or t
tcagcagtagacgtcacgaccggtgctcgatttagtgtgagtagtttgggtttggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtggacagcctcctaaactcctgattactggcttcacccgggcatccgggttcctaaccgnttcattggcagcgggtctgggaccgatttccactctcaccatcagcagcctgcaggctgaagatgtggctagtttattactgtcagcaactattatacttctttcgtctactttcggcggaggaccaaggtgagatacgaaacgtaactgtgctgcaccatcgtcgtcttctac

SEQ ID NO: 64852 - DNA, 512 bp, Homo sapiens
  misc_feature: GYAE6OF02IPX9E.31.78.H01.1.454.CMB.1.raw
  modified_base (312)..(312): a, c, t, g, unknown or other
  misc_feature (312)..(312): n is a, c, g, or t
  modified_base (500)..(500): a, c, t, g, unknown or other
  misc_feature (500)..(500): n is a, c, g, or t
  modified_base (509)..(509): a, c, t, g, unknown or other
  misc_feature (509)..(509): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccaccaataacaactacttagcttggtaccagcagaaagtaggacagcctcctaaactcctgatttacngggcttctacccgggcatccggggttcctaaccgattcattggcagcgggtctgggaccatttcactctcaccatcagcagcctgcaggctgaagatgtgcagtttatactgtcagcaacattatacttctttcgtctactttcggcggtaggaccaaggtgagatcgaaacgactggtcgctgcacntctgtcttntac

SEQ ID NO: 64853 - DNA, 532 bp, Homo sapiens
  misc_feature: GYAE6OF02GPZXV.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacaactacttagcttggtaccagcagaaagtaggacagcctacctaaactcctgatttactgggcttctacccgggcactccggggttcctaaccgattcattggcagcggtctgggaccatttcactctcaccatcagcagcctgcaggctgaagatgtggctagtttattactgtcagtcaactattatactttctttcgtctacgtttcgggcggtaggaacctaagggtggagtatacgaaacgaactggtaggctagcacgtatctgtcttctac

SEQ ID NO: 64854 - DNA, 520 bp, Homo sapiens
  misc_feature: GYAE6OF02G4GY0.31.78.H01.1.454.CMB.1.raw
  modified_base (409)..(409): a, c, t, g, unknown or other
  misc_feature (409)..(409): n is a, c, g, or t
  modified_base (517)..(517): a, c, t, g, unknown or other
  misc_feature (517)..(517): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttactgggcttctacccgggcatcccggggttcctaaccgattcattcggcagcgggtctgggaccgatttcactctcaccatcagcagcctgcaggctgaanatgtgcagtttattctgtcagcaacattatacttctttcgtctactttcggcggtaggaccaaggtcggagatacgaaacgtaactgtaggctgacaccatctgtctntac

SEQ ID NO: 64855 - DNA, 650 bp, Homo sapiens
  misc_feature: GYAE6OF02GD5F4.31.78.H01.1.454.CMB.1.raw
  modified_base (325)..(325): a, c, t, g, unknown or other
  misc_feature (325)..(325): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgacgcctagtttccagacctccctggctgtgtctcgtgggcgaggacgggccaccatcaactgacaagtccagccagagttgttttattcggccccacaataacaactactagcttggtaccagcaagaaagtaggacagccctacctaactcctgtactttacgngggtccttccgtacccgggctacggttcccggggttaccctaaccgtacttcagttcggacagggtccgggtcgtcggggacccgtatttccacttcctaccacctatccagcacgcctgcgaggctaggaagtatggtggacttaagttttacttacgttgtaccagacctaaactatttaacttaccttttcttttccgtaccttaccgttttccggaaccgggtaacgggtaaccgtaaggggtcggtagtaactaaccggaaaacggtaacgttggtacggtctaggacctaacctacgttccgtacgttccttacgtacc

SEQ ID NO: 64856 - DNA, 542 bp, Homo sapiens
  misc_feature: GYAE6OF02I7CGB.31.78.H01.1.454.CMB.1.raw
  modified_base (309)..(309): a, c, t, g, unknown or other
  misc_feature (309)..(309): n is a, c, g, or t
  modified_base (412)..(412): a, c, t, g, unknown or other
  misc_feature (412)..(412): n is a, c, g, or t
  modified_base (538)..(538): a, c, t, g, unknown or other
  misc_feature (538)..(538): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgtttattggcccacaataacaactactagcttggtaccagcagaaagtaggacagcctacctaaactcctgatttacngggcttcacccgggcagtccggggttcctaaccggattcattcggcagcgggtctgggacccgtatttcacgtctacaccatccagcagcctgcaggctgaanatgtggctagtttattactgtcagcaactattatacttcttcgtactaccgtttcggcgtagggacctaagggtggacgtaatacgaaacggtaactggtacgctagacactatcgtgttaccttntacg

SEQ ID NO: 64857 - DNA, 522 bp, Homo sapiens
  misc_feature: GYAE6OF02GSZIR.31.78.H01.1.454.CMB.1.raw
  modified_base (519)..(519): a, c, t, g, unknown or other
  misc_feature (519)..(519): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctacctaaactcctgatttactgggcttcgtacccgggcacgtccggggttcctaaccgattcattggcagcgggtctgggaccatttcactctcacatcagcagcctgcaggctgaagatgtggctagtttatactgtcagcaactattactacttctttcgtctacgtttcggcggtacggacctaagggtgagactacgaaacgtactgtgctgcacatctgtctntac

SEQ ID NO: 64858 - DNA, 519 bp, Homo sapiens
  misc_feature: GYAE6OF02G6D94.31.78.H01.1.454.CMB.1.raw
  modified_base (311)..(311): a, c, t, g, unknown or other
  misc_feature (311)..(311): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcagagggccaccatcaactgcaagtccagccagagttgttttattggccccacaataacaactactagcttggtaccagcagaaagtaggacagcctacctaaactcctgatttacngggcttcacccgggcatccgggtcctaaccgattcattggcagcggtctgggaccgatttcactctcaccatcagcagcctgcaggctagaagatgtggctaggtttatactgtcagcaactattatactttctttcgtctactttcggcggtaggaccgaggtggagatacgaaacgaactgtggctgacactatctcgtcttctac

SEQ ID NO: 64859 - DNA, 518 bp, Homo sapiens
  misc_feature: GYAE6OF02F4MEG.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttactgggcttctacccgggcactccggggttcctaaccgattcattggcagcgggtctgggaccatttcactctcaccatcagcagcctgcaggctgaagatgtggctagtttatactgtcagcaacattatactttctttcgtctacgtttcggcggtaagggaccaagggtgagatacgaaacgactgtgctgcacatctgtcttctac

SEQ ID NO: 64860 - DNA, 550 bp, Homo sapiens
  misc_feature: GYAE6OF02IPMXF.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggcccccaacaataacaactacttagcttggtaccagcagaaagtaggacagcctacctaaactcctagtatttactgggcttcgtacccgggcagttcccggggttacctaaccgattcattcggcagcgggtctgggaccgtatttcactctcaccatcagcagcctgcaggctagaagatgtggctagtttattactgtcagacaactattactacttcttctactacgtttcggcggaggaccaagggtggagtagtacgaaacgtacgtaggtcggtctagccaaccgtattctgtccttctac

SEQ ID NO: 64861 - DNA, 522 bp, Homo sapiens
  misc_feature: GYAE6OF02H2SZX.31.78.H01.1.454.CMB.1.raw
  modified_base (519)..(519): a, c, t, g, unknown or other
  misc_feature (519)..(519): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaaactgcaagtccagccagagtgttttattggcccccacaataacaactacttagcttggtaccagcagaaagtaggacagcctcctaaactcctgatttactgggcttctacccgggcatccgggttcctaaccgattcattcggcagcgggtctgggaccgatttcactctcaccatcagcagcctgcaggctgaagatgtggctagtttattactgttcagcaacatttatactttctttcgtctacgtttcgcggtaggacctaagggtgagatcgaaacgactgtggctgcacatctgtccttntac

SEQ ID NO: 64862 - DNA, 514 bp, Homo sapiens
  misc_feature: GYAE6OF02GMU18.31.78.H01.1.454.CMB.1.raw
  modified_base (436)..(436): a, c, t, g, unknown or other
  misc_feature (436)..(436): n is a, c, g, or t
  modified_base (511)..(511): a, c, t, g, unknown or other
  misc_feature (511)..(511): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttactgggcttctacccgggcactccggggttcctaaccgattcattggcagcgggtctgggaccgtatttcactctcaccatcagcagcctgcaggctgaagatgtggctagtttatactgtcagcaanattatactttctttcgtctactttcggcggaggaccaggtggagatacgaaacgactgtgctgcacatctgtctntac

SEQ ID NO: 64863 - DNA, 545 bp, Homo sapiens
  misc_feature: GYAE6OF02IGOVO.31.78.H01.1.454.CMB.1.raw
  modified_base (328)..(328): a, c, t, g, unknown or other
  misc_feature (328)..(328): n is a, c, g, or t
  modified_base (347)..(347): a, c, t, g, unknown or other
  misc_feature (347)..(347): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaaactcctgatttactgggcttctacccgggnacgtccgggttcctaacgnttcattggcagcggtctgggaccgtatttcactctcaccatcagcagcctgcaggctgaagatgtggctagtttattactgtcagacaatattaattactttctttcgtctacgtttcgggacggtagggaccaagggtggagtactacgaaaacgtaactggtacggctagaccacctattccgtagttccttctac

SEQ ID NO: 64864 - DNA, 515 bp, Homo sapiens
  misc_feature: GYAE6OF02H9SN3.31.78.H01.1.454.CMB.1.raw
  modified_base (347)..(347): a, c, t, g, unknown or other
  misc_feature (347)..(347): n is a, c, g, or t
  modified_base (435)..(435): a, c, t, g, unknown or other
  misc_feature (435)..(435): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctacctaaactcctgatttactgggcttctacccgggcagtccggggttctaaccgnttcattggcagcgggtctgggaccatttcactctcaccatcagcagcctgcaggctgaagatgtgctagtttatactgtcagcaactnttatactttctttcgtctacgtttcggcggaggaccagggtgagatacgaaacgactgtggctgcacatctgttctctac

SEQ ID NO: 64865 - DNA, 518 bp, Homo sapiens
  misc_feature: GYAE6OF02H18BP.31.78.H01.1.454.CMB.1.raw
  modified_base (511)..(511): a, c, t, g, unknown or other
  misc_feature (511)..(511): n is a, c, g, or t
  modified_base (515)..(515): a, c, t, g, unknown or other
  misc_feature (515)..(515): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggcccccacaataacaactacttagcttggtaccagcagaaagtaggacagcctcctaaactcctgatttactgggcttctaccccgggcagtccggggttcctaaccgattcattggcagcgggtctgggaccgatttcactctcaccatcagcagcctgcaggctgaagatgtggctagtttattactgtcagcaactattatacttctttcgtctacgtttcggcggtaggaccaaggtggagatacaaacgactgtgctgcacatctntctntac

SEQ ID NO: 64866 - DNA, 511 bp, Homo sapiens
  misc_feature: GYAE6OF02HKYYO.31.78.H01.1.454.CMB.1.raw
  modified_base (324)..(324): a, c, t, g, unknown or other
  misc_feature (324)..(324): n is a, c, g, or t
  modified_base (508)..(508): a, c, t, g, unknown or other
  misc_feature (508)..(508): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgtttattggccccacaataacaactactagcttggtaccagcagaaagtaggacagcctcctaaactcctgatttactggcttctacccgggnatccgggttcctaaccgattcattggcagcgggtctgggaccatttcactctcaccatcagcagcctgcaggctgaagatgtggctagtttattactgtcagcaactattactacttctttcgtctactttcggcggtaggaccaagggtgagactcgaaacgactgtgctgcacatctgtctntac

SEQ ID NO: 64867 - DNA, 525 bp, Homo sapiens
  misc_feature: GYAE6OF02JAGPO.31.78.H01.1.454.CMB.1.raw
  modified_base (522)..(522): a, c, t, g, unknown or other
  misc_feature (522)..(522): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctacctaaactcctgatttactgggcttcgtacccgggcacgtcccggggttcctaaccgattcattggcagcgggtctgggaccgtatttcactctcaccatcagcagcctgcaggctgaagatgtggctagtttatactgtcagcaactattatacttctttcgtctacgtttcggcggtacggaccaggtggagtatacgaaacgtaactggtgctgcacatctgtctntac

SEQ ID NO: 64868 - DNA, 544 bp, Homo sapiens
  misc_feature: GYAE6OF02JY21N.31.78.H01.1.454.CMB.1.raw
  modified_base (311)..(311): a, c, t, g, unknown or other
  misc_feature (311)..(311): n is a, c, g, or t
  modified_base (387)..(387): a, c, t, g, unknown or other
  misc_feature (387)..(387): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttacngggcttctacccgggcagtccggggttcctaaccgattcattggcagcgggtctgggaccgatttcactctcaccntcagcagcctgcaggctgaagatgtggctagtttattactgttcagtccaatattatacttcttttcgtctacgttttcggccggtacggtaccgaaggtggacgtagtacgaaacgtacgtgtaggccgtgcctaccattccgtgttccttctacc

SEQ ID NO: 64869 - DNA, 587 bp, Homo sapiens
  misc_feature: GYAE6OF02IR67U.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggccccacaataacaactacttagcttggtaccagcagaaagtaggacagcctacctaaactcctgatttacgtgggcttccgtacccgggcacgttcccggggttacctaaccgattcagttggcaggcgggtcgtgggaccgtatttcactctcaccatcagcacgcctgcaggctgaagagtggtcggctaagttttacttactgtacagacaaactattacttactttcgtttaccgttctacgtttccgggacgggtacgggtaaccctaagggtggagtactacgaaacggtaactggtacggcgtagaccgtacctacttccgtcgttccttactaccg

SEQ ID NO: 64870 - DNA, 518 bp, Homo sapiens
  misc_feature: GYAE6OF02G033F.31.78.H01.1.454.CMB.1.raw
  modified_base (515)..(515): a, c, t, g, unknown or other
  misc_feature (515)..(515): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactactagcttggtaccagcagaaagtaggacagcctcctaaactcctgattactgggcttctacccgggcatccggggttcctaaccgattcattggcagcgggtctgggaccgatttcactctcaccatcagcagcctgcaggctgaagatgtggctagtttatactgtcagcaacattatacttctttcgtctactttcggcggtacggacaagggtggagagtacgaaacgactggtagctgcacctatctgtcttntac

SEQ ID NO: 64871 - DNA, 590 bp, Homo sapiens
  misc_feature: GYAE6OF02HDB4E.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagttgttttattcggccccacaataacaactacttagcttggtaccagcaagaaagtaggacagcctacctaaactcctagtatttacgtgggccttccgtacccgggcaacgttccggggttaccctaaccgtattcattcggcaggcgggtcgtgggaccgtatttcactctacaccatcacgcacgcctgcgaggctagaagtagtgtaggctagtttatacgtgtacagacaactattaactactttctttcgtctacgtttcgggtacggaacggtaccgtaagggtggtacgtacttacgaaacggtaactggtacggcttaggaccaccgtagtccgtacgttcctacgtaccg

SEQ ID NO: 64872 - DNA, 553 bp, Homo sapiens
  misc_feature: GYAE6OF02ITX1F.31.78.H01.1.454.CMB.1.raw
  modified_base (410)..(410): a, c, t, g, unknown or other
  misc_feature (410)..(410): n is a, c, g, or t
  modified_base (413)..(413): a, c, t, g, unknown or other
  misc_feature (413)..(413): n is a, c, g, or t
  modified_base (463)..(463): a, c, t, g, unknown or other
  misc_feature (463)..(463): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttactggcttctacccgggcagtccggggttcctaaccgattcatttggcagcgggtctgggaccctatttcactctcaccatcagcagcctgcaggctgaagntgnggctagtttatacgtgtacagacaactattactacctttctttaccgttntaccgttttcgggcggacgggtaaccaagggttcggacgtataccgaaacgtactaggtcgactagaccacctagtcctgttcctcgtac

SEQ ID NO: 64873 - DNA, 518 bp, Homo sapiens
  misc_feature: GYAE6OF02IKG98.31.78.H01.1.454.CMB.1.raw
  modified_base (515)..(515): a, c, t, g, unknown or other
  misc_feature (515)..(515): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgtttattggccccacaataacaactacttagcttggtaccagcagaaagtaggacagcctcctaaactcctgatttactgggcttctacccgggcatccggggttcctaaccgattcattggcagcgggtctgggaccgtatttcactctcaccatcagcagcctgcaggctgaagatggtggctagtttattactgtcagcaactattatactttctttcgtctacgtttcggcggaggaccaaggtggagatacgaaacgaactgtgctgcacatctgtctntac

SEQ ID NO: 64874 - DNA, 527 bp, Homo sapiens
  misc_feature: GYAE6OF02JI0QW.31.78.H01.1.454.CMB.1.raw
  modified_base (484)..(484): a, c, t, g, unknown or other
  misc_feature (484)..(484): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgtttattggccccacaataacaactacttagcttggtaccagcagaaagtaggacagcctcctaaaactcctgatttactgggcttctacccgggcatcccggggttcctaaccgattcattggcagcgggtctgggaccatttcactctcaccatcagcagcctgcaggctagaagagtgtggctagtttacttactgtcagcaatattatactttcttcgtctacgtttcggcggtaggacctaaggtganatacgaaacgtaactggtagctgacctacatctgtcttctacg

SEQ ID NO: 64875 - DNA, 546 bp, Homo sapiens
  misc_feature: GYAE6OF02HOW2H.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgtattactggcttctacccgggcactccggggttacctaaccgattcattcggcagcgggtctcgggaccgtatttcgactctcaccatcagcagcctgcaggctgaagatgtggctaggtttattactgtcagcaaactattatactttctttcgtcctacgtttcggacggacggaaccgtagggtggagtactacgaaacgtaacgtgtacggactgccacgattcgtgtccttactacc

SEQ ID NO: 64876 - DNA, 572 bp, Homo sapiens
  misc_feature: GYAE6OF02H1SMR.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacaactacttagcttggtaccagcagaaagtaggacagcctcctaaactcctagtatttactgggtcttcgtacccgggcacgtcccggggttcctaaaccgattcattggcaggtcgggtctgggaccgtatttcactctcaccatcagcagcctgcaggctagaagatggtggactaagtttattactgtacagcaaactatttaacttacctttctttcgtctacgttttccgggacggtacggtaaccgaagggtggagtacgtaacgaaacggtaacctggtggacctgaccacctattacctagttccttctac

SEQ ID NO: 64877 - DNA, 529 bp, Homo sapiens
  misc_feature: GYAE6OF02IYCDD.31.78.H01.1.454.CMB.1.raw
  modified_base (441)..(441): a, c, t, g, unknown or other
  misc_feature (441)..(441): n is a, c, g, or t
  modified_base (526)..(526): a, c, t, g, unknown or other
  misc_feature (526)..(526): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttactgggcttcgtacccgggctacgtccggggttcctaaccgattcattggcagcgggtctgggaccatttcactctcaccatcagcacgcctgcaggctagaagatgtggctagtttattactgtcagcaatnttatactttcttcgtctacgtttcggcggtaggaccaaggtgagtactacgaaacgtaactggtcgctcgcaccatctcgttctntac

SEQ ID NO: 64878 - DNA, 570 bp, Homo sapiens
  misc_feature: GYAE6OF02GIPUQ.31.78.H01.1.454.CMB.1.raw
  modified_base (451)..(451): a, c, t, g, unknown or other
  misc_feature (451)..(451): n is a, c, g, or t
  modified_base (567)..(567): a, c, t, g, unknown or other
  misc_feature (567)..(567): n is a, c, g, or t
tcagcagtagacgtcacgaccggtgctcgatttagtgtgagtagtttgggtttgggggtaggctaacgaacaggcacggcaggggtcagccaacgactagggtcgttgcgagtaccccagggtcttccatttctcctggttgctctcggatctctggtgccgtaccggggacgatcggtcgagtcgaaggcctagttttcccaagtactccctggctgtgtcgtctggggcgaaggacgggccaaccagtcaactgcaagtccagccagagtgttttattcggccccacaataacaactacttagcttggtaccagcagaaagtaggacagcctactaaactcctgatttactgggcttcgacccgggcacgtccggggttcctaaccgattcattggcagcgggtctgggacctatttcgactctcaccatcagcagctgcaggctgaanatgtggctagtttattactgtcagcaatattatactttctttcgtctacgtttcggacggtagggaacctaggtgagtatacgaaacgtactgtacgctgacactagtctgtcttntac

SEQ ID NO: 64879 - DNA, 523 bp, Homo sapiens
  misc_feature: GYAE6OF02GYAAP.31.78.H01.1.454.CMB.1.raw
  modified_base (520)..(520): a, c, t, g, unknown or other
  misc_feature (520)..(520): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgtttattggccccacaataacaactacttagcttggtaccagcagaaagtaggacagcctacctaaactcctgatttactgggcttctacccgggcagtccggggttcctaaccgattcattggcagcgggtctgggacctatttcactctcaccatcagcagcctgcaggctagaagatggtggctagtttatacttgtcgagccaactattattacctttctttcgtctactttcggcggaggacctaaggtgagatacgaaacgactgtagctgcacatctgtctntac

SEQ ID NO: 64880 - DNA, 515 bp, Homo sapiens
  misc_feature: GYAE6OF02G0FSY.31.78.H01.1.454.CMB.1.raw
  modified_base (409)..(409): a, c, t, g, unknown or other
  misc_feature (409)..(409): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttactgggcttctacccgggcagtccggggttcctaaccgattcattggcagcggtctgggaccatttcactctcacatcagcagcctgcaggctgaagatgngctagtttatactgtcagcaacattatacttctttcgtctactttcggcggtaggaccagggtgagatacgaaacgactgtcggactgacacatctcgtcttctac

SEQ ID NO: 64881 - DNA, 518 bp, Homo sapiens
  misc_feature: GYAE6OF02IMXML.31.78.H01.1.454.CMB.1.raw
  modified_base (347)..(347): a, c, t, g, unknown or other
  misc_feature (347)..(347): n is a, c, g, or t
  modified_base (512)..(512): a, c, t, g, unknown or other
  misc_feature (512)..(512): n is a, c, g, or t
  modified_base (516)..(516): a, c, t, g, unknown or other
  misc_feature (516)..(516): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttactgggcttctacccgggcacgtccgggttcctaaccgnttcattggcagcggtctgggacctatttcactctcaccatcagcagccctgcaggctagaagatggtggctagtttattactgtcagcaactattatactttctttcgtctactttcggcggaggaaccaggtggagatacaaacgtactgtgctgcactatctntctnac

SEQ ID NO: 64882 - DNA, 512 bp, Homo sapiens
  misc_feature: GYAE6OF02HW3F4.31.78.H01.1.454.CMB.1.raw
  modified_base (343)..(343): a, c, t, g, unknown or other
  misc_feature (343)..(343): n is a, c, g, or t
  modified_base (407)..(407): a, c, t, g, unknown or other
  misc_feature (407)..(407): n is a, c, g, or t
  modified_base (509)..(509): a, c, t, g, unknown or other
  misc_feature (509)..(509): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttactggcttctacccggcatccgggttcctaaccgnttcattggcaggcgggtctgggaccgtatttcactctcaccatcagcagcctgcaggctgaagntgtggctagtttattactgtcagcaactattatacttcttcgtctactttcggcggaggaccaaggtgagactacgaaacgactgtgctgcacatctgtctntac

SEQ ID NO: 64883 - DNA, 534 bp, Homo sapiens
  misc_feature: GYAE6OF02GPTAX.31.78.H01.1.454.CMB.1.raw
  modified_base (439)..(439): a, c, t, g, unknown or other
  misc_feature (439)..(439): n is a, c, g, or t
  modified_base (530)..(530): a, c, t, g, unknown or other
  misc_feature (530)..(530): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactactagcttggtaccagcagaaagtaggacagcctactaaactcctgatttactgggcttctacccgggctacgtccggggttacctaaccgattcattggcagcgggtctgggaccgatttcactctcaccatcagcagcctgcaggctagaagatggtgctagtttatacttgtcagcaanattatactttcttcgtctacgtttcggcggtaacggacctaagggtgagatacgaaacgtaactggtagcgtgaccacgtatctgttcctntacg

SEQ ID NO: 64884 - DNA, 552 bp, Homo sapiens
  misc_feature: GYAE6OF02FHRP0.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcagagggccaccatcaactgcaagtccagccagagtgttttattggccccacaataacaactacttagcttggtaccagcagaaagtaggacagcctcctaaactcctgatttactgggcttcgtacccgggcacgtccggggttacctaaccgattcattcggcaggcgggtctgggaccgtatttcactctcaccatcagcagcctgcaggctagaagatgtggctagtttactactgtcagacaactattatactttctttacgtctacgtttcggcgtaagggacctaagggtggacgtatacgaaaacgtactggtacggtcttagaccacctattctcggttccttactacg

SEQ ID NO: 64885 - DNA, 527 bp, Homo sapiens
  misc_feature: GYAE6OF02HXFYE.31.78.H01.1.454.CMB.1.raw
  modified_base (311)..(311): a, c, t, g, unknown or other
  misc_feature (311)..(311): n is a, c, g, or t
  modified_base (413)..(413): a, c, t, g, unknown or other
  misc_feature (413)..(413): n is a, c, g, or t
  modified_base (502)..(502): a, c, t, g, unknown or other
  misc_feature (502)..(502): n is a, c, g, or t
  modified_base (524)..(524): a, c, t, g, unknown or other
  misc_feature (524)..(524): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttacngggcttcgtacccgggcagtccgggttcctaaccgattcattggcaggcgggtctgggaccgtatttcactctcaaccatcagcagcctgcaggctagaagntgtggctagtttattactgtcagcaactattacttacttctttacgtctactttcggcgaggaccaagggtgagatacgaaacgactgngactgacacattctagtccttntac

SEQ ID NO: 64886 - DNA, 533 bp, Homo sapiens
  misc_feature: GYAE6OF02GFHGO.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctacctaaactcctgatttactgggcttctacccgggcacgtcccggggttcctaaccggattcagtttggcaggcgggtctgggaccgtatttcactctcaccatcagcagcctgcaggctgaagatgtgctagtttatactgtcagcaactattatacttctttcgtctacgtttcggcggtaggacctaagggtggagtataccgaaacgtactggtcgctgcacctatcgtgtctctac

SEQ ID NO: 64887 - DNA, 527 bp, Homo sapiens
  misc_feature: GYAE6OF02GFKWW.31.78.H01.1.454.CMB.1.raw
  modified_base (411)..(411): a, c, t, g, unknown or other
  misc_feature (411)..(411): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctacctaaactcctgatttactgggcttcgtacccgggcacgtccggggttcctaaccgattcattggcagcgggtctgggaccatttcactctcaccatcagcagcctgcaggctgaagntgtggctagtttatactgtcagcaactattatacttctttcgtctacgtttcggcggtagggaccaaggtggagatacgaaacgtactggtggctgacacctatctcgttctctac

SEQ ID NO: 64888 - DNA, 624 bp, Homo sapiens
  misc_feature: GYAE6OF02H1B70.31.78.H01.1.454.CMB.1.raw
  modified_base (126)..(126): a, c, t, g, unknown or other
  misc_feature (126)..(126): n is a, c, g, or t
  modified_base (264)..(264): a, c, t, g, unknown or other
  misc_feature (264)..(264): n is a, c, g, or t
  modified_base (316)..(316): a, c, t, g, unknown or other
  misc_feature (316)..(316): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctntggatctctggtgcctacggggacatcgtgatgagccagtttccagactccctggctgtgtctctgggcgagagggccacatcaactgcaagtccagccagagtgttttaattggccccacaaataacaactacttancttggtaccagacagaaagtaggacagcctacctaaactcctagatttacgngggcttccgtacccgggcaacgttccggggttacctaaccgattacagttaggcaggcgggtcgtagggaccgtatttcgacttctacacctaatcagtcacgcctagcaggctagaaacgatggtacgcttaagtttaattacgtaggttaccagccaaactatttaactactttctttacgtacctacgttttcgcgggtaagggaacctaagggtggtagaagttaccgaaaacggtaaccttgggtacgggaccttaggaccctaaccgtagttaccctttacggtttccttacccttaaccgg

SEQ ID NO: 64889 - DNA, 558 bp, Homo sapiens
  misc_feature: GYAE6OF02JDMHB.31.78.H01.1.454.CMB.1.raw
  modified_base (318)..(318): a, c, t, g, unknown or other
  misc_feature (318)..(318): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagtttccagacctccctggctgtgtctcgtgggcgagagggccaccatcaactgcaagtccagccagagttgttttattcggccccacaataacaactacttagcttggtaccagcagaaagtaggacagcctacctaaactcctgatttacgngggcttcgtacccgggcagttcccggggttcctaacgattcattggcaggcgggtctgggaccgtatttcactctcaccatcagcacgcctgcaggctgaagatgtggctagtttatactgtcagacaactattatactttctttcgtctacgtttcggacggtacgggaccgtaagggtcggagtacgtacgaaacggtaactggtacggcgtgacctaccagttctgttcttctaccg

SEQ ID NO: 64890 - DNA, 528 bp, Homo sapiens
  misc_feature: GYAE6OF02HNZW3.31.78.H01.1.454.CMB.1.raw
  modified_base (520)..(520): a, c, t, g, unknown or other
  misc_feature (520)..(520): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattggccccacaataacaactacttagcttggtaccagcaagaaagtaggacagcctacctaaactcctagatttactgggtcttccgtacccgggcacgttcccggggttcctaaccgattcattggcagcgggtctgggaccatttcactctcacatcagcagcctgcaggctgaagatgtggctagtttattactgtcagcaactattattactttctttcgtctacgtttcggcggaggaccgaaggtggagatacgaaacgactgtgctgcacatctntcttctac

SEQ ID NO: 64891 - DNA, 640 bp, Homo sapiens
  misc_feature: GYAE6OF02HH2K2.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagtgttttattcggccccacaataacaactacttagcttggtaccagcaagaaagtaggacagccctacctaaactcctagtactttacgtgggtcctttccgtaccccggggctaacgttcccggggtttaccctaaaccggtatttccgaagtttcggcctagggtccggggttccgtacggggacccgtacttttccgaaccttcctaccaaccctatccagccacgtcccgtgaccgtacggctaggaaagtagtggtaggtacttagtttacttacgttgtacagaccaactattacttactttcgtttcgtacttaccgtttcggacggtacggaacctaagggtgagtagtacgaaacgtacgtggtcggtactcgacctacctacttcgtacgttcttctacg

SEQ ID NO: 64892 - DNA, 533 bp, Homo sapiens
  misc_feature: GYAE6OF02GLBXT.31.78.H01.1.454.CMB.1.raw
  modified_base (530)..(530): a, c, t, g, unknown or other
  misc_feature (530)..(530): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacactacttagcttggtaccagcagaaagtaggacagcctacctaaactcctgtatttactgggccttcgtacccgggcacgttcccggggttacctaaccgtattcattggcaggcgggtctggggacctatttcactctcaccatcagcacgcctgcaggctgaagatggtgctagtttatactgtcagacaactattatacttctttcgtctacgtttcggcgagggtactaggtggagactacgaaacgtatcgtaggctgacactatctgtctntac

SEQ ID NO: 64893 - DNA, 519 bp, Homo sapiens
  misc_feature: GYAE6OF02GQTVD.31.78.H01.1.454.CMB.1.raw
  modified_base (515)..(515): a, c, t, g, unknown or other
  misc_feature (515)..(515): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttactgggcttctacccgggcatccggggttcctaaccgattcattggcagcgggtctgggaccgatttcactctcaccatcagcagcctgcaggctgaagatgtggcagtttatactgtcagcaacattatacttctttcgtctactttcggcgtagggaccaaggtggagagtcaaacggtaactgtggctgcaccatctcgtcttntacg

SEQ ID NO: 64894 - DNA, 525 bp, Homo sapiens
  misc_feature: GYAE6OF02I8NAE.31.78.H01.1.454.CMB.1.raw
  modified_base (522)..(522): a, c, t, g, unknown or other
  misc_feature (522)..(522): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccaccaataacaactacttagcttggtaccagcagaaagtaggacagcctcctaaactcctgatttactgggcttctacccgggcatccggggttcctaaccgattcattggcagcgggtctgggaccatttcactctcaccatcagcagcctgcaggctgaagatgtggctagtttattactgtcagcaactattacttacttctttcgtctactttcgggcggtagggaccaaggtgagatacgaaacgaacttgtcgctgcaccattctgttcttntac

SEQ ID NO: 64895 - DNA, 558 bp, Homo sapiens
  misc_feature: GYAE6OF02HH55N.31.78.H01.1.454.CMB.1.raw
  modified_base (312)..(312): a, c, t, g, unknown or other
  misc_feature (312)..(312): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctagatttacngggcttccgtacccgggcagtccggggttcctaaccgattcattggcagcgggtctgggaccatttcactctcaccatcagcagcctgcaggctgaagatgtggctagttttattacgtgtcagacaactatttaatactttctttcgttctaacgtttcggcggtaggacctaaggtggagtagtaccgaaacggtaacctggtacggccttaggacctaaccgagttcctagttccttacgtac

SEQ ID NO: 64896 - DNA, 538 bp, Homo sapiens
  misc_feature: GYAE6OF02HOHH2.31.78.H01.1.454.CMB.1.raw
  modified_base (328)..(328): a, c, t, g, unknown or other
  misc_feature (328)..(328): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactactagcttggtaccagcagaaagtaggacagcctactaaactcctagatttactgggcttcgtacccgggnacgtccggggttcctaaccgattcattggcagcgggtctgggaccgatttcactctcaccatcagcagcctgcagctagaagatgtggctagtttattactgtcagcaactattacttacttctttacgtctacgtttcgggacggtacggaccgtaaggtggagtagtacgaaacgtactggtaggctagcaccatccgtgtcttctac

SEQ ID NO: 64897 - DNA, 646 bp, Homo sapiens
  misc_feature: GYAE6OF02GHAC9.31.78.H01.1.454.CMB.1.raw
  modified_base (325)..(325): a, c, t, g, unknown or other
  misc_feature (325)..(325): n is a, c, g, or t
  modified_base (339)..(339): a, c, t, g, unknown or other
  misc_feature (339)..(339): n is a, c, g, or t
  modified_base (356)..(356): a, c, t, g, unknown or other
  misc_feature (356)..(356): n is a, c, g, or t
  modified_base (383)..(383): a, c, t, g, unknown or other
  misc_feature (383)..(383): n is a, c, g, or t
tcagcagtagacgtcacgaccggtgctcgatttagtgtgagtagtttgggtttgggggtagggctacaacgaggcaggcagggcaggcaagactggtgttggccaggacccaggtcttcatttcctctcgttcgctctggagtctctgggtcgccgtaccgggacatcgtcgatgagccagtttccagtcctcccgtggtcgtgtcgtcgtctgggcgagcgggccacatcaactgcaagtccagacagagttgtttattgaccctacatacactactagcttagaccagactacgaagtgacagcttactaatcgtgattacgnggccttcgaccggntacgtccgggtctacgnttcgacgttgcagtcggtcgcggactntttccgaccttccgtacacctattccaaggtccgacgtccgtcggcgacgggacgtacggaagtcgtggtaggtacttaagtttactacgttgtacctagtactaactaattaacttactttaccgtttacgttcgttacgtttacgggccggtaacgggtaaccgtaagggttcggtacgtactacggtaaaccgtaacgttacggtacggtaccgtccggacccgtaccgtacgttacttccgttaccgttacccttaccg

SEQ ID NO: 64898 - DNA, 525 bp, Homo sapiens
  misc_feature: GYAE6OF02HT6VS.31.78.H01.1.454.CMB.1.raw
  modified_base (326)..(326): a, c, t, g, unknown or other
  misc_feature (326)..(326): n is a, c, g, or t
  modified_base (521)..(521): a, c, t, g, unknown or other
  misc_feature (521)..(521): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttactggcttctacccgggntagtccggggttcctaaccgattcattggcagcgggtctgggaccgtatttcactctcacatcagcagcctgcagctgaagatgtggctagtttattactgtcagcaatattactactttcttcgtctacgtttcgcggtaggacctaaggtgagactacgaaacgtactggtgtctgcaccattcgtgttcctntacg

SEQ ID NO: 64899 - DNA, 521 bp, Homo sapiens
  misc_feature: GYAE6OF02H2ENU.31.78.H01.1.454.CMB.1.raw
  modified_base (347)..(347): a, c, t, g, unknown or other
  misc_feature (347)..(347): n is a, c, g, or t
  modified_base (500)..(500): a, c, t, g, unknown or other
  misc_feature (500)..(500): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacattgtgatgatccagttccagactcctggctgtgtctctgggcgagagggccaccatcaactgcaagtccagccagagtgttttattggccccacaataacaactacttagcttggtaccagcagaaagtaggacagcctcctaaactcctgatttactgggcttcgtacccgggcacgtccggggttaccaaccgnttcattggcagcgggtctgggaccgtatttcactctcaccatcagcagcctgcaggctagaagatgtggctagtttattactgtcagcaactattatacttctttcgtctactttcggcggtaggacctaggtgagtactacgaaacgactgngtctgcacatctgtcttctac

SEQ ID NO: 64900 - DNA, 522 bp, Homo sapiens
  misc_feature: GYAE6OF02GIQCJ.31.78.H01.1.454.CMB.1.raw
  modified_base (312)..(312): a, c, t, g, unknown or other
  misc_feature (312)..(312): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctacctaaactcctgatttacngggcttctacccgggcatcccggggttcctaaccgattcattggcagcgggtctgggaccgatttcactctcaccatcagcagcctgcaggctgaagatgtgctagtttattactgtcagcaactattatactttctttcgtctacgtttcggcggtacggaccaaggtggagatacgaaacgactggtgctgcaccatctgtcttctac

SEQ ID NO: 64901 - DNA, 522 bp, Homo sapiens
  misc_feature: GYAE6OF02FIJ0U.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttactgggcttctacccgggcatccggggttcctaaccgattcattggcagcgggtctggggaccatttcactctcaccatcagcagcctgcaggctgaagatgtggctagtttatactgtcagcaacattatactttctttcgtctactttcgggcggtacgggaccaagggtggagactacgaaacgactgtggctgcaccatctgtcttctac

SEQ ID NO: 64902 - DNA, 534 bp, Homo sapiens
  misc_feature: GYAE6OF02HB3JH.31.78.H01.1.454.CMB.1.raw
  modified_base (314)..(314): a, c, t, g, unknown or other
  misc_feature (314)..(314): n is a, c, g, or t
  modified_base (331)..(331): a, c, t, g, unknown or other
  misc_feature (331)..(331): n is a, c, g, or t
  modified_base (420)..(420): a, c, t, g, unknown or other
  misc_feature (420)..(420): n is a, c, g, or t
  modified_base (498)..(498): a, c, t, g, unknown or other
  misc_feature (498)..(498): n is a, c, g, or t
  modified_base (522)..(522): a, c, t, g, unknown or other
  misc_feature (522)..(522): n is a, c, g, or t
tcagcagtagacgtcacgaccggtgctcgatttagtgtgagtagtttgggtttgggggtaggctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactactagcttggtaccagcaagaaagtaggacagccctactaaactcctgatttacnggccttcgtacccgggnagtcccgggttacctaaccgattcattggcagcgggtctggggacctatttcgactcgtcacctatcagcacgcctgcaggctgaaagngtgtgactaagtttacttactgtcagcaacattatactttctttacgtctacttcggacggaggaccgaggtgagtanacaaagtactgagcgtagcaaccnttctgtctatac

SEQ ID NO: 64903 - DNA, 532 bp, Homo sapiens
  misc_feature: GYAE6OF02G0KQ0.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctacctaaactcctgatttactgggcttcctacccggggcacgtccggggttacctaaccgattcattggcagcgggtctgggaccgtatttcactctcaccatcagcagcctgcaggctgaagatgtggctagtttatactgtacagactaacattattacttctttcgtctacgtttcggcggaggacctaaggtgagatacgaaacgtactgtgctggaccacctatctgttcttctac

SEQ ID NO: 64904 - DNA, 532 bp, Homo sapiens
  misc_feature: GYAE6OF02ICBIA.31.78.H01.1.454.CMB.1.raw
  modified_base (311)..(311): a, c, t, g, unknown or other
  misc_feature (311)..(311): n is a, c, g, or t
  modified_base (348)..(348): a, c, t, g, unknown or other
  misc_feature (348)..(348): n is a, c, g, or t
  modified_base (411)..(411): a, c, t, g, unknown or other
  misc_feature (411)..(411): n is a, c, g, or t
  modified_base (527)..(527): a, c, t, g, unknown or other
  misc_feature (527)..(527): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttacgcttggtaccagcagaaagtggacagcctcctaaactcctgatttacngggtcttctacccgggcagtccggggttcctaaccgnttcattggcagcgggtctgggaccgtatttcactctcaccatcagcagcctgcaggctgaagntgtggctagtttatactgtcagcaatattatactttctttcgtctacgtttcggacggaggaaccaagggtgagatacgaaacgtaacgtggtggctgcaacctatctgttccttntaccg

SEQ ID NO: 64905 - DNA, 517 bp, Homo sapiens
  misc_feature: GYAE6OF02F69WW.31.78.H01.1.454.CMB.1.raw
  modified_base (306)..(306): a, c, t, g, unknown or other
  misc_feature (306)..(306): n is a, c, g, or t
  modified_base (320)..(320): a, c, t, g, unknown or other
  misc_feature (320)..(320): n is a, c, g, or t
  modified_base (336)..(336): a, c, t, g, unknown or other
  misc_feature (336)..(336): n is a, c, g, or t
  modified_base (395)..(395): a, c, t, g, unknown or other
  misc_feature (395)..(395): n is a, c, g, or t
  modified_base (467)..(467): a, c, t, g, unknown or other
  misc_feature (467)..(467): n is a, c, g, or t
tcagcagtagacgtcacgaccggtgctcgatttagtgtgagtagtttgggtttggggagctacaacaggcaggcaggggcagcaagatggtgttgcagacccaggtcttcatttctctgttgctctggatctctggtgcctacgggacatcgtgatgaaccagtttccagactccctggctgtgtctctgggcgagagggccaccatcaactgcaagtccagccagagtgtttattggccccacaataacaactacttagcttggtaccagcagaaagtggacagcctctaaactcctgatttacnggcttctaccgggnatccgggttctaacgnttcattggcagcggtctgggaccatttcactctcacatcagcagcctgcaggctgaagntgtgcagtttatactgtcagcaactattactacttctttcgtactacgtttcggacgtaggaccaagtgganatacgaaacgaactgtggcttagacctacattccgtagtcttcattcccg

SEQ ID NO: 64906 - DNA, 515 bp, Homo sapiens
  misc_feature: GYAE6OF02FVW7B.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttactgggcttctacccgggcatccggggttcctaaccgattcattggcagcgggtctgggaccgatttcactctcaacatcagcagcctgcaggctgaagatgtggctagtttatactgtcaagcaacattatacttctttcgtctactttcggcggtaggaccaaggtggagatacgaaacgactgtggctgcacatctgtctctac

SEQ ID NO: 64907 - DNA, 574 bp, Homo sapiens
  misc_feature: GYAE6OF02IFS48.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggcccaccatcaactgcaagtccagccagagtgtttattggcccccacaataacaactacttagcttggaccagcaagaaagtaggacagcctacctaaactcctagtatttactgggccttcgtacccgggctacgttcccggggttacctaaccgtattccattcggcaggtcgggtctcgggacccgtatttccgactctccacctatcagcacgcctcgcaggctgaagatgtggactagtttaattactgtacagacaactattactactttctttcgtctacgtttcggacggtacggacctaagggtgagtataccgaaacgtaacgtggtacggtcgtgaccacctacttcgtcgttccttctacg

SEQ ID NO: 64908 - DNA, 524 bp, Homo sapiens
  misc_feature: GYAE6OF02IVFIQ.31.78.H01.1.454.CMB.1.raw
  modified_base (310)..(310): a, c, t, g, unknown or other
  misc_feature (310)..(310): n is a, c, g, or t
  modified_base (484)..(484): a, c, t, g, unknown or other
  misc_feature (484)..(484): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctctaaactcctgatttacngggcttctacccgggcatccggggttcctaaccgattcattggcagcgggtctgggaccatttcactctcaccatcagcagcctgcacggctgaagatggtgctagtttatactgtcagcaactattatacctttctttcgtcctacgtttcgggcggaaggaccaaggtgganactctaaaagactgtcggactgaccacattctgtcttcac

SEQ ID NO: 64909 - DNA, 619 bp, Homo sapiens
  misc_feature: GYAE6OF02G8X08.31.78.H01.1.454.CMB.1.raw
  modified_base (417)..(417): a, c, t, g, unknown or other
  misc_feature (417)..(417): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagttccagactccctggctgtgtctcgtgggcgaggagggccaccatcaactgcaagtccagccagagttgttttattcggccccacaataacaactacttagcttaggtaccagcaagaaagtaggacacgcctacctaaactcctagtactttacgtgggtccttaccgtacccggggctacggttcccggggttaccctaaccggtattcgagttcggcacggtcgggtcgtacgggacctatttcactcncaccatcagcacgcctgcgaggctagaagtgtggtacggctagtttacttacgtgtacagtacaacttattacttacctttcctttacgtacgttaccgtttcgggaccgggtacggtaaccgtaagggtagacgtaacgtaaccgaaacggtaacgtggtacggactacggactacctacttcgttacgttcctactaccg

SEQ ID NO: 64910 - DNA, 530 bp, Homo sapiens
  misc_feature: GYAE6OF02F0ZG3.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttactgggcttctacccgggcatccggggttcctaaccgattcattggcagcgggtctgggaccgatttcactctcaccatcagcagcctgcaggctgaagatgtggctagtttattactgtcagcaactattatactttctttcgtctacgttttcgggcggtagggtaccaagggtggagtatacgaaacgaactggtggctgacaccatctgttcttctac

SEQ ID NO: 64911 - DNA, 727 bp, Homo sapiens
  misc_feature: GYAE6OF02I4PN4.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtcccagccagagtgttttattggccccacaataacaactactagcttggtaccagcaagaaagtaggacagcctacctaaatcctgatttacgtgggcctttcgtacccgggctaacgttcccggggttacctaaaccggtatttccaagtttcggaccgtaaggtcccgggggttaccttacggggggtaaccccgtaagtttttcccgaaacctttccgtaccgtaacccacgtttacccgaaggtccctaaacggtccccttaggaccgaacgggtccttacggtaaacgtacgtcgggtacgggtacctaaggttttaactttaccttggttaccaggtacctaaacgtatttaacttacctttaccgttttcgtaccgttaacgtttccgggtaccgggtaaacggtaacccgtaagggttcggaacgtacgtaaccgtaaacggtaacgttggtacggtactacggtactaccgtagttccgtacggttccttacgtaaccg

SEQ ID NO: 64912 - DNA, 517 bp, Homo sapiens
  misc_feature: GYAE6OF02IG1CP.31.78.H01.1.454.CMB.1.raw
  modified_base (407)..(407): a, c, t, g, unknown or other
  misc_feature (407)..(407): n is a, c, g, or t
  modified_base (514)..(514): a, c, t, g, unknown or other
  misc_feature (514)..(514): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccaccaataacaactacttagcttggtaccagcagaaagtaggacagcctcctaaactcctgattactgggcttctacccgggcagtccgggttcctaaccgattcattggcagcgggtctgggaccatttcactctcaccatcagcagcctgcaggctgaagntggtggctagtttattactgtcagcaacattatactttcttcgtctacgtttcggcggtaggaccaaggtgagatacgaaacgactgtcgctgcaccatctgtcttntac

SEQ ID NO: 64913 - DNA, 532 bp, Homo sapiens
  misc_feature: GYAE6OF02GLFPK.31.78.H01.1.454.CMB.1.raw
  modified_base (528)..(528): a, c, t, g, unknown or other
  misc_feature (528)..(528): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccaccaataacaactactagcttggtaccagcagaaagtaggacagcctacctaaactcctgatttactgggcttctacccgggctacgtcccggggttcctaaccgtattcattggcagcgggtctgggaccgtatttcactctcaccatcagcagcctgcaggctagaagatgtggctagtttatactgtcagcaactattatactttctttcgtctacgtttcggcggagggaacctaagggtgagatacgaaacgactggtcgctgcacctatctgtcttntacc

SEQ ID NO: 64914 - DNA, 531 bp, Homo sapiens
  misc_feature: GYAE6OF02HY7A1.31.78.H01.1.454.CMB.1.raw
  modified_base (386)..(386): a, c, t, g, unknown or other
  misc_feature (386)..(386): n is a, c, g, or t
  modified_base (528)..(528): a, c, t, g, unknown or other
  misc_feature (528)..(528): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggcccccacaataacaactacttagcttggtaccagcagaaagtaggacagcctacctaaactcctgattactggcttctacccgggcagtccgggttcctaaccgattcattggcagcgggtctgggacctatttcactctcaccntcagcagcctgcagctgaagatgtgctagtttacttactgtcagcaactattatactttctttcgtctacgtttcggacggtaggaacctaagggtgagtactacgaaacgtactggtgactgaccacgtatcgtgtccttntac

SEQ ID NO: 64915 - DNA, 790 bp, Homo sapiens
  misc_feature: GYAE6OF02HQSPJ.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggccccacaataacaactacttagcttggtaccagcaagaaagtaggacagcctacctaaactcctgtactttacgtgggtccttccgtacccggggctacggttcccggggtttaccctaaacccggtatttccgaagtttcgggccaagggtccggggttccgtacgggggtaaccccgtatttttccgaaccttccgttacccaacccgtacttaccgaacggcctaacggccccttaggccgtaacggggtccttaggaaaggtacgttgggtacgggtaccttaaggtttttaactttaccgttggttaccaacggtacctaaaacgttaacttttaaactttaaccctttttcccgttttaccggttaccttaaccgtttttaccgggggaaccgggtaaacgggtaaacccggtaaaggggttacgggaacgttaacgttaacccgtaaaaaaccggttaaccgttacgggttacgggtacccgttacggacccctaaccggtaactttcccggtttacggtttaccctttaccgtaacccg

SEQ ID NO: 64916 - DNA, 578 bp, Homo sapiens
  misc_feature: GYAE6OF02F14F4.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacaactacttagcttaggtaccagcaagaaagtaggacagcctacctaaactcctgtatttacgtgggtcttccgtacccgggctacgttcccggggttacctaaaccggtacttcagttcggacaggtcgggtcgtggggtacccgtatttcactctcaccatcagcacgcctgcaggctagaagatggtcggctagtttatacgtgtacagactaactatttactactttctttcgtacttacgtttcgggacggacgggtacctaagggtgagactacgaaacgtaacgtggtagactagacctactatcgtcgttcttctac

SEQ ID NO: 64917 - DNA, 531 bp, Homo sapiens
  misc_feature: GYAE6OF02HRG6M.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgaggagggccaccatcaactgcaagtccagccagagtgttttattggccccacaataacaactacttagcttggtaccagcagaaagtaggacagcctacctaaactcctagatttactgggcttctacccgggctagtcccggggttacctaaccgattcattggcagcgggtctgggaccgtatttcactctcaccatcagcagcctgcaggctagaagatgtggctagtttatactgtcaagcaaactattactactttcttacgtctacgtttcggacggacggacagggtgagtatacgaaacgactggtgctgactacatctgtctctac

SEQ ID NO: 64918 - DNA, 522 bp, Homo sapiens
  misc_feature: GYAE6OF02H7E8A.31.78.H01.1.454.CMB.1.raw
  modified_base (347)..(347): a, c, t, g, unknown or other
  misc_feature (347)..(347): n is a, c, g, or t
  modified_base (411)..(411): a, c, t, g, unknown or other
  misc_feature (411)..(411): n is a, c, g, or t
  modified_base (519)..(519): a, c, t, g, unknown or other
  misc_feature (519)..(519): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaaactcctgatttactgggcttctacccgggcatccggggttcctaaccgnttcattggcagcgggtctgggaccgatttcactctcaccatcagcagccctgcaggctgaaagntgtggctagtttatactgtcagcaacattataccttctttcgtctacgtttcggacggaggaccaagggtgagatacgaaacgactggtgctgccaccatctgtcttntac

SEQ ID NO: 64919 - DNA, 516 bp, Homo sapiens
  misc_feature: GYAE6OF02F2GCU.31.78.H01.1.454.CMB.1.raw
  modified_base (434)..(434): a, c, t, g, unknown or other
  misc_feature (434)..(434): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttactgggcttctacccgggcatccggggttcctaaccgattcattggcagcgggtctgggaccgatttcactctcaccatcagcagcctgcaggctgaagatgtggctagtttatactgtcagcaanattatacttctttcgtctacgtttcggcggtaggaccaaggtgagatacgaaacgactgtgctgcaccatctgttcttctac

SEQ ID NO: 64920 - DNA, 539 bp, Homo sapiens
  misc_feature: GYAE6OF02I71WN.31.78.H01.1.454.CMB.1.raw
  modified_base (311)..(311): a, c, t, g, unknown or other
  misc_feature (311)..(311): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacaactacttagcttggtaccagcagaaagtaggacagcctctaaactcctagattacnggcttcacccgggcacgtccgggttcctaacgattcattggcagcggtctgggaccatttcactctcaccatcagcagcctgcaggctgaagagtgtcggctagtttatactgtacagacaactattactactttcttcgtctacgtttcgacggtaggaccaaggtgagtactacgaaacgtactggtcgacgtagcctaaccgtattaccgtgttacttactaccg

SEQ ID NO: 64921 - DNA, 558 bp, Homo sapiens
  misc_feature: GYAE6OF02IBUDY.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggcccccacaataacaactacttagcttggtaccagcaagaaagtaggacagcctacctaaactcctagtatttacgtgggtcttccgtaccccgggcaacgttcccggggtttacctaaaccgattcattcggcaggcgggtctgggaccgtatttcgactctcaccatcagcagcctgcaggctagaagagtgtggctagtttattactgtcagcaactattactacttcttcgtctacgtttcgggcggtaggacctaagggtgagtactacgaaacgtaacttggtagtcgtgacaccagttctgttccttctac

SEQ ID NO: 64922 - DNA, 532 bp, Homo sapiens
  misc_feature: GYAE6OF02HQRJM.31.78.H01.1.454.CMB.1.raw
  modified_base (356)..(356): a, c, t, g, unknown or other
  misc_feature (356)..(356): n is a, c, g, or t
  modified_base (403)..(403): a, c, t, g, unknown or other
  misc_feature (403)..(403): n is a, c, g, or t
  modified_base (418)..(418): a, c, t, g, unknown or other
  misc_feature (418)..(418): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctacctaaactcctagatttactggccttcgtaccccgggctagtcccggggttcctaaaccggtnttcattggcagcgggtctgggacctatttcactctcaccatcagcancctgcaggctgaagntgtggctagtttattactgtcagcaatattattacttctttacgtctacgtttcgggcggtaggaccaaggtggagtactacgaaacgtactgtgctgcacatctgtctctacg

SEQ ID NO: 64923 - DNA, 542 bp, Homo sapiens
  misc_feature: GYAE6OF02HKE7G.31.78.H01.1.454.CMB.1.raw
  modified_base (416)..(416): a, c, t, g, unknown or other
  misc_feature (416)..(416): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctacctaaactcctgtatttactgggtcttcgtacccgggcacgttcccggggttcctaaccgtattcattggcagcgggtctgggaccatttcactctcaccatcagcagcctgcaggctgaagntgtgctagtttatacgtgtcagcaactattatacttctttcgtactacgtttcggacggtacggacagggtgagtataccgaaagacgttggtacgcgtgacctacattcgtacgttcttcgtacc

SEQ ID NO: 64924 - DNA, 545 bp, Homo sapiens
  misc_feature: GYAE6OF02GN4W2.31.78.H01.1.454.CMB.1.raw
  modified_base (310)..(310): a, c, t, g, unknown or other
  misc_feature (310)..(310): n is a, c, g, or t
  modified_base (324)..(324): a, c, t, g, unknown or other
  misc_feature (324)..(324): n is a, c, g, or t
  modified_base (341)..(341): a, c, t, g, unknown or other
  misc_feature (341)..(341): n is a, c, g, or t
  modified_base (401)..(401): a, c, t, g, unknown or other
  misc_feature (401)..(401): n is a, c, g, or t
  modified_base (428)..(428): a, c, t, g, unknown or other
  misc_feature (428)..(428): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctctaaactcctgatttacnggcttcacccgggnatccgggttctaaccgnttcattggcagcggtctgggaccgattcactctcaccatcagcagcctgcaggctagaanatgtggctagtttatactgtcagcaanattatacttctttcgtctacgtttcggcggtaacgggaccaaggtggagacgtaccgaaaacggtaaccttgggtacggtacttgacctaaccctagttactcggttccttcgtaac

SEQ ID NO: 64925 - DNA, 526 bp, Homo sapiens
  misc_feature: GYAE6OF02FTWA9.31.78.H01.1.454.CMB.1.raw
  modified_base (312)..(312): a, c, t, g, unknown or other
  misc_feature (312)..(312): n is a, c, g, or t
  modified_base (523)..(523): a, c, t, g, unknown or other
  misc_feature (523)..(523): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctacctaaactcctgatttacngggcttctacccgggcatccggggttcctaaccgattcattggcagcgggtctgggaccatttcactctcaccatcagcagcctgcaggctgaagatggtggctagtttattactgtcagcaacatttatactttctttcgtctacgttttcgggcggtagggaccaagggtggagactacgaaacgactgtggctgcaccatctgtcctntac

SEQ ID NO: 64926 - DNA, 512 bp, Homo sapiens
  misc_feature: GYAE6OF02JDX2U.31.78.H01.1.454.CMB.1.raw
  modified_base (509)..(509): a, c, t, g, unknown or other
  misc_feature (509)..(509): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattggcccccacaataacaactacttagcttggtaccagcagaaagtaggacagcctctaaactcctgatttactggcttctacccggcatccggggttcctaaccgattcattgcagcgggtctgggacatttcactctcaccatcagcagcctgcaggctgaagatgtgctagtttacttactgtcagcaacattatacttcttacgtctactttcggacgtacggaccaaggtgacgatacgaaacgactgtgctgcactatctgtctntac

SEQ ID NO: 64927 - DNA, 578 bp, Homo sapiens
  misc_feature: GYAE6OF02G05GK.31.78.H01.1.454.CMB.1.raw
  modified_base (311)..(311): a, c, t, g, unknown or other
  misc_feature (311)..(311): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagaggccaccatcaactgcaagtccagccagagtgttttattggccccacaataacaactacttagcttggtaccagcagaaagtaggacagcctacctaaactcctgatttacngggcttctacccgggcacgtccgggttcctaaccgattcattggcagcgggtctgggacctatttcactctcaccatcagcagcctgcaggctagaagatgtggctagtttatactgtcagactaactatttatactttctttcgttactacgtttccgggcggtaacgggtaaccgtaagggtggacgtaagtaaccgaaaacggtaaccttaggtcggtaccttggaccctacccgtaagttcccttaggttccttactaacccg

SEQ ID NO: 64928 - DNA, 528 bp, Homo sapiens
  misc_feature: GYAE6OF02G0UIX.31.78.H01.1.454.CMB.1.raw
  modified_base (525)..(525): a, c, t, g, unknown or other
  misc_feature (525)..(525): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctacctaaactcctgatttactgggcttctacccgggcacgtccggggttcctaaccgattcattggcagcgggtctgggacccgtatttcactctcaccatcagcagcctgcaggctagaagatgtggctagtttattactgtcagacaactattatactttctttcgtctacgtttcggcggtaggaccaagggtggagatacgaaacgtaactgtgctgcacatctgtcttntac

SEQ ID NO: 64929 - DNA, 521 bp, Homo sapiens
  misc_feature: GYAE6OF02FWN2G.31.78.H01.1.454.CMB.1.raw
  modified_base (407)..(407): a, c, t, g, unknown or other
  misc_feature (407)..(407): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttactgggcttcacccgggcatccggggttcctaaccgattcattggcagcgggtctgggaccgatttcactctcaccatcagcagcctgcaggctgaagntgtggctagtttatactgtcagcaacattatacttctttcgtctacgtttcggcggtaggtaccaagggtggagatacgaaacgaacttggtggctgcaccatctgtcttctac

SEQ ID NO: 64930 - DNA, 528 bp, Homo sapiens
  misc_feature: GYAE6OF02I0MKX.31.78.H01.1.454.CMB.1.raw
  modified_base (436)..(436): a, c, t, g, unknown or other
  misc_feature (436)..(436): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctacctaaactcctgatttactgggcttcgtacccgggcacgtccggggttacctaaccgattcattggcaggcggtctgggaccgtatttcactctcacatcagcagcctgcaggctagaagagtgtgctagtttatactgtcancaatattatacttctttcgtctacgtttcggcggacggtaccaagggtgagtatacgaacgtaacgtgtcgctgcactatctagttctctac

SEQ ID NO: 64931 - DNA, 543 bp, Homo sapiens
  misc_feature: GYAE6OF02FS5QX.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcaagaaagtaggacagcctacctaaactcctgatttactgggcttcgtacccgggcacgttcccggggttcctaaccgattcattcggcagcgggtctgggaccgtatttcactctcaccatcagcagcctgcaggctaggaagagtggtggctagtttactacttgtcagcaactattatactttctttcgtctacgtttcggcggtaggtaccaagggtgagagtacgaaacggactggtagcgtagaccacgatctgtccttctac

SEQ ID NO: 64932 - DNA, 516 bp, Homo sapiens
  misc_feature: GYAE6OF02FKBKC.31.78.H01.1.454.CMB.1.raw
  modified_base (513)..(513): a, c, t, g, unknown or other
  misc_feature (513)..(513): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttactgggcttctacccgggcatccggggttcctaaccgattcattggcagcgggtctgggaccgatttcactctcaccatcagcagcctgcaggctgaagatgtggctagtttatactgtcagcaactattatactttctttcgtctacgtttcggcggagggaccaaggtgagatacgaaacgactgtggctgcacatctgtctntac

SEQ ID NO: 64933 - DNA, 543 bp, Homo sapiens
  misc_feature: GYAE6OF02H5YYZ.31.78.H01.1.454.CMB.1.raw
  modified_base (350)..(350): a, c, t, g, unknown or other
  misc_feature (350)..(350): n is a, c, g, or t
  modified_base (416)..(416): a, c, t, g, unknown or other
  misc_feature (416)..(416): n is a, c, g, or t
  modified_base (539)..(539): a, c, t, g, unknown or other
  misc_feature (539)..(539): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggcccccacaataacaactacttagcttggtaccagcagaaagtaggacagcctccctaaaactcctgtattactgggcttccgacccgggcagtccgggttcctaaccgnttcattggcagcgggtctggggacctatttcacctctcacccatcagcagcctgcaggctagaagntgtggctaagtttattactgtcagcaattattatactttctttcgtctacgtttcggacggaggaacctaagggtggagacttacgaaacgtacgtggtcggctgctaccattctgttccttntacc

SEQ ID NO: 64934 - DNA, 509 bp, Homo sapiens
  misc_feature: GYAE6OF02IOH8E.31.78.H01.1.454.CMB.1.raw
  modified_base (343)..(343): a, c, t, g, unknown or other
  misc_feature (343)..(343): n is a, c, g, or t
  modified_base (432)..(432): a, c, t, g, unknown or other
  misc_feature (432)..(432): n is a, c, g, or t
  modified_base (506)..(506): a, c, t, g, unknown or other
  misc_feature (506)..(506): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgtttattggccccacaataacaactacttagcttggtaccagcagaaagtaggacagcctcctaaactcctgatttactgggcttctacccgggcatccgggttcctaacgnttcattggcagcgggtctgggaccatttcactctcaccatcagcagcctgcaggctgaagatgtggctagtttatactgtcagcaactnttatacttctttcgtctactttcggcggaggaccaaggtgagatacgaaacgtactgtgctgcacatctgtctntac

SEQ ID NO: 64935 - DNA, 589 bp, Homo sapiens
  misc_feature: GYAE6OF02JH8RC.31.78.H01.1.454.CMB.1.raw
tcagcagtagacgtcacgaccggtgctcgatttagtgtgagtagtttgggtttgggggaggctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttactgggcttctaccgggcatccggggttcctaacgattcattggcagcgggtctgggaccattcactctcacatcagcagctgcagctgaacgatgtggctagtttatactgtcagtcaactattaactactttcgtttcgtctaacgttttccgggcgggtaacggtaacccgtaaggggttggacgtaacgtaccgtaaaaccggtaattcgggttaccgggactttacggacccgttacccgtaacgttccgtttacggtttccgttaccttaaccg

SEQ ID NO: 64936 - DNA, 601 bp, Homo sapiens
  misc_feature: GYAE6OF02FX5DG.31.78.H01.1.454.CMB.1.raw
  modified_base (216)..(216): a, c, t, g, unknown or other
  misc_feature (216)..(216): n is a, c, g, or t
  modified_base (316)..(316): a, c, t, g, unknown or other
  misc_feature (316)..(316): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccacatcaacgtncaagtccagccagtagttgttttattcggccccacaataacaactacttagcttggaccagcagaaagtaggacagcctacctaactcctgtatttacgngggtcttcgtacccgggctacgttcccggggttacctaacgtattcagttcggctagtccgggtctggggacctatttcacgtctcaccatccagtcacgcctgcacggctagaagatgtcgactagtttactacgtgtcgagacaactattatactttcctttacgtactaccgtttcgggacggtacggtacgtaagggtggtagacttaccgtaaacggtaacgttcgggtaggtaccttacggacctaaccctagtttccttcggttaccttacgtacccg

SEQ ID NO: 64937 - DNA, 543 bp, Homo sapiens
  misc_feature: GYAE6OF02HLUEQ.31.78.H01.1.454.CMB.1.raw
  modified_base (325)..(325): a, c, t, g, unknown or other
  misc_feature (325)..(325): n is a, c, g, or t
  modified_base (342)..(342): a, c, t, g, unknown or other
  misc_feature (342)..(342): n is a, c, g, or t
  modified_base (403)..(403): a, c, t, g, unknown or other
  misc_feature (403)..(403): n is a, c, g, or t
  modified_base (406)..(406): a, c, t, g, unknown or other
  misc_feature (406)..(406): n is a, c, g, or t
tcagcagtagacgtcacgaccggtgctcgatttagtgtgagtagtttgggtttgggggatctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttactggcttcacccgggnagtccgggttccaacgnttcattggcagcgggtctgggacctatttcactctcaccatcagcagcctgcagctgaagntgnggctagtttacttactgtcagcaaactattatacttctttcgtactacctttcggacggtaggaaccgtaaggtggacgagtacgaaacggtaacttggtacggccttagaccaccgtattcgtcgttcttactacg

SEQ ID NO: 64938 - DNA, 521 bp, Homo sapiens
  misc_feature: GYAE6OF02HGYXX.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctacctaaactcctgatttactgggcttctacccgggcactccggggttcctaaccgattcattggcagcgggtctgggaccatttcactctcaccatcagcagcctgcaggctgaagatgtggcagtttatactgtcagcaactattactacttctttcgtctacgtttcggcggacggaccaagggtggagataccgaaacgactgtaggctgccacatctgtctctac

SEQ ID NO: 64939 - DNA, 588 bp, Homo sapiens
  misc_feature: GYAE6OF02FWY2E.31.78.H01.1.454.CMB.1.raw
  modified_base (313)..(313): a, c, t, g, unknown or other
  misc_feature (313)..(313): n is a, c, g, or t
  modified_base (344)..(344): a, c, t, g, unknown or other
  misc_feature (344)..(344): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcagagggccaccatcaactgcaagtccagccagagtgttttacttggccccacaataacaactacttagcttggtaccagcagaaagtaggacagcctacctaaactcctgtatttacngggcttcgtaccggcagtccgggttcaacgnttcattggcagcggtctgggacatttcactctcactatcagcacgcctgacgaggtctagaacgagttgtcggacttagtttactacgttgtacagtactaactaagttacttaacttcgttttacgtacttacgttttacgggaccggtaggtaccgtaagggttcggaaggtactaccggtaaaacgaacgttaggtacggtactaggtaccaacctagttctacggttaccttgtaacccg

SEQ ID NO: 64940 - DNA, 546 bp, Homo sapiens
  misc_feature: GYAE6OF02GR7LK.31.78.H01.1.454.CMB.1.raw
  modified_base (416)..(416): a, c, t, g, unknown or other
  misc_feature (416)..(416): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctacctaaactcctgatttactgggccttcgtaccccgggcacgttcccggggttcctaaccgattcattggcagcgggtctgggaccgatttcactctcaccatcagcagcctgcaggctgaagntgtggctagtttatactgtcagcaacattatacttctttcgtctacgtttcggcggtacggacctaagggtggagtagtacgaaacgtacgttggtacggctagaccacctatccgttgttccttactac

SEQ ID NO: 64941 - DNA, 556 bp, Homo sapiens
  misc_feature: GYAE6OF02F90L5.31.78.H01.1.454.CMB.1.raw
  modified_base (447)..(447): a, c, t, g, unknown or other
  misc_feature (447)..(447): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtaccacgccacgagtgttttatttggtccccacccaataacaactacttagtcttggtaccagcagaaagtaggacagcctccctaaactcctcgatttactagggcttctacccggcgatccgggttcctaaccgacttcacttggtcacgcgggtctgggacgactttcactctcaccactcagcagcctgcaggctgaaacgatggtggcagtttatacttgacngacaactatttactactttctttcgttcacgttttcggcggtacgggaccaagggtggtagactcgaaaacgacttggtgacctgacacctatctcgttcgtacctacg

SEQ ID NO: 64942 - DNA, 528 bp, Homo sapiens
  misc_feature: GYAE6OF02GWFO0.31.78.H01.1.454.CMB.1.raw
  modified_base (525)..(525): a, c, t, g, unknown or other
  misc_feature (525)..(525): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctacctaaactcctgatttactgggcttcgtacccgggcacgtccggggttcctaaccgattcattggcagcgggtctgggaccgtatttcactctcaccatcagcagcctgcaggctagaagatggtggctagtttattactgtcagcaactattattactttctttcgtctacgtttcggacggtaggaccaagggtgagactacgaaacgactgtgctgcacatctgtcttntac

SEQ ID NO: 64943 - DNA, 535 bp, Homo sapiens
  misc_feature: GYAE6OF02IAPDR.31.78.H01.1.454.CMB.1.raw
  modified_base (329)..(329): a, c, t, g, unknown or other
  misc_feature (329)..(329): n is a, c, g, or t
  modified_base (412)..(412): a, c, t, g, unknown or other
  misc_feature (412)..(412): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcaagaaagtaggacagcctcctaaactcctagatttactgggcttctacccgggnagtccggggttcctaaccgattcattggcagcgggtctgggaccgtatttcactctcaccatcagcagcctgcaggctgaagntgtggctagtttattactgtcagcaactatttaactactttcttttacgtctacgttttcgggcggtagggaccaagggtggagactacgaaacgactggtcgctgcacattctgttctctac

SEQ ID NO: 64944 - DNA, 547 bp, Homo sapiens
  misc_feature: GYAE6OF02I1OW3.31.78.H01.1.454.CMB.1.raw
  modified_base (423)..(423): a, c, t, g, unknown or other
  misc_feature (423)..(423): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacaactacttagcttggtaccagcagaaagtaggacagcctacctaaactcctagatttacgtgggccttcgtacccgggcacgttcccggggttacctaaccggattcattggcaggcgggtctgggaccgtatttcactctcaccatcagcagcctgcaggctagaagntgtggctagtttacttactgtcagacaactattatactttctttcgtctacgtttcggcgggtaggtaccgaaggtggagactacgaaacgtactggtcggctgaccacctatctgtcttctac

SEQ ID NO: 64945 - DNA, 551 bp, Homo sapiens
  misc_feature: GYAE6OF02IYZCE.31.78.H01.1.454.CMB.1.raw
  modified_base (317)..(317): a, c, t, g, unknown or other
  misc_feature (317)..(317): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggcccccaccaataacaactacttagcttggtaccagcagaaagtaggacagccctacctaaactcctgatttacgngggcttccgtacccggggcacgttcccggggttcctaaccgtattcagttggcagcgggtctgggaccgtatttcactctcaccatcagcagcctgcgaggctgaagatggtgctagtttatactgtcagcaactattatacttctttcgtctacgtttccggcggacggtaaccgtagggtgagtataacgaaacgtaactggtggactgaccaccgtatctcgttcttctac

SEQ ID NO: 64946 - DNA, 565 bp, Homo sapiens
  misc_feature: GYAE6OF02I99Z3.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcaagaaagtaggacagcctacctaaactcctgtatttacgtgggtccttccgtaccccggggcacgttcccgggggtttaccctaaccgtattccagtttcggcaggcgggtctggggacctatttcactctcaccatcagcagcctgcaggctagaagatgtggctagtttattactgtcagacaactattacttactttctttcgtctacgtttcggcggtacgggaccgtaagggtggagagtacgaaacgtacgttaggtggtctgcaccgtatcgtcgtcttctac

SEQ ID NO: 64947 - DNA, 536 bp, Homo sapiens
  misc_feature: GYAE6OF02HRP6K.31.78.H01.1.454.CMB.1.raw
  modified_base (533)..(533): a, c, t, g, unknown or other
  misc_feature (533)..(533): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagcagagtgttttattggccccacaataacaactacttagcttggtaccagcagaaagtaggacagcctacctaaactcctagatttactgggcttcgtacccgggcagtccggggttacctaaccgattcattcggcagcgggtctgggaccgtatttcactctcaccatcagcagcctgcaggctgaagatgtggctagtttattactgtcagcaaactattacttacttctttctctacgtttcggcggtaggacctaagggtggagatacgaaacgtaactgtaggtctgcacctatcgtgtccttntac

SEQ ID NO: 64948 - DNA, 517 bp, Homo sapiens
  misc_feature: GYAE6OF02FV9LK.31.78.H01.1.454.CMB.1.raw
  modified_base (498)..(498): a, c, t, g, unknown or other
  misc_feature (498)..(498): n is a, c, g, or t
  modified_base (510)..(510): a, c, t, g, unknown or other
  misc_feature (510)..(510): n is a, c, g, or t
  modified_base (514)..(514): a, c, t, g, unknown or other
  misc_feature (514)..(514): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttactgggcttctacccgggcacgtccggggttcctaaccgattcattcggcagcgggtctgggaccgatttcactctcaccatcagcacgcctgcaggctgaagatgtgctagtttatactgtcagcaactattaatactttctttcgtctacgtttcggcgaggaccagggtgagatacaaacgactggngctgcacatctntctntac

SEQ ID NO: 64949 - DNA, 527 bp, Homo sapiens
  misc_feature: GYAE6OF02IAA0M.31.78.H01.1.454.CMB.1.raw
  modified_base (348)..(348): a, c, t, g, unknown or other
  misc_feature (348)..(348): n is a, c, g, or t
  modified_base (519)..(519): a, c, t, g, unknown or other
  misc_feature (519)..(519): n is a, c, g, or t
  modified_base (524)..(524): a, c, t, g, unknown or other
  misc_feature (524)..(524): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggcccccacaataacaactacttagcttggtaccagcagaaagtaggacagcctcctaaactcctgatttactgggcttctacccgggcagtccggggttcctaaccgnttcattggcagcgggtctgggaccgatttcactctcaccatcagcagcctgcaggctagaagatgtggctagtttattactgtcagcaactattacttactttctttcgtctacgtttcgggcggagggtaaccagggtgagatacgaaacgactggtgctgcaccatctntcctntac

SEQ ID NO: 64950 - DNA, 948 bp, Homo sapiens
  misc_feature: GYAE6OF02JGAPA.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgtttattcggcccacaataacactactagcttggtaccagcagaaagtggacagccctacctaaactcctagtactttaccgtgggtcctttccgtaccccggggctacgttcccgggggtttacctaaacccggtattccgtaacgtttcgggacctaacgggtccggggttccgttacggggggtaaccccgttaacgtttttcccgaaaccgtttcccgttaacccgtaaaccccgtaacgttcccgaaacgggtaccccgtaaccgggtccccgttacggccccgggtaaacggggtacccgttaacggggtaaaaaccgggtaacggtttacggggttacggggtaacccgtttaaaacgggtttttttaaccggtttaaacccgtttacgggttaacccgtaaacgggttaaccctaaaaccgtttaaacgtttttaaactttaacccgtttttttacccggtttttaacccgtttacccgttaaacccgggttttttaccgggggacccggggttaaaaccggggttaaaccccggttaaaaggggggtttccgggtaaacgggttaaaccgtttaaacccggtaaaaacggggttaaacccgtttacgggggttaaccggggttaacccgtttaccggggtaccccgtaaaccccggtttaaacgtttcccggtttacggtttaccccttttaacccggttaaccccg

SEQ ID NO: 64951 - DNA, 811 bp, Homo sapiens
  misc_feature: GYAE6OF02H4F5Y.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcaagaaaagtaggacagccctactaaaactcctagactttactgggccttccgtaaccccggggctaacgttcccgggggtttaccctaaaccggtatttccgtaatttcgggcctaaggccggggtttactcgggggaaccccgtaatttttccgaacttccttaccaaccctattccgaacgccgaacggtccccttagcccggtaacggccgttaggaaaacggtaacgttaggttcgggtaaccgttaaggtttttaaacttttaaccgttcggttaccgaaacggtacctaaaaccgtaaactttttaacgtttaaacctttttacccgtttttccgttacccttaaccggtttttacccgggggaaccggggttaaacgggtaaaccccggtaaagggggtttacgggaaacggttaaccgttaaccgtaaaaaaccgggtaaccgttacgggttaacggggtcccgttacggttaacccggaaccccttaaagttcccggtttacgtttacccgttacctttaaccccgg

SEQ ID NO: 64952 - DNA, 529 bp, Homo sapiens
  misc_feature: GYAE6OF02HYROL.31.78.H01.1.454.CMB.1.raw
  modified_base (412)..(412): a, c, t, g, unknown or other
  misc_feature (412)..(412): n is a, c, g, or t
  modified_base (526)..(526): a, c, t, g, unknown or other
  misc_feature (526)..(526): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctacctaaactcctgatttactgggtcttcgtacccgggcagtcccggggttcctaaccgtattcattggcagcgggtctgggacatttcactctcacatcagcagcctgcaggctgaaagntgtggctagtttattactgtcagacaaactattacttactttctttcgtctacgtttcggcggaggaccgaagggtgagatacgaaacgactgtggctgcaccatctgtccttntac

SEQ ID NO: 64953 - DNA, 571 bp, Homo sapiens
  misc_feature: GYAE6OF02J0SN3.31.78.H01.1.454.CMB.1.raw
  modified_base (554)..(554): a, c, t, g, unknown or other
  misc_feature (554)..(554): n is a, c, g, or t
  modified_base (561)..(561): a, c, t, g, unknown or other
  misc_feature (561)..(561): n is a, c, g, or t
tcagcagtagacgtcacgaccggtgctcgatttagtgtgagtagtttgggtttgggggtaggcgtacaacaggcaggcaggggcgagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccaccaataacactactagctgtaccagcagaaagtggacagccctacctaaactccctgaatttacgtgggccttctaaccccggggcatcccgggggtttccaaaccgattcatggtcagtcggtctggggaccattttcactctcaccatcacgcacgcctagtcacggtctgaagtatgtggactagtttactactgtcagccaactagttacttactttctttcgtacctacgttttcggccgggtaggaacccgtaagggtggactatacgaaaccggtaactggtacggctagctaaccnttacgtntcgttctacg

SEQ ID NO: 64954 - DNA, 524 bp, Homo sapiens
  misc_feature: GYAE6OF02GJY19.31.78.H01.1.454.CMB.1.raw
  modified_base (440)..(440): a, c, t, g, unknown or other
  misc_feature (440)..(440): n is a, c, g, or t
  modified_base (521)..(521): a, c, t, g, unknown or other
  misc_feature (521)..(521): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctacctaaactcctgatttactgggcttcgtacccgggcacgttccggggttcctaaccgattcattggcagcgggtctgggaccgtatttcactctcaccatcagcagcctgcaggctgaagatgtggctagtttatactgtcagcaanattatactttctttcgtctactttcggcggacggacaaggtgagatacaaacttacgtgtgctgcaacctatctcgtcttntac

SEQ ID NO: 64955 - DNA, 524 bp, Homo sapiens
  misc_feature: GYAE6OF02HP5BZ.31.78.H01.1.454.CMB.1.raw
  modified_base (327)..(327): a, c, t, g, unknown or other
  misc_feature (327)..(327): n is a, c, g, or t
  modified_base (499)..(499): a, c, t, g, unknown or other
  misc_feature (499)..(499): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctagatttactggcttctacccgggnagtccgggttcctaaccgattcattggcagcgggtctgggaccgatttcactctcaccatcagcagcctgcagctgaagatgtggctagtttattacgtgtcagcaactattactactttctttcgtctactttcggcggaggaccgaaggtggagatacgaaacgactggngtctgacaccattcgtgtcttctac

SEQ ID NO: 64956 - DNA, 723 bp, Homo sapiens
  misc_feature: GYAE6OF02JGAPD.31.78.H01.1.454.CMB.1.raw
  modified_base (324)..(324): a, c, t, g, unknown or other
  misc_feature (324)..(324): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgacaagtccagccagagttgttttattcggcccccaacaataacaactactagcttggtaccagcaagaaagtaggacagccctacctaaactcctagtactttaccgngggtccttccgtacccgggctacgttcccggggttacctaaaccgattccaagttcggacagggtccgggttctacggggtaccctatttccgacttccgtaccaccgtaattccgagtccacggtccctaggcctaagggtcctaggtaaacggtagttacgggtacggtacgttaacggttttaacgttaaccgtcggttaccgaacggtactaaacgtactttaacgttaacctttccgttttaccgtaccttaccggtttccgggaccgggtacgggtaacccgtaaggggttagggacgtaacgttaaccggtaaaaccggtaacttgggtacggtaccgttacggaacccttaaccgtacgtttccggttacgtttacccttaccgttaaccg

SEQ ID NO: 64957 - DNA, 593 bp, Homo sapiens
  misc_feature: GYAE6OF02I6VFV.31.78.H01.1.454.CMB.1.raw
  modified_base (332)..(332): a, c, t, g, unknown or other
  misc_feature (332)..(332): n is a, c, g, or t
  modified_base (358)..(358): a, c, t, g, unknown or other
  misc_feature (358)..(358): n is a, c, g, or t
  modified_base (442)..(442): a, c, t, g, unknown or other
  misc_feature (442)..(442): n is a, c, g, or t
  modified_base (534)..(534): a, c, t, g, unknown or other
  misc_feature (534)..(534): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggccccaccaataacaactacttagcttggtaccagcagaaagtaggacagccctacctaaactcctgatttacgtggcttccacccgggnacgttcccggggttacctaaaccgtnttccatttcggacaggtccggggtctacggggacccagttttccacttcctcaaccctagtcagcagcctgccgaggctgaagntggcgtctagtttattactgtcagccaacgtatttatacctttctttacgtactaccgtttcgggacgggtacggtaaccgaagggtcgganaacgtaccgaaaacgtaacgtgttacggcttaggacctactacgtctcgtacttctacc

SEQ ID NO: 64958 - DNA, 527 bp, Homo sapiens
  misc_feature: GYAE6OF02IFG9R.31.78.H01.1.454.CMB.1.raw
  modified_base (351)..(351): a, c, t, g, unknown or other
  misc_feature (351)..(351): n is a, c, g, or t
  modified_base (415)..(415): a, c, t, g, unknown or other
  misc_feature (415)..(415): n is a, c, g, or t
  modified_base (524)..(524): a, c, t, g, unknown or other
  misc_feature (524)..(524): n is a, c, g, or t
tcagcagtagacgtcacgaccggtgctcgatttagtgtgagtagtttgggtttgggggatctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggcccccacaataacaactacttagcttggtaccagcagaaagtaggacagcctaccctaaactcctgatttactgggcttcgtacccgggcagtccggggttcctaaccgnttcattggcagcgggtactgggacctatttcactctcaccatcagcagcctgcaggctagaagntgtggctagtttattactgtcagcaactattattaccttctttcgtctacgtttcgggcggtaggaccaaggtgagatacgaaacgactggtgctgcacatctgttctntac

SEQ ID NO: 64959 - DNA, 543 bp, Homo sapiens
  misc_feature: GYAE6OF02I3S19.31.78.H01.1.454.CMB.1.raw
  modified_base (330)..(330): a, c, t, g, unknown or other
  misc_feature (330)..(330): n is a, c, g, or t
  modified_base (421)..(421): a, c, t, g, unknown or other
  misc_feature (421)..(421): n is a, c, g, or t
  modified_base (538)..(538): a, c, t, g, unknown or other
  misc_feature (538)..(538): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactactagcttggtaccagcagaaagtaggacagcctacctaaactcctgactttacgtgggcttcgtacccgggnacgtccggggttcctaaccgattcattggcagcgggtctgggaccgtatttcacgtctcaccatccagcacgcctgcaggctagaagatgngctagtttatactgtcagcaacattatactttcttcgtactacgtttcggacggaggtaccaaggttggagatacgaaacgtaacgtggtacgctcgacacctatcgtcgttacttntaccg

SEQ ID NO: 64960 - DNA, 519 bp, Homo sapiens
  misc_feature: GYAE6OF02JCAZQ.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttactgggcttctacccgggcatccggggttcctaaccgattcattggcagcgggtctgggaccgatttcactctcaccatcagcagcctgcaggctgaagatgtggctagtttatactgtcagcaacattatactttctttcgtctacgtttcggcggtaggaccaaggtgagactacgaaacgactgtggctgcacctatctgtcttctac

SEQ ID NO: 64961 - DNA, 576 bp, Homo sapiens
  misc_feature: GYAE6OF02GEUZ1.31.78.H01.1.454.CMB.1.raw
  modified_base (313)..(313): a, c, t, g, unknown or other
  misc_feature (313)..(313): n is a, c, g, or t
  modified_base (331)..(331): a, c, t, g, unknown or other
  misc_feature (331)..(331): n is a, c, g, or t
tcagcagtagacgtcacgaccggtgctcgatttagtgtgagtagtttgggtttgggggagcgtacaacaggcagggcaggggcacgcaagatggtgttgcagacccaggtcttcatttctctgttgctctggatctcgtggtgcctacggggacatcgtgatgagccagtttccagactcctggctagtgtctctgggcagaggccacgatcaactgacaagtccagccagacgtgttttatcggcccacaataacactactagcttggtaccagcagaaagtggacagcctacgtaaactcctgactttacngggcttactaccccgggntacgtccggggttacctaaccgattcgagttcggcaaggtccgggtctgggggaaccctattttcacgttctacaccgattccaagtcagcctgactaaggctaggaagtactgtacggctagttttatacgtgtacagcaacgtattacaactttcgttcgtactacgtttcgggacgtaggtacctaagggtcgagatacgaactaacgtggtggtctgacaccgtatctacgttcctgtacg

SEQ ID NO: 64962 - DNA, 518 bp, Homo sapiens
  misc_feature: GYAE6OF02GAU3P.31.78.H01.1.454.CMB.1.raw
  modified_base (515)..(515): a, c, t, g, unknown or other
  misc_feature (515)..(515): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttactgggcttctacccgggcatccggggttcctaaccgattcattggcagcgggtctgggacccatttcactctcaccatcagcagcctgcaggctgaagatgtggctagtttatactgtcagcaacattatactttctttcgtctacgtttcggcggagggaccaaggtggagatacgaaacgactggtgctgcaccatctgtcttntac

SEQ ID NO: 64963 - DNA, 517 bp, Homo sapiens
  misc_feature: GYAE6OF02HD9WA.31.78.H01.1.454.CMB.1.raw
  modified_base (410)..(410): a, c, t, g, unknown or other
  misc_feature (410)..(410): n is a, c, g, or t
  modified_base (514)..(514): a, c, t, g, unknown or other
  misc_feature (514)..(514): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactactagcttggtaccagcagaaagtaggacagcctcctaaactcctgatttactgggcttctacccgggcagtccggggttcctaaccgattcattggcagcgggtctgggaccatttcactctcaccatcagcagcctgcaggctgaagatgnggctagtttattactgtcagcaacattactacttctttcgtctacgtttcggcggtaggaccaagggtgagatacaaacggaactgtggctgcacatctgtctntac

SEQ ID NO: 64964 - DNA, 547 bp, Homo sapiens
  misc_feature: GYAE6OF02GGCHO.31.78.H01.1.454.CMB.1.raw
  modified_base (411)..(411): a, c, t, g, unknown or other
  misc_feature (411)..(411): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacaactacttagcttggtaccagcagaaagtaggacagcctacctaaactcctgatttactgggcttcgtacccgggcactccggggttcctaaccgattcattggcagcggtctgggaccgatttcactctcaccatcagcagcctgcaggctgaagntgtggctagtttatactgtcagcaactattatactttctttcgtctacgtttcgggacggtacgggtaccaagggtcggagtacgtacgaaaacgtacgtggtacggtactcgaccacctatctcgttcttactac

SEQ ID NO: 64965 - DNA, 526 bp, Homo sapiens
  misc_feature: GYAE6OF02G2AVV.31.78.H01.1.454.CMB.1.raw
  modified_base (406)..(406): a, c, t, g, unknown or other
  misc_feature (406)..(406): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgtttattggccccacaataacaactacttagcttggtaccagcagaaagtagacagcctcctaaactcctgatttactgggcttctacccgggcatccggggttcctaaccgattcattggcagcgggtctgggacccatttcactctcaccatcagcagcctgcaggctgaagntgtggctagtttatactgtcagcaacattatactttctttcgtctactttcggcgggtacggaccgtaagggtggagatacgaaacgtactggtggctgcctacatctgttacctctacg

SEQ ID NO: 64966 - DNA, 519 bp, Homo sapiens
  misc_feature: GYAE6OF02F2Z87.31.78.H01.1.454.CMB.1.raw
  modified_base (311)..(311): a, c, t, g, unknown or other
  misc_feature (311)..(311): n is a, c, g, or t
  modified_base (500)..(500): a, c, t, g, unknown or other
  misc_feature (500)..(500): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttacngggcttctacccgggcatccggggttcctaaccgattcattggcagcgggtctgggaccgatttcactctcaccatcagcagcctgcaggctgaagatgtggctagtttattactgtcagcaacattatactttctttcgttctactttcggcgtacgggacaaggtggagatacgaaacgaactgtgntgcacatctgttcttctac

SEQ ID NO: 64967 - DNA, 537 bp, Homo sapiens
  misc_feature: GYAE6OF02IBIRB.31.78.H01.1.454.CMB.1.raw
  modified_base (406)..(406): a, c, t, g, unknown or other
  misc_feature (406)..(406): n is a, c, g, or t
  modified_base (415)..(415): a, c, t, g, unknown or other
  misc_feature (415)..(415): n is a, c, g, or t
  modified_base (418)..(418): a, c, t, g, unknown or other
  misc_feature (418)..(418): n is a, c, g, or t
  modified_base (532)..(532): a, c, t, g, unknown or other
  misc_feature (532)..(532): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagttgttttattcggccccacaataacaactacttagcttggtaccagcagaaagtggacagcctcctaaactcctgatttactgggcttcgtacccgggcacgtcccggggttacctaaccgattcattggcaggcgggtctgggacctattcactctcaccatcagcagcctgcnggctgaagntgnggctagtttattactgtcagcaactatttaactactttctttcgtctacgtttcggcggtaggaccaggtgagactacgaaacgtactggtcggctgacaccatctgttccttntaccg

SEQ ID NO: 64968 - DNA, 526 bp, Homo sapiens
  misc_feature: GYAE6OF02GO2LV.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctacctaaactcctgatttactgggcttctacccgggcacgtccggggttcctaaccgattcattggcagcgggtctgggaccatttcactctcaccatcagcagcctgcaggctagaagatgtggctagtttatactgtcagcaactattatacttctttcgtctacgtttcggcggtaggaccaagggtgagatacgaaacgaacttgtagctgacaccgatctgttcttctac

SEQ ID NO: 64969 - DNA, 532 bp, Homo sapiens
  misc_feature: GYAE6OF02GBPOS.31.78.H01.1.454.CMB.1.raw
  modified_base (414)..(414): a, c, t, g, unknown or other
  misc_feature (414)..(414): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttactgggcttctacccggggcagtccggggttcctaaccgattcattggcagcgggtctgggacctatttcactctcaccatcagcagcctgcaggctagaagatgnggtctagtttatactgtcagcaactattatactttctttcgtctacgtttcgggcggtacggacctaagggtggagactacgaaacgacttggtggctgaccaccatctgtcttctac

SEQ ID NO: 64970 - DNA, 524 bp, Homo sapiens
  misc_feature: GYAE6OF02GXG44.31.78.H01.1.454.CMB.1.raw
  modified_base (329)..(329): a, c, t, g, unknown or other
  misc_feature (329)..(329): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggccccacaataacaactacttagcttggtaccagcagaaagtaggacagcctacctaaactcctgatttactgggcttcacccgggnagtccgggttcctaacgattcattggcagcgggtctgggactatttcactctcacatcagcagctgcagctagaagatgtgctagtttatactgtacagacaactattactacttctttcgtactacgtttcggcggtaggaccgtaaggtggagatacgaaacgtactggtcgctagcacgatcgtgtctctac

SEQ ID NO: 64971 - DNA, 609 bp, Homo sapiens
  misc_feature: GYAE6OF02F6WCT.31.78.H01.1.454.CMB.1.raw
tcagcagtagacgtcacgaccggtgctcgatttagtgtgagtagtttgggtttgggggtaggctacaacaggcaggcaggggcagcaagatggtgtttgcagacccaggtcttcatttctctgttgctctggatctctggtgccttacgggggacatcgtgtatgagccagttttccagactccctggctgtgtctctgggcgagacggggccaccatccaactgcgaacgtccagccagacgtgttttattcggccccaccaataaccaactacttagcttggtaccagcagtaagtaggacagcctacctaaacgtccgtgactttacgtgggcttcgtaacccgggctaagtcccggggttacctaaccgattcagttcggactaggcgggtctggggaccgtattttaccgacttcctcacctatccagcagccctgacaggtctgaagatggtgactagtttaacttacgtgttcagcaacattaatacttcgtttcgtctacgtttcggcggtagggacctaagggtggagtagtaaccgtaaacggtacgttaggtggtccttaggaccgtaccgtagttccttacggttccttccgtaccg

SEQ ID NO: 64972 - DNA, 538 bp, Homo sapiens
  misc_feature: GYAE6OF02GBBTS.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttactgggcttctacccgggcacgtccggggttcctaaccgattcattggcagcgggtctgggaccgatttcactctcaccatcagcagcctgcaggctgaagatgtggctagtttatactgtcagcaactattatactttctttcgtctacgttttcgggacggacgggtaccaagggtggagtagtacgaaacgtactggtacgtcgtagccactatctgttcttctacg

SEQ ID NO: 64973 - DNA, 525 bp, Homo sapiens
  misc_feature: GYAE6OF02F90H8.31.78.H01.1.454.CMB.1.raw
  modified_base (407)..(407): a, c, t, g, unknown or other
  misc_feature (407)..(407): n is a, c, g, or t
  modified_base (504)..(504): a, c, t, g, unknown or other
  misc_feature (504)..(504): n is a, c, g, or t
  modified_base (522)..(522): a, c, t, g, unknown or other
  misc_feature (522)..(522): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgattactgggcttctacccggcatccggggttcctaaccgattcattggcagcgggtctgggaccgtatttcactctcaccatcagcagcctgcaggctgaagntgtgctagtttatactgtcagctaactatttactactttctttacgtctacgtttcggcggaggtaccgaggtgagtactacgaaacgtatggtcgntcgacgaccatctgtctntac

SEQ ID NO: 64974 - DNA, 513 bp, Homo sapiens
  misc_feature: GYAE6OF02IUKVO.31.78.H01.1.454.CMB.1.raw
  modified_base (410)..(410): a, c, t, g, unknown or other
  misc_feature (410)..(410): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttactgggcttctacccgggcatccggggttcctaaccgattcattggcagcgggtctgggaccatttcactctcaccatcagcagcctgcaggctgaagatgnggcagtttattactgtcagcaactattatactttctttcgtctactttcggcggaggaccaaggtgagatacaaacgaactggtgctgcaccatctgtctcac

SEQ ID NO: 64975 - DNA, 528 bp, Homo sapiens
  misc_feature: GYAE6OF02GFCZ5.31.78.H01.1.454.CMB.1.raw
  modified_base (405)..(405): a, c, t, g, unknown or other
  misc_feature (405)..(405): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactactagcttggtaccagcagaaagtaggacagcctcctaaactcctgattactgggcttctacccgggcagtccggggttcctaaccgattcattggcagcgggtctgggaccattcactctcaccatcagcagcctgcaggctgaagntgtggctagtttatactgtcagcaactattatactttctttcgtctacgtttcggacggtacggaccgtagggtgagtactaccgaaacgtacgtgtacgctgacacctatctgttctctacg

SEQ ID NO: 64976 - DNA, 579 bp, Homo sapiens
  misc_feature: GYAE6OF02IYZMN.31.78.H01.1.454.CMB.1.raw
  modified_base (314)..(314): a, c, t, g, unknown or other
  misc_feature (314)..(314): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctccggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtagacagccctacctaaactcctgtatttacgngggtccttcgtaccccgggctacgttcccggggttacctaaaccgatttccagttcggctaggcgggttcgtcggggacctatttcactctcaccatcagcagcctgcaggctgaagagtgtgctagttacttactgtacagactaaactatttacttactttctttcgtcttacgtttcgggcggtaagggaccgtaaagggtgaagactacgaaacggtaactagtcggctcgaccacctacttctcgttcttctacttcccg

SEQ ID NO: 64977 - DNA, 545 bp, Homo sapiens
  misc_feature: GYAE6OF02HWBKW.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaaactcctagatttactggcttctacccgggcatccgggttcctaaccgattcattgcagcggtctgggaccatttcactctcaccatcagcagcctgcaggctgaagatgtggctagtttatactgtcagcaacattatactttctttcgttctacgtttcggcggtacggaccgtaagggtggagtatacgaaacggtaacttggtaggccttaggccaaccgtacttctacggttccttactaccg

SEQ ID NO: 64978 - DNA, 559 bp, Homo sapiens
  misc_feature: GYAE6OF02IEK3R.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacacgcctcctaaactcctgatttactggcttcgtacccggcagtccgggttcctaaccgattcattggcagcgggtctgggacctagtttcactctcaccatcagcagcctgcaggctagaagatgtggctagtttattactgtacagcaactattattactttctttacgtctaccgtttcgggcggtacggaccgtaagggtggagtaactaaccgaaacgtaacgttggtacggctaggacctaccaagttcttcggttccttcgtaacc

SEQ ID NO: 64979 - DNA, 600 bp, Homo sapiens
  misc_feature: GYAE6OF02IYL93.31.78.H01.1.454.CMB.1.raw
  modified_base (419)..(419): a, c, t, g, unknown or other
  misc_feature (419)..(419): n is a, c, g, or t
  modified_base (446)..(446): a, c, t, g, unknown or other
  misc_feature (446)..(446): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccaccaataacaactacttagcttggtaccagcagaaagtaggacagcctacctaaactcctgatttactgggcttccgtacccgggcacgttcccggggtttcctaaccgattcattggcagcgggtctgggaccgatttcactctcaccatcagcagcctgcaggctagaagntgtggctagtttatactgtcagctaanttatactttcttttcgtctaccgtttcgggacgggtacgggtaacccgaaggggtcggtagtacgttaaccgaaaaccgggtaaacttcggggttcgggtaccgttcggaaccgtaacccgtaattcccgtttacggttcccttacgtaacccg

SEQ ID NO: 64980 - DNA, 608 bp, Homo sapiens
  misc_feature: GYAE6OF02JIGBX.31.78.H01.1.454.CMB.1.raw
  modified_base (427)..(427): a, c, t, g, unknown or other
  misc_feature (427)..(427): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagttgttttattcggccccacaataacactactagcttgtaccagcagaaagtaggacagcctactaaactcctagatttacgtgggcttcgtacccgggcacgttcccgggttacctaaccgtattcattcggcacggcgggtcgtcgggaccgtatttcactctaccaccatccagcacgcctgcacggcagaagntggtggtactagtttacttacgtcgtacagacctaactatttacttacctttcgtttacgtacttaccgtttccgggacgggtaacgggtaccgtaagggtaggtacgtaacgtaaccgaaacggtaacttgggttacggctacggaccctaccgtacttccgtacgttaccttcgtaacc

SEQ ID NO: 64981 - DNA, 518 bp, Homo sapiens
  misc_feature: GYAE6OF02JEBCE.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaaactcctgatttactgggcttctacccgggcatccggggttcctaaccgattcattggcagcgggtctgggacatttcactctcaccatcagcagcctgcaggctgaagatggtgctagtttatactgtcagcaactattatacttctttcgtctacgttttcggcggtaggaccaaggtggagatacgaaacgtactgtggctgcacatctgtcttctac

SEQ ID NO: 64982 - DNA, 519 bp, Homo sapiens
  misc_feature: GYAE6OF02GC7RJ.31.78.H01.1.454.CMB.1.raw
  modified_base (516)..(516): a, c, t, g, unknown or other
  misc_feature (516)..(516): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcaagaaagtaggacagcctcctaaactcctagatttactgggcttctacccgggcacgtccggggttacctaaccgattcattggcagcgggtctgggacctatttcactctcaccatcagcagcctgcaggctgaagatgtggctagtttatactgtcagcaactattatactttctttcgtctacgtttcggcggtacggacagggtgagatacgaaacgatgtgctgcacatctgtctntac

SEQ ID NO: 64983 - DNA, 568 bp, Homo sapiens
  misc_feature: GYAE6OF02G3SCW.31.78.H01.1.454.CMB.1.raw
  modified_base (319)..(319): a, c, t, g, unknown or other
  misc_feature (319)..(319): n is a, c, g, or t
  modified_base (335)..(335): a, c, t, g, unknown or other
  misc_feature (335)..(335): n is a, c, g, or t
  modified_base (399)..(399): a, c, t, g, unknown or other
  misc_feature (399)..(399): n is a, c, g, or t
  modified_base (422)..(422): a, c, t, g, unknown or other
  misc_feature (422)..(422): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgaggagggccaccatcaactgcaagtccagccagagttgttttattcggcccccacaataacaactacttagcttggtaccagcagaaagtaggacagcctacctaaactcctagtatttacgngggcttcgacccgggnacgttccggggttacctaaccgattcattggcagcgggtctgggacctatttcactctacaccntcagcagcctgcaggctgaaagntggtggctagtttatactgtacagactaactattatactttcttacgtctacgtttcgggacggaggtaccgtaaggtggacgtagtacgaaaacgtagtaggtcggactaggacctaccgtagttccgtagttccgttactaccg

SEQ ID NO: 64984 - DNA, 542 bp, Homo sapiens
  misc_feature: GYAE6OF02HMCDH.31.78.H01.1.454.CMB.1.raw
  modified_base (311)..(311): a, c, t, g, unknown or other
  misc_feature (311)..(311): n is a, c, g, or t
  modified_base (325)..(325): a, c, t, g, unknown or other
  misc_feature (325)..(325): n is a, c, g, or t
  modified_base (407)..(407): a, c, t, g, unknown or other
  misc_feature (407)..(407): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtagacagcctacctaaactcctgatttacngggcttcacccggnacgtccgggttcctaacgattcattgcagcggtctgggacctatttcactctcacctatcagcacgcctgcaggctagaagntgtgctagtttattactgtcagcaaactattattacttctttcgtactacgtttcggacggaggaccgtaagggtcgagacgtaccgaaacgtacgtgtacggtcgtgaccaccgtattccgtgttcctactacg

SEQ ID NO: 64985 - DNA, 698 bp, Homo sapiens
  misc_feature: GYAE6OF02JFONQ.31.78.H01.1.454.CMB.1.raw
  modified_base (316)..(316): a, c, t, g, unknown or other
  misc_feature (316)..(316): n is a, c, g, or t
  modified_base (334)..(334): a, c, t, g, unknown or other
  misc_feature (334)..(334): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgtttattcggccccacaataacaactacttagcttggtaccagcaagaaagtaggacagcctacctaaactcctagactttacgnggccttccgtacccgggntacgttcccggggttacctaaccggacttcgagttcggccacggtcgggtactaggggaacccgtagttttccaaccgttctaccaacccgtacttccgacgtaccacgcccgttgccgaaggcctaggaaaacgtgttacggtcggtaccttaagttttaactttaccgtggttaccgacgtaacctaaaccttaagtttaactttaaccgttttccgttttacgtacccttaaccggttttccgggacgggtaacgggtaacccgtaagggttacggtaacgtaactaaccggtaaaacggtaacgttgggtaaccggtctacggacctaaccgtagttacccgtagttcctttactaaccg

SEQ ID NO: 64986 - DNA, 517 bp, Homo sapiens
  misc_feature: GYAE6OF02FQC1Y.31.78.H01.1.454.CMB.1.raw
  modified_base (514)..(514): a, c, t, g, unknown or other
  misc_feature (514)..(514): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttactgggcttctacccgggcatcccggggttcctaaccgattcattggcagcgggtctggggaccgtatttcactctcaccatcagcagcctgcaggctgaagatgtggctagtttatactgtcagcaactattatactttctttcgtctactttcggcggtaggaccaaggtggagatacgaaacgatgtgctgcacatctgtctntac

SEQ ID NO: 64987 - DNA, 517 bp, Homo sapiens
  misc_feature: GYAE6OF02GHPIT.31.78.H01.1.454.CMB.1.raw
  modified_base (409)..(409): a, c, t, g, unknown or other
  misc_feature (409)..(409): n is a, c, g, or t
  modified_base (514)..(514): a, c, t, g, unknown or other
  misc_feature (514)..(514): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttactgggcttctacccgggcatcccggggttcctaaccgattcattggcaggcgggtctgggaccatttcactctcaccatcagcagcctgcaggctgaagntgtggctagtttatactgtcagcaacattatactttctttcgtctacgtttcggcggtaggaccaagggtgagatacgaaacgactggtgctgcacatctgtctntac

SEQ ID NO: 64988 - DNA, 540 bp, Homo sapiens
  misc_feature: GYAE6OF02HRW2U.31.78.H01.1.454.CMB.1.raw
  modified_base (396)..(396): a, c, t, g, unknown or other
  misc_feature (396)..(396): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgtttattggccccacaataacaactacttagcttggtaccagcagaaagtaggacagcctacctaaactcctagatttactgggtccttcgtacccgggcacgttcccggggttacctaaccgattcattggcaggcgggtctgggacctatttcactctcaccntcagcagcctgcagctagaagatgtggctagtttatactgtcagcaactattaatactttctttcgctacgttcggcggaggacctaggtgagactacgaaacgtacgtggtacggctgacctaccgattcgtgttcctactac

SEQ ID NO: 64989 - DNA, 576 bp, Homo sapiens
  misc_feature: GYAE6OF02IE9FQ.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagttgttttattcggcccccacaataacaactacttagcttggtaccagcaagaaagtaggacagcctacctaaactcctagtatttacgtgggtccttcgtaccccgggctacgttccccggggttaccctaaccgtattccgagttcggctaggccggggtctcggggacccgtatttccacttctccacctatcagcagcctgcaggctagaagagtgtggctagtttatacgtgtacagacaactattacttactttcttacgtactacgtttcggcgggtacggaccgaagggtcgagactacgaaacgtactggtcgctgccactattctgtccttctacc

SEQ ID NO: 64990 - DNA, 516 bp, Homo sapiens
  misc_feature: GYAE6OF02HLF6U.31.78.H01.1.454.CMB.1.raw
  modified_base (505)..(505): a, c, t, g, unknown or other
  misc_feature (505)..(505): n is a, c, g, or t
  modified_base (513)..(513): a, c, t, g, unknown or other
  misc_feature (513)..(513): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttactgggcttctacccgggcagtccggggttcctaaccgattcattggcagcgggtctgggaccgatttcactctcaccatcagcagcctgcaggctagaagatgtggctagtttatactgtcagcaactattactacttctttcgtctactttcggcggtaggaccaaggtgagatacaaacgactggtgctgcacntctgtctntac

SEQ ID NO: 64991 - DNA, 691 bp, Homo sapiens
  misc_feature: GYAE6OF02H0W6G.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggccccacaataacaactacttagctggtaccagcaagaaagtggacagcctacctaaactcctgtactttacgtgggtcttccgtaccccgggctacgttcccgggggtttacctaaaccggtacttaccgagtttcggacctacggtccggggttactcggggaacccgtattttccgactcgtaccaacctatccacgcacgccctggacgaacggctaggaaacgtagtcggtggtacttaaggttttaattacgttgttaccaagtacctaaaacttatttaacttaaccttttccgttttaccgtaccgttaaccgttttccgggaccgggtaacgggtaaaccgtaaggggtacggtagtaacgttaccgaaaacggtaaccgttagggtaggtaccgttacggacccgtaacctacgttacgttacgttacttacctaaccg

SEQ ID NO: 64992 - DNA, 782 bp, Homo sapiens
  misc_feature: GYAE6OF02GBIVL.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagttgttttattcggaccccacaataacaactacttagcttggtaccagcaagaaagtaggacagcctacctaaactcctagtactttacgtgggtcctttccgtaccccgggctaacgttcccgggggtttaccctaaaccggtactttccgaagtttcggacctacgggtccggggttccgtcgggggtaaccccgtattttccgaaccgttcctacccaaccctattcccaacggcctacggtccctcggaccgaacggggtcctagggaaacgtaagttcgggttacgggaccgttaaggtttttaactttacgttcggttaccgaacgtacctaaactaacgttttaacttaaccgttttccgtttttaccgttaccttaaccgtttttccgggggaaccgggtaaacggggtaacccgtaaagggggttacgggtaacggtaacgttaacccggtaaaaaccggtaaccgttacgggttaccgggtaccgttacggacccgtaacccgtaacgttaccgtttacggtttaccctttacgttaacccg

SEQ ID NO: 64993 - DNA, 586 bp, Homo sapiens
  misc_feature: GYAE6OF02FWPHA.31.78.H01.1.454.CMB.1.raw
  modified_base (311)..(311): a, c, t, g, unknown or other
  misc_feature (311)..(311): n is a, c, g, or t
  modified_base (319)..(319): a, c, t, g, unknown or other
  misc_feature (319)..(319): n is a, c, g, or t
  modified_base (326)..(326): a, c, t, g, unknown or other
  misc_feature (326)..(326): n is a, c, g, or t
  modified_base (347)..(347): a, c, t, g, unknown or other
  misc_feature (347)..(347): n is a, c, g, or t
  modified_base (357)..(357): a, c, t, g, unknown or other
  misc_feature (357)..(357): n is a, c, g, or t
  modified_base (371)..(371): a, c, t, g, unknown or other
  misc_feature (371)..(371): n is a, c, g, or t
  modified_base (387)..(387): a, c, t, g, unknown or other
  misc_feature (387)..(387): n is a, c, g, or t
  modified_base (389)..(389): a, c, t, g, unknown or other
  misc_feature (389)..(389): n is a, c, g, or t
  modified_base (400)..(400): a, c, t, g, unknown or other
  misc_feature (400)..(400): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttacngggcttcncggccgntacggttccggtacctacgtntctagtcgcnggcggtgcggactnttcactcacactcacncncacgctgacgngctagaagtgtggtcgcttaagtttacttacgtcgtacagtaaccaacttattaactttacctttcgtttccgtactttaccggttcggacgggtaacggtaaccgtagggtacggaatacgtaaaccgaaacgtacgttgggtaccgtacgtacgaccctaaccgtactcgttcgttacttaccg

SEQ ID NO: 64994 - DNA, 542 bp, Homo sapiens
  misc_feature: GYAE6OF02FOSCH.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggaccagcagaaagtaggacagcctacctaaactcctgatttactgggcttcgtacccgggcagttcccggggttcctaaccgattcattggcaggcggtctgggaccatttcactctcaccatcagcagcctgcaggctgaagatgtggctagtttattactgtcagcaactattattactttctttcgttctacgtttcgggacggtagggaccaagggtggagactacgaaaacggaactggtgacgtgaccacctatccttgttccttctac

SEQ ID NO: 64995 - DNA, 555 bp, Homo sapiens
  misc_feature: GYAE6OF02IKAZY.31.78.H01.1.454.CMB.1.raw
  modified_base (552)..(552): a, c, t, g, unknown or other
  misc_feature (552)..(552): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgaggagggccaccatcaactgcaagtccagccagagtgtttattggccccacaataacaactacttagcttggtaccagcagaaagtaggacagcctcctaaactcctagtactttacgtgggtcttcgtacccgggctacgtcccggggttacctaaccgattcattcggcaggtcgggtcgtcgggaccgtatttcactctacacctatcagcacgcctgcgaggctagaagatggtcggactagtttactcttgtcagacaatattatactttctttcgtctacgttcgggacggacggacgagggtgagtatacgaaacgtacgtggtcgctagaccacctagtctgttcctntac

SEQ ID NO: 64996 - DNA, 538 bp, Homo sapiens
  misc_feature: GYAE6OF02G50JF.31.78.H01.1.454.CMB.1.raw
  modified_base (526)..(526): a, c, t, g, unknown or other
  misc_feature (526)..(526): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacaactacttagcttggtaccagcagaaagtaggacagcctacctaaactcctgatttactgggcttcgtacccgggcacgttccggggttacctaaccgattcattggcaggcgggtctgggaccgtatttcactctcaccatcagcagcctgcaggctagaagatgtggctagtttatacttgtcagcaatattatactttctttcgtctacgtttcggcggtacggaccgtaagggtgagtactacgaaacgtaactggtcgtctgacacntctgtcttctac

SEQ ID NO: 64997 - DNA, 547 bp, Homo sapiens
  misc_feature: GYAE6OF02FY2WU.31.78.H01.1.454.CMB.1.raw
  modified_base (314)..(314): a, c, t, g, unknown or other
  misc_feature (314)..(314): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacaactacttagcttggtaccagcagaaagtaggacagcctacctaaactcctagatttacngggcttcgtacccgggctacgttcccggggttcctaaaccgtattcattggcaggcgggtctggggacctatttcactctcaccatcagcagctgcaggctagaagatgtggctagtttatactgtacagacaactattatactttctttcgtctacgtttcggacggtaggtaccgaagggtgagatacgaaacgtactggtcggactgacacctatcgtgttccttatacc

SEQ ID NO: 64998 - DNA, 521 bp, Homo sapiens
  misc_feature: GYAE6OF02JBB5C.31.78.H01.1.454.CMB.1.raw
  modified_base (328)..(328): a, c, t, g, unknown or other
  misc_feature (328)..(328): n is a, c, g, or t
  modified_base (411)..(411): a, c, t, g, unknown or other
  misc_feature (411)..(411): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttactgggcttcgtacccgggnatccggggttcctaaccgattcattggcagcgggtctgggaccgtatttcactctcaccatccagcagcctgcaggctgaagntggtggctagtttattactgtcagtcaactattatacttctttcgtctactttcggcggaggtaccgagggtgagatcgaaacgactggtgctgcactatctgtctctac

SEQ ID NO: 64999 - DNA, 517 bp, Homo sapiens
  misc_feature: GYAE6OF02I14WF.31.78.H01.1.454.CMB.1.raw
  modified_base (312)..(312): a, c, t, g, unknown or other
  misc_feature (312)..(312): n is a, c, g, or t
  modified_base (325)..(325): a, c, t, g, unknown or other
  misc_feature (325)..(325): n is a, c, g, or t
  modified_base (343)..(343): a, c, t, g, unknown or other
  misc_feature (343)..(343): n is a, c, g, or t
  modified_base (506)..(506): a, c, t, g, unknown or other
  misc_feature (506)..(506): n is a, c, g, or t
  modified_base (515)..(515): a, c, t, g, unknown or other
  misc_feature (515)..(515): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttacgnggcttctaccggnacgtccgggttctaacgnttcattggcagcgggtctgggacctatttcactctacaccagtcagcagcctgcaggctagaagatgtggctagtttatacgtgtcagcaacattatacttctttcgtctacgtttcggcgaggtaccaagggtgagtatacgaaacgactgtgctgacactntcgtgtctnac

SEQ ID NO: 65000 - DNA, 542 bp, Homo sapiens
  misc_feature: GYAE6OF02HWPFN.31.78.H01.1.454.CMB.1.raw
  modified_base (419)..(419): a, c, t, g, unknown or other
  misc_feature (419)..(419): n is a, c, g, or t
  modified_base (526)..(526): a, c, t, g, unknown or other
  misc_feature (526)..(526): n is a, c, g, or t
  modified_base (537)..(537): a, c, t, g, unknown or other
  misc_feature (537)..(537): n is a, c, g, or t
tcagcagtagacgtcacgaccggtgctcgatttagtgtgagtagtttgggtttgggggagctacaacaggcaggcaggggcagcaagatggtgttgtagacccaggtcttcatttctctgttgctctggatctctggtgcctacggggacatcgtgatgagccagtttccagactccctggctgtgtctctgggcgagagggccaccatcaactgcaagtccagccagagtgttttatttcggccccaaccaataacaactacttagcttggtaccagcagaaagtaggacagcctcctaaactcctagtatttactgggcttcgtaccccgggcacgtcccggggttcctaaccgattcattggcagcgggtctgggaccgatttcactctcacatcagcacgcctgcaggctgaagntgtggctagtttattactgtacagcaactattattactttctttcgtactacgtttcggcggtacgggaccgaaggtgagatacgaaacgaacgtgtggctgcactntctacgtcttncttcc

SEQ ID NO: 65001 - DNA, 565 bp, Homo sapiens
  misc_feature: GYAE6OF02IEZ5U.31.78.H01.1.454.CMB.1.raw
  modified_base (439)..(439): a, c, t, g, unknown or other
  misc_feature (439)..(439): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattggcccccacaataacaactacttagcttggtaccagcaagaaagtaggacagcctacctaaactcctgtatttacgtggtcttcgtacccgggcacgttcccggggttacctaaccgtattcctagtttcggcctaggccgggtcgtcggggaccgtatttccactcctaccaccatcacgcagcctgcaggctgaagntggtgactagtttatactgtacagcaactattattacttctttcgtctacgtttcggcggtaggaccgtaagggtgagtactacgaaacggtactggtcgtcgtgcacctagtctgttcctactac

SEQ ID NO: 65002 - DNA, 533 bp, Homo sapiens
  misc_feature: GYAE6OF02GS6B3.31.78.H01.1.454.CMB.1.raw
  modified_base (408)..(408): a, c, t, g, unknown or other
  misc_feature (408)..(408): n is a, c, g, or t
  modified_base (529)..(529): a, c, t, g, unknown or other
  misc_feature (529)..(529): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctacctaaactcctgatttactgggcttctacccgggcacgtcccggggttctaaccgattcattggcagcggtctgggaccattcactctcaccatcagcagcctgcaggctgaagntgtggctagtttattactgtcagacaatattatactttctttcgtctacgtttcgggcggagggtaccaagggtgagtataccgaaacgaactggtagctgaccacctatctcgttccttntacc

SEQ ID NO: 65003 - DNA, 549 bp, Homo sapiens
  misc_feature: GYAE6OF02HOHXO.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggccccacaataacaactacttagcttggtaccagcagaaagtaggacagcctacctaaactcctagatttacgtgggccttcgtacccgggcacgtccggggttacctaaccgattcagttggcagcgggtctgggaccatttcactctcaccatcagcagcctgcaggctagaagtagtgtgctagtttattactgtacagacaactattattacttctttcgtctacgtttcggacggtaggaaccaagggtcgagtactacgaaacgtactaggtcggactgacactagtctgtccttactacg

SEQ ID NO: 65004 - DNA, 544 bp, Homo sapiens
  misc_feature: GYAE6OF02IC7F6.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctagtatttactgggcttccgtacccgggcacgttccggggttacctaaccgattcattcggcagcgggtctcggggaccgtatttcgactctacaccatccagcagcctgcaggctgaagatgtggctagtttatactgtcagcaactattactacttctttacgtctacgtttcgacggacggaccgaagggtgagacgtacgaaacgtaactggtagctagcacattctgttacctctac

SEQ ID NO: 65005 - DNA, 558 bp, Homo sapiens
  misc_feature: GYAE6OF02HC3FL.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggccccacaataacaactacttagcttggtaccagcagaaagtaggacagcctacctaaactcctagtactttacgtgggctttccgtaccccgggcacgttcccggggttacctaaccggtacttcattcggcaggtcgggtcgtcgggaccgtagtttcactctcacatcagcagcctgcaggctagaagatgtgctagtttatactgtcagcaactattatacttctttcgtctacgtttcggcggtacggacgaggtaggagatacgaaacgtacgtggtacgcgtcgactacacttcgtacgttcttctacg

SEQ ID NO: 65006 - DNA, 638 bp, Homo sapiens
  misc_feature: GYAE6OF02H50W8.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagtgttttatcggcccacaataacaactacttagcttggtaccagcaagaaagtaggacagcctacctaaactcctagtactttacgtgggtccttacgtaccccgggcaacgttcccggggtttacctaaacccggtatttcgaacgttcggaccaacggtccggggttacgtcggggacccgtagttttccaacttccgtaccaaccagtccagcacgccctgcgaggcctaggaagagtgtggtctaaggtttacttacgtgtacagactaaactatttactacctttctttcgtactacgtttacgggcggtaacgggtaccgtaagggtcggagtacgtaacgaaacggtaacgtggtacggtcgtaggtacctaccgtattccgtacgttacctactaacccg

SEQ ID NO: 65007 - DNA, 517 bp, Homo sapiens
  misc_feature: GYAE6OF02FXWLM.31.78.H01.1.454.CMB.1.raw
  modified_base (514)..(514): a, c, t, g, unknown or other
  misc_feature (514)..(514): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttactgggcttctacccgggcatccggggttcctaaccgattcattggcagcgggtctgggaccgatttcactctcaccatcagcagcctgcaggctgaagatgtggctagtttatactgtcagcaatattatactttctttcgtctactttcggcgagggaccaagggtgagatacgaaacgactggtgctgccacatctcgtcttntac

SEQ ID NO: 65008 - DNA, 523 bp, Homo sapiens
  misc_feature: GYAE6OF02FYJ42.31.78.H01.1.454.CMB.1.raw
  modified_base (229)..(229): a, c, t, g, unknown or other
  misc_feature (229)..(229): n is a, c, g, or t
  modified_base (413)..(413): a, c, t, g, unknown or other
  misc_feature (413)..(413): n is a, c, g, or t
  modified_base (520)..(520): a, c, t, g, unknown or other
  misc_feature (520)..(520): n is a, c, g, or t
tcagcagtagacgtcacgaccggtgctcgatttagtgtgagtagtttgggtttgggggatctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagngtgttttattggccccacaataacaactacttagcttggtaccagcagaaagtaggacagcctcctaaactcctgtatttactgggcttctacccgggcattcccggggttcctaaccgattcattggcagcgggtctgggaccgtatttcactctcaccatcagcagcctgcaggctagaagntgtggctagtttatactgtcagcaactattactactttctttcgtctacgtttcggcggtacggaccaagggtgagatacgaaacgactgtgctgcacatctgtctntac

SEQ ID NO: 65009 - DNA, 540 bp, Homo sapiens
  misc_feature: GYAE6OF02H0EEZ.31.78.H01.1.454.CMB.1.raw
  modified_base (526)..(526): a, c, t, g, unknown or other
  misc_feature (526)..(526): n is a, c, g, or t
  modified_base (537)..(537): a, c, t, g, unknown or other
  misc_feature (537)..(537): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggcccccacaataacaactacttagcttggtaccagcagaaagtaggacagcctcctaaactcctgatttactgggcttcgtacccgggcacgtccggggttcctaaccgattcatttggcagcgggtctgggacctatttccactctcaccatcagcagcctgcaggctgaagatgtggctagtttattactgtcagacaactattacttacttctttcgtctacgtttcgggcggtacgggaaccgtagggtggagacgtacgaaacgtactggtcgctgcaccntcgtcgtcttntac

SEQ ID NO: 65010 - DNA, 526 bp, Homo sapiens
  misc_feature: GYAE6OF02I9NPQ.31.78.H01.1.454.CMB.1.raw
  modified_base (523)..(523): a, c, t, g, unknown or other
  misc_feature (523)..(523): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggcccccacaataacaactacttagcttggtaccagcagaaagtaggacagcctacctaaactcctgatttactgggcttcctacccgggcacgtccggggttcctaaccgattcattggcagcgggtctgggaccgtattcactctcaccatcagcagcctgcagctagaagatgtgctagtttatactgtcagcaactattactactttctttcgtctacgtttcggcggtacggaccaaggtggagatacgaaacgactggtgctgcaccattctgtcttntac

SEQ ID NO: 65011 - DNA, 540 bp, Homo sapiens
  misc_feature: GYAE6OF02HKN1X.31.78.H01.1.454.CMB.1.raw
  modified_base (329)..(329): a, c, t, g, unknown or other
  misc_feature (329)..(329): n is a, c, g, or t
  modified_base (537)..(537): a, c, t, g, unknown or other
  misc_feature (537)..(537): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctacctaaactcctagatttactgggcttctacccgggnatcccgggttcctaaccgattcattggcagcgggtctgggaccgatttcactctcaccatcagcagcctgcaggctgaagatggtggctagtttatactgtcagcaactattactactttctttcgtctacgttttcggacgggaggacctaagggtcggagtactacgaaaacggtaactggtggactgaccacctatcctgtcctntac

SEQ ID NO: 65012 - DNA, 523 bp, Homo sapiens
  misc_feature: GYAE6OF02G0KQM.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttactgggcttctacccgggcagtccggggttcctaaccgattcattggcagcgggtctgggaccgatttcactctcaccatcagcagcctgcaggctgaagatgtggctagtttattactgtcagcaactattatactttctttcgtctacgtttcgggcggtacggaccaagggtgagatacgaaacgactgtggctggacacatctgtcttcac

SEQ ID NO: 65013 - DNA, 559 bp, Homo sapiens
  misc_feature: GYAE6OF02FRPTB.31.78.H01.1.454.CMB.1.raw
  modified_base (426)..(426): a, c, t, g, unknown or other
  misc_feature (426)..(426): n is a, c, g, or t
tcagcagtagacgtcacgaccggtgctcgatttagtgtgagtagtttgggtttgggggagctacaaccaggcaggcagggcagtcaagatggtgttgcagacccaggtcttcatttctctgttgctctggatctctggtgcctacggggtacatcgtgattagagcccagttttccaggactccctggctgtggtctctggggcgagagggccaaccagtccaaactgcaagtccagccagagtgttttatttcggccccacaataacaactacttagacttggtaccagcagaaagtaggacagcctctaaactcctagtatttacctgggcttctacccgggcagtccggggttcctaaccgattcatttggcagcgggtctgggaccatttcactctcgaccatcagcagcctgcagctgaanatagagctagtttatactgtcagcaacattatacttctttacgtactacgttttcggacggtagggtacctaagggttggagtactacgaaacgtaactcggtggtctggcaccgattcgtacgtcttctacg

SEQ ID NO: 65014 - DNA, 523 bp, Homo sapiens
  misc_feature: GYAE6OF02FHA7X.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgtttattcggccccacaataacaactacttagcttggtaccagcagaaagtaggacagcctacctaaactcctgtatttactgggcttcgtacccgggcagtcccggggttcctaaccgattcattcggcaggtcggtcgtgggacctatttcactctcacatcagcacgctgcaggtctagaagatgtgctagtttatactgtcagcaacgtattactactttcttcgtctacgtttcggacgaggacaaggtgagatacgaaagactgcgctagcactatctgtctctac

SEQ ID NO: 65015 - DNA, 540 bp, Homo sapiens
  misc_feature: GYAE6OF02IG1KG.31.78.H01.1.454.CMB.1.raw
  modified_base (419)..(419): a, c, t, g, unknown or other
  misc_feature (419)..(419): n is a, c, g, or t
  modified_base (536)..(536): a, c, t, g, unknown or other
  misc_feature (536)..(536): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgtatttactgggcttcgtacccgggcacgtccggggttcctaaccgattcattggcagcgggtctgggaccgtatttcactctcaccatcagcagcctgcaggctgaagatgtggntagtttattactgtcagacaactattattacttctttcgtctacgtttcggcggtagggacctaagggtggagtagtacgaaacggtaactggtcgtactgcaccatctcgtccttntacc

SEQ ID NO: 65016 - DNA, 519 bp, Homo sapiens
  misc_feature: GYAE6OF02FTDOC.31.78.H01.1.454.CMB.1.raw
  modified_base (409)..(409): a, c, t, g, unknown or other
  misc_feature (409)..(409): n is a, c, g, or t
  modified_base (516)..(516): a, c, t, g, unknown or other
  misc_feature (516)..(516): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctacctaaactcctgatttactgggcttctacccgggcatccggggttcctaaccgattcattggcagcgggtctgggaccgatttcactctcaccatcagcagcctgcaggctgaagntgtggctagtttatactgtcagcaacattatacttctttcgtctactttcggcggtagggaccaagggtggagatacgaaacgactggtggctgcaccatctgtctntac

SEQ ID NO: 65017 - DNA, 566 bp, Homo sapiens
  misc_feature: GYAE6OF02GWHSB.31.78.H01.1.454.CMB.1.raw
  modified_base (316)..(316): a, c, t, g, unknown or other
  misc_feature (316)..(316): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagccctacctaaactcctagactttacgngggccttcgtacccgggctacgttcccggggttaccctaaccggattcagtttcggcaggcggggttctcggggacccgtatttcactctcaccatcagcacgcctgcaggctgaagatggtggctagtttattacgtgtacagacaactattacttacctttctttccgtctacgtttcgggacggtaggaccgtaagggtggagtagtacgaaacgtactggtggactgacactatctcgtcttctac

SEQ ID NO: 65018 - DNA, 596 bp, Homo sapiens
  misc_feature: GYAE6OF02HYGKX.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagttgttttattggacccccacaaataacaactacttagcttggtaccagcaagaaagtaggacacgccctacctaaaactcctagtactttacgtgggtcttccgtacccggggctacgttcccggggttacctaaaccgtattccatttcggctaggtcgggtcgtgggaccctatttcactctcaccatcagcacgcctgcaggctagaagatggtgactaagtttattactgtcagtacaactattaacttactttctttacgtctacgtttcgggacgggaggaccgtaagggtgagtactaacgaaacgtaacgttggtacggtactggaccaccgtattaccgttcgttaccttactacg

SEQ ID NO: 65019 - DNA, 530 bp, Homo sapiens
  misc_feature: GYAE6OF02I13MB.31.78.H01.1.454.CMB.1.raw
  modified_base (327)..(327): a, c, t, g, unknown or other
  misc_feature (327)..(327): n is a, c, g, or t
  modified_base (527)..(527): a, c, t, g, unknown or other
  misc_feature (527)..(527): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttactgggcttctacccgggnacgtcccggggttcctaaccgattcattggcaggcgggtctggggaccatttcactctcaccatcagcagcctgcaggctgaagatgtggctagtttattactgtcagcaactattatactttctttcgtctacgtttcggcggtaggacctaagggtgagatacgaaacgactggtaggctgacaccatctgttccttntac

SEQ ID NO: 65020 - DNA, 968 bp, Homo sapiens
  misc_feature: GYAE6OF02GBOEJ.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctacctaaactcctagactttacgtgggtccttaccgtaccccggggctacgttcccgggggtttaccctaaacccggtactttaccgaacgtttcgggacctaacggggtcccgggggttccgttacggggggtaacccccgtaagttttttacccgaaaccgtttcccgttacccaaacccccgtaaagtttccccgaaacgggtacccgtaaaccgggtacccccgtttacgggaccccgtaacgggggtacccgttaacgggaaaaacggtaacgtttacggggttacggggtacccgtttaaagggttttttaaacgttttaaacccgtttacgggtttacccgtaaacgggtacccttaaaaacccggttaaacttttttaaaaccgtttaaacccgtttttttaccccgtttttttaacccgggtttaccccgtttaacccggttttttttacccggggggaacccgggggttaaaccggggggttaaaaccccggtaaaaggggggtttaccggggtaacgggttaaaccggtttaacccggtaaaaaacccggggttaaacccgtttacgggggttaaccggggtacccgtttaccgggtaaccccgtaaaccccggttaacgtttaccccgttttacgggttttaccccgttttacccgtaaacccgg

SEQ ID NO: 65021 - DNA, 526 bp, Homo sapiens
  misc_feature: GYAE6OF02I7PML.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactactagcttggtaccagcaagaaagtaggacagcctcctaaactcctgatttactgggcttcctacccgggcacgtcccggggttacctaaccgattcattcggcagcgggtctgggaccgtatttcactctcaccatcagcagcctgcaggctagaagatgtggctagtttattactgtcagcaatattatacttctttcgtctacgtttcggcggtacggaccaaggtgagactacgaaacgaactgtgctgcacatctgtcttatac

SEQ ID NO: 65022 - DNA, 742 bp, Homo sapiens
  misc_feature: GYAE6OF02J3NU4.31.78.H01.1.454.CMB.1.raw
  modified_base (340)..(340): a, c, t, g, unknown or other
  misc_feature (340)..(340): n is a, c, g, or t
  modified_base (359)..(359): a, c, t, g, unknown or other
  misc_feature (359)..(359): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacgggacatcgtgatgagcctagtttccagcctccctggctgtgtctcgtgggcgagacgggccaccatcaacgtgcaagtccagccagtacgttgttttacttccggacccctaacaataaccaactacgttagcgttaggtaccagacaagaaacgtaggacacgtccctaccgtaaactccgtagtactttacgnggtccttaccgacccgggntacgttcccggggttacctaaccgtattccgtagttcggcgtacggtccgggttactacggggtaccctacttttccgaccttcctaccaaccctagtccgaacgtccgacgtccgtacggcgtaacgggtctacggtaaagtacgttcgggtacggtaccgtttaaggttttacttacgttacgtaccaacgaccttaaacttaagtttaccgttacctttccgtttaccgtaccgttaccggtttaccggggacggtaaaccgggtaaccgtaagggtccgtaacgtaaccgttaaccggaaaaccgttcgttacggtaccggtaccgtacgacccgtaaccgtacgttaccggtttaccgttacctttacccgttacccg

SEQ ID NO: 65023 - DNA, 641 bp, Homo sapiens
  misc_feature: GYAE6OF02JHFPT.31.78.H01.1.454.CMB.1.raw
tcagcagtagacgtcacgaccggtgctcgatttagtgtgagtagtttgggtttgggggagctacaacaggcaggcgaggggcagcaagatggtgttgcacgacccaggtcttctatttctctgttgctctggatctctggtgccgtacgggacgagtcgtgatgacgccgtacgttcctacgtacctcccgtcggtcgtgtcgtcgtcgtgggcggaggacggaccgaccactacaacgtacgacaagtccacgaccacgagtgtttacttggtaccccgtaccaactaaactaaactaaccttaacgtacttacggtaccaggacctaagaaacgtaaggaacagacctaccgtaaactacctacgacttactacggtacgttcgtaccggtcgtacgtaccggtaccgtaaccgacttacgtacttacgctagcggtacgtcggtacgacgttactactctactaccactacacgcacgctacgcacgactagagacgtagtagtacgtagttattactacgtactagtacaactactactacttacttacgtactacttcgtacgtacgacgtacgtagagacgtacaacgacgtacgtacgtacgtacgtacgtaccgtacgtacgtacgtacgtac

SEQ ID NO: 65024 - DNA, 526 bp, Homo sapiens
  misc_feature: GYAE6OF02H3VI6.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctacctaaactcctgatttactgggcttctacccgggcatccggggttcctaaccgattcattggcagcgggtctgggaccatttcactctcaccatcagcagcctgcaggctgaatatgtgctagtttattactgtcagcaactattatactttctttctactacgtttcggcggtaaggacctaagggtggagatacgaaacgaactggtacgctgcaccatctagtcttctac

SEQ ID NO: 65025 - DNA, 928 bp, Homo sapiens
  misc_feature: GYAE6OF02F9M95.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctcgtgctacgggacgatcgtgatgagccacgtttaccgtacgactccctcggcgtcgtgtctctgggcggagagggccgaccatcaactagcaacgtaccacgaccgacgaggttgtttttattttcggcccccgaaccctaaataaactaaacctaactttaacgcttcggttaaccaacgtcaacgaaaaaggtaacgggaccacgtacccttacccttaaaaaccgttacctcggtaatttttaaccgttcggggcctttacccttaccccggggaccgatttaccccggggggttttaccccgttaaaccgaagttttcctaacgttggggtcccgaacggtccggggggtttccgttacgggggaaccccggtaacttttttccaacccgttacccgttccaaacccccgtaaactttacgtaaccgggaccgtaacgtaccccgtcggtaccgaacgggtacccgttagggtaaaacggtaaacgttgggttacgggaccgttaaacggtttttaacgttttaaccgtaggtttaccgaaacggtaacctaaaccgttaaattttaactttaacccgtttccgttttttacccggttaaccgttaacccgttttttaccggggtacgggggtaaaccgggtaaacccggttaaagggttacggggtaacggtaacttaaacccggtaaaaccgggtaaaacggtttcgggttaccgggtccgttaaccggtacccgtaaaccccgtaagtttcccgtacggttttcccgttttaccgtaacctttccccg

SEQ ID NO: 65026 - DNA, 544 bp, Homo sapiens
  misc_feature: GYAE6OF02HYQDK.31.78.H01.1.454.CMB.1.raw
  modified_base (540)..(540): a, c, t, g, unknown or other
  misc_feature (540)..(540): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcaagaaagtaggacagcctacctaaactcctagatttactgggtcttctacccgggcatccggggttacctaaccgattcattggcaggcgggtctgggaccgtatttcactctcaccatcagcagcctgcaggctgaagatgtggctagtttattactgtacagcaaactattatactttctttcgtctacgtttcggcggaggacctaaggtgagtactacgaaacgtacgtggtggtctgaccaccgtattcgttcgtccttntacg

SEQ ID NO: 65027 - DNA, 517 bp, Homo sapiens
  misc_feature: GYAE6OF02FN82U.31.78.H01.1.454.CMB.1.raw
  modified_base (514)..(514): a, c, t, g, unknown or other
  misc_feature (514)..(514): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctacctaaactcctgatttactgggcttctacccgggcagtccgggttcctaaccgattcattggcagcgggtctgggaccgtatttcactctcaccatcagcagcctgcaggctgaatatgtggctagtttatactgtcagcaactattatactttctttcgtctactttcggcggtaggaccaagggtgagatacgaaacgactgtgctgcacatctgtctntac

SEQ ID NO: 65028 - DNA, 517 bp, Homo sapiens
  misc_feature: GYAE6OF02GA5RV.31.78.H01.1.454.CMB.1.raw
  modified_base (406)..(406): a, c, t, g, unknown or other
  misc_feature (406)..(406): n is a, c, g, or t
  modified_base (495)..(495): a, c, t, g, unknown or other
  misc_feature (495)..(495): n is a, c, g, or t
  modified_base (514)..(514): a, c, t, g, unknown or other
  misc_feature (514)..(514): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagccctactaaactcctgatttactgggcttctacccgggcatccgggttcctaacgattcattggcagcggtctgggaccatttcactctcaccatcagcagctgcagctgaagatgnggctagtttatactgtcagcaactattactactttctttcgtctactttcggcggtaggaccaaggtgagatacgaaacgactgtacgngtagcaccatcgtcgtctntac

SEQ ID NO: 65029 - DNA, 568 bp, Homo sapiens
  misc_feature: GYAE6OF02HCAP5.31.78.H01.1.454.CMB.1.raw
  modified_base (311)..(311): a, c, t, g, unknown or other
  misc_feature (311)..(311): n is a, c, g, or t
  modified_base (327)..(327): a, c, t, g, unknown or other
  misc_feature (327)..(327): n is a, c, g, or t
  modified_base (381)..(381): a, c, t, g, unknown or other
  misc_feature (381)..(381): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttacngggtcttctacccggnactccggggttcctaacgattcattggcagcgggtctgggaccgatttcactcncaccatcagcagcctgcaggctagaagatggtggctagtttaattactgtcagtcaactatttatactttctttacgtcttacgtttcggcggtacgggtaaccgtaagggtggtagtactacgaaaacggtaactgggtacgccgttagaccgtaaccgtacttccgttagttccgttactaaccg

SEQ ID NO: 65030 - DNA, 560 bp, Homo sapiens
  misc_feature: GYAE6OF02HMDHU.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccacatcaactgcaagtccagccagagtgttttattggccccaacaataacaactacttagcttggtaccagcaagaaagtaggacagcctactaaactcctgatttactggcttctacccgggcagtccgggttcctaaccgattcattcggcagcgggtctgggaccgtatttcactctcaccatcagcagcctgcaggctaggaagtagtggtcggcttagtttaacttactgtacagacaactattatactttctttcgtactacgtttcggcgggaaggaccgtaaggtggagaagtacgaaaacgtaacttaggtggacctgaccacctacgttcgtacgttccttactacc

SEQ ID NO: 65031 - DNA, 519 bp, Homo sapiens
  misc_feature: GYAE6OF02IAG1I.31.78.H01.1.454.CMB.1.raw
  modified_base (409)..(409): a, c, t, g, unknown or other
  misc_feature (409)..(409): n is a, c, g, or t
  modified_base (516)..(516): a, c, t, g, unknown or other
  misc_feature (516)..(516): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccaccaataacaactacttagcttggtaccagcagaaagtaggacagcctcctaaactcctgatttactgggcttctacccggcactccggggttcctaaccgattcattggcagcgggtctgggacccgatttccactctcaccatcagcagcctgcagctgagntgtggcagtttattactgtcagcaactattatactttctttcgtctacgtttcggcggaggaccaaggtgagatacgaaacgtactgtgctgcacatcctgttcctntac

SEQ ID NO: 65032 - DNA, 751 bp, Homo sapiens
  misc_feature: GYAE6OF02HGLB8.31.78.H01.1.454.CMB.1.raw
  modified_base (318)..(318): a, c, t, g, unknown or other
  misc_feature (318)..(318): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagaggccaccatcaactgcaagtccagccagagttgttttattcggccccacaataacaactacttagcttggtaaccagacagaaagtagaacagcctacctaaactcctagactttacgngggtccttccgtaccccggggctacgttcccgggggttaccctaaaccggtatttccgaagtttcggactagggtccggggttacctagggggaacccctagttttccgaaccttccttaccaaccctaattccgaacggcctaacggtcccttaggaccgacgggtaccttaggaaagtacgttcggtacgggtcttaaggttttaactttaaccgttggtacctaacgtaacctaaacttaacgttttaactttaaccttttccgtttttaccgttaccgttaacccgtttttaccggggaccggggtaacgggtaaacccgttaaaggggtacgggtaacgtaacgttaaccgaaaacggtaacgttcggtacgggtaccgttacggacctaacccgtagtttcccgttacggttacctttaccgtaccg

SEQ ID NO: 65033 - DNA, 561 bp, Homo sapiens
  misc_feature: GYAE6OF02HDVX8.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggcccccacaataacaactacttagcttggtaccagcagaaagtaggacagcctacctaaactcctgatttactgggccttccgtacccgggctacgttcccggggttacctaaaccggtattccagttcggcaggcgggtctggggacccgtatttcactctccaccatcagcacgcctgcaggctagaagagtgtggactagtttattacttgtacagactaactattactactttctttcgtctacgtttcggcggtacggaccagggtgagactacgaaacgtactggtcgctgcctaccatcgtacgttcttctacc

SEQ ID NO: 65034 - DNA, 529 bp, Homo sapiens
  misc_feature: GYAE6OF02H7ARJ.31.78.H01.1.454.CMB.1.raw
  modified_base (348)..(348): a, c, t, g, unknown or other
  misc_feature (348)..(348): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctccctaaactcctgatttactgggcttctacccgggcagtccggggttcctaaccgnttcattggcagcgggtctgggaccgatttcactctcaccatcagcagcctgcaggctgaagatgtggctagtttattactgtcagcaactattactactttctttctctacgtttcggcggacggtaccgaaggtgagactacgaaacgacgtggtggtactgcaccgatctgttctctac

SEQ ID NO: 65035 - DNA, 585 bp, Homo sapiens
  misc_feature: GYAE6OF02JBG3V.31.78.H01.1.454.CMB.1.raw
  modified_base (311)..(311): a, c, t, g, unknown or other
  misc_feature (311)..(311): n is a, c, g, or t
  modified_base (325)..(325): a, c, t, g, unknown or other
  misc_feature (325)..(325): n is a, c, g, or t
  modified_base (401)..(401): a, c, t, g, unknown or other
  misc_feature (401)..(401): n is a, c, g, or t
  modified_base (580)..(580): a, c, t, g, unknown or other
  misc_feature (580)..(580): n is a, c, g, or t
tcagcagtagacgtcacgaccggtgctcgatttagtgtgagtagtttgggtttgggggatctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacactacttagcttggtaccagcaagaaagtaggacagcctactaaactcctgatttacnggcttcacccgggnagtccgggtctaacgattcattgcagcggtctgggaccatttcactctcaccatcagcagcctgcaggctaggaancgtgtggctaaggtttataccgtgtacctagcctaaacgtatttaactaacgttttcctttacgtacttaaccgttttcggggaccggtaacggggaaccctaagggttacggagtaactaccggtaaaacgtacgtggtacggtctaggaccctaccgtattccggtagttacccttntaccg

SEQ ID NO: 65036 - DNA, 554 bp, Homo sapiens
  misc_feature: GYAE6OF02IOOMZ.31.78.H01.1.454.CMB.1.raw
  modified_base (310)..(310): a, c, t, g, unknown or other
  misc_feature (310)..(310): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgtttattggccccacaataacaactacttagcttggtaccagcagaaagtaggacagcctcctaaactcctgatttacngggcttctacccgggcactccggggttcctaaccgattcattggcagcgggtctgggaccgatttcactctcaccatcagcagcctgcaggctgaagatgtggctagtttattacgtgtacagcaacattatactttctttcgtctacgtttcggcgggtacggtaaccgaagggttggagtactaccgaaaacgtaacgtggtaggcgtagacctaaccctagttccgtggttccttactacg

SEQ ID NO: 65037 - DNA, 583 bp, Homo sapiens
  misc_feature: GYAE6OF02HKVPY.31.78.H01.1.454.CMB.1.raw
  modified_base (334)..(334): a, c, t, g, unknown or other
  misc_feature (334)..(334): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctacctaaactcctagtatttacgtgggcttcgtacccggggtntacgttcccggggttacctaaccggtattcattggcaggcgggtctggggaccctatttcactctcaccatcagcagcctgcaggctagaacgtagtggtggtactaagtttattacttcgtacagacaactattactactttctttcgtactacgtttcgggacggtaggaaccgtaagggtggagtaacgtacgaaacggtacttggtacggcgttggactaccgtattccgtcgttccttctaccg

SEQ ID NO: 65038 - DNA, 553 bp, Homo sapiens
  misc_feature: GYAE6OF02JIQE6.31.78.H01.1.454.CMB.1.raw
  modified_base (419)..(419): a, c, t, g, unknown or other
  misc_feature (419)..(419): n is a, c, g, or t
tcagcagtagacgtcacgaccggtgctcgatttagtgtgagtagtttgggtttgggggtaggcgtacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccaccaataacaactacttagcttggtaccagcagaaagtaggacagcctcctaaactcctagactttactgggtcttctacccggggcactccggggttcctaaccgattcattggcagtcgggtctgggaccatttcactctcaccatcagcagcctgcagctgaagatgngctagtttatactgtcagtcaactattactacttctttcgactactttcgggacggtacgggtaccaagggttgagtactacaaacggtaacttggtacggcttaggcctaaccgattcgtagttcttctaccg

SEQ ID NO: 65039 - DNA, 529 bp, Homo sapiens
  misc_feature: GYAE6OF02FI6NY.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctacctaaactcctgatttactgggcctttctacccgggcagtccggggttcctaaccgattcattggcagcgggtctggggaccatttcactctcaccatcagcagcctgcaggctgaagatgtggctaggtttattactgtacagcaactatttactactttcttttcgtctacgtttcggcggagggaccaaggtgagatacaaacgactgtggtctgacaccatctgtcttctac

SEQ ID NO: 65040 - DNA, 531 bp, Homo sapiens
  misc_feature: GYAE6OF02I0HWF.31.78.H01.1.454.CMB.1.raw
  modified_base (312)..(312): a, c, t, g, unknown or other
  misc_feature (312)..(312): n is a, c, g, or t
  modified_base (414)..(414): a, c, t, g, unknown or other
  misc_feature (414)..(414): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactactagcttagtaccagcagaaagtaggacagcctacctaaactcctgatttacgngggcttctacccgggcacgtccgggttacctaaccgattcattggacagcgggtctgggaccgtatttcactctcaccatcagcagctgcagctgagagtgngctagttattactgtcagtcaactattatactttctttacgtctacgtttcggcggtacggaccaaggtgagtatacgaaacgtactggtagctagcaccgatcgtagtctataccg

SEQ ID NO: 65041 - DNA, 604 bp, Homo sapiens
  misc_feature: GYAE6OF02IUOW7.31.78.H01.1.454.CMB.1.raw
  modified_base (309)..(309): a, c, t, g, unknown or other
  misc_feature (309)..(309): n is a, c, g, or t
  modified_base (325)..(325): a, c, t, g, unknown or other
  misc_feature (325)..(325): n is a, c, g, or t
  modified_base (342)..(342): a, c, t, g, unknown or other
  misc_feature (342)..(342): n is a, c, g, or t
  modified_base (372)..(372): a, c, t, g, unknown or other
  misc_feature (372)..(372): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactactagcttggtaccagcagaaagtggacagcctctaaactcctagatttacngggcttctacccgggnatccgggttcctaacgnttcattggcagccgggtactgggacccgtntttcacttctcaccatcagcagcctgcaggctgaagtactgtcggcagtttatacctgttccaagccaactatttattacctttcgttttaccgtactacgtttttcggggacggtaacgggtaacccgtaagggttcgggacgtaacgttaccgaaaaaccgggtaccttagggttcgggaccttagggtacccaacccgtaattccgttacggtttcctttacgtaaccg

SEQ ID NO: 65042 - DNA, 642 bp, Homo sapiens
  misc_feature: GYAE6OF02JV1SE.31.78.H01.1.454.CMB.1.raw
  modified_base (522)..(522): a, c, t, g, unknown or other
  misc_feature (522)..(522): n is a, c, g, or t
tcagcagtagacgtcacgaccggtgctcgatttagtgtgagtagtttgggtttgggggtaggcgtacaacaggcaggcaggggcgagcaagatggtgttgcagacccaggtcttcatttctctgttgctctggatctctggtgcctacggggacatcgtgatgagccagtttccagactccctggctgtgtctctgggcgagagggccacatcaactgcaagtccagccagagttgttttattcgaccccacaataacaactacttagcttggtaccagcagaaagtggacagcctacctaaactccctgtaactttacgtgggtccttaccgtaaccccggggctaacgttcccgggggtttacccttaaacccggtactttcaacgtttcggactacgggtccgggttaccttgggggaaccccgttattttccgaccgttctccaaccctagtcccaggcccaggtccctacgccgaggccgtagaaacgtagtgtacggctacggtttattactgtcncgtacaactatttataccttctttcgtactacgtttcggcggtacggaaccgagtcggagtactacgaaacggtaactggtacggtactcggactaccgtaattcgttcgtacttactac

SEQ ID NO: 65043 - DNA, 830 bp, Homo sapiens
  misc_feature: GYAE6OF02HIFH6.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacaactacttagcttaggtaccagcagaaagtaggacagcctacctaaactcctagtactttacgtcgggtcttccgtacccgggcaacggttcccgggggtttaccctaaaccggtatttaccgacgtttcgggacctacgggtccggggttaccgttacgggggtaacccgtaacgtttttccgaaccttccgttacccaaacccgtactaccgtaacggaccgtaacgtcccgtacggtaccgtaacggggtaccttagggaaaggttaacgttcgggttacgggtaccgttaagggtttttaactttaaccgttcggttaaccaaacgggtacctaaaaccgttaacgtttttaaacctttaaccgtttttcccgtttttaccggtttacccgtttaacccggtttttccggggtaacccggggtaaacggggttaaaccccgtaaagggggtttacgggtaacggttaacgttaacccggtaaaaaccggttaaccgttcgggtaacgggttacccgtacggtacccgtaacccgtaacgtttccgttacggtttaccctttaccgtaacccg

SEQ ID NO: 65044 - DNA, 521 bp, Homo sapiens
  misc_feature: GYAE6OF02GPR7A.31.78.H01.1.454.CMB.1.raw
  modified_base (514)..(514): a, c, t, g, unknown or other
  misc_feature (514)..(514): n is a, c, g, or t
  modified_base (518)..(518): a, c, t, g, unknown or other
  misc_feature (518)..(518): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttactgggcttctacccgggcatccggggttcctaaccgattcattggcagcgggtctgggaccgatttcactctcaccatcagcagcctgcaggctgaagatgtggctagtttatactgtcagcaactatttatactttctttcgtctacgtttcgggcggagggaccaaggtggagtatacgaaacgaactggtgctgcacatctntctntac

SEQ ID NO: 65045 - DNA, 695 bp, Homo sapiens
  misc_feature: GYAE6OF02JDBDI.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctctgggcgagagggcccaccatcaactgcaagtccagccagagttgttttattcggccccaacaataacaactactagcttggtaccagcaagaaagtaggacagccctacctaaactcctagtacttacgtcgggtacttccgtacccgggctacgtcccgggttacctaaccgattcctattcggcacggcgggtacgttcgggaccgtatttaccactcctcaccactcagaccagtccctgacgacgctagaaacgtagtgtacgggtacttaaggtttaactttaccgtgtaccgaagtaactaaaccgttaatttaacgttaacccttttccgttttaccgttaccgtaacccggttttccgggaccgggtaacggggtaaaccctaaggggtacgggtacgtaagtaaccggtaaaacggtaacccggttaggtacgggttacctaggtaaccctaacccgtagttacccggttaggtttacccgtttaccttacccgg

SEQ ID NO: 65046 - DNA, 530 bp, Homo sapiens
  misc_feature: GYAE6OF02G88WI.31.78.H01.1.454.CMB.1.raw
  modified_base (413)..(413): a, c, t, g, unknown or other
  misc_feature (413)..(413): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctagatttactgggcttctacccgggcagtccggggttcctaaccgattcattggcagcgggtctgggaccgatttcactctcaccatcagcagcctgcaggctgaagatgngctagtttatactgtcagcaactattactactttctttcgtctacgttttcggcggtacggacctaagggtcgagatacgaaacgtaactgtggctgacacctatctgttctctacg

SEQ ID NO: 65047 - DNA, 527 bp, Homo sapiens
  misc_feature: GYAE6OF02HC095.31.78.H01.1.454.CMB.1.raw
  modified_base (311)..(311): a, c, t, g, unknown or other
  misc_feature (311)..(311): n is a, c, g, or t
  modified_base (524)..(524): a, c, t, g, unknown or other
  misc_feature (524)..(524): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttacngggcttcgtacccgggcagtcccggggttcctaaccgattcattggcagcgggtctgggaccatttcactctcaccatcagcagcctgcaggctagaagatgtggctagtttattactgtacagcaactattactactttctttcgtctacgtttcgggcggaggaccaagggtggagagtacgaaacgactggtagctgacacatctgtctntac

SEQ ID NO: 65048 - DNA, 586 bp, Homo sapiens
  misc_feature: GYAE6OF02FYE02.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccaccaataacaactacttagcttggtaccagcagaaagtaggacagcctacctaaactcctgactttactgggctttctaccccggggcacgttcccggggttcctaaccgattcattggcagcgggtctgggaccgtatttcactctcaccatcagcagcctgcaggctgaagatgtgctagtttatacgtgtcagacaactatttatacctttcttttaccgtccttacgtttcgggaccggtaacgggtacctaaggggtggacgtaactaccgaaaacggtaacgttggtacggtactcggacctaccgtaagttcctacggttaccttccgtaccg

SEQ ID NO: 65049 - DNA, 533 bp, Homo sapiens
  misc_feature: GYAE6OF02HA6SL.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttactgggcttctacccgggcagtccgggttcctaaccgattcattggcaggcgggtctggggaccatttcactctcaccatcagcagcctgcaggctgaagatgtggctagttttatactgtctagctaacatttatactttctttcgtctacgtttcggcggtagggaccaagggtgagtatacgaaacgtaactggtaggctgactaccattcctgtccttgac

SEQ ID NO: 65050 - DNA, 693 bp, Homo sapiens
  misc_feature: GYAE6OF02GHJ82.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagacctccctggctgtgtctcgtgggcgagacgggccaccatcaactgcaagtccagccagtagttgttttattcggccccacaataacaactacttagcttggtaccagcaagaaagtaggacagccctacctaaactcctagtactttacgtgggtcctttccgtacccgggctacgttccccggggttaccctaaaccgtattcgtaacgtttggaccagggtccggggtacgttacggggacccgtagttttcccacgtttccctacctacccagttccaacgtccaacgtcccgtgaccgagggtcgtaggaacgtagtggtacggtcttaaggtttacttacgttgttacacgtacctaacgttactttacttacctttaccgttttccgtccttaccgttttaccgggacggtaacgggtaaccgtaagggtaggtacgtacgtacgaaaacggtacgttcgggtacggtacgtacggacctacccgtacgttccgttacgttccttacctaccg

SEQ ID NO: 65051 - DNA, 526 bp, Homo sapiens
  misc_feature: GYAE6OF02HXYVJ.31.78.H01.1.454.CMB.1.raw
  modified_base (348)..(348): a, c, t, g, unknown or other
  misc_feature (348)..(348): n is a, c, g, or t
  modified_base (366)..(366): a, c, t, g, unknown or other
  misc_feature (366)..(366): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggacaccatcaactgcaagtccagccagagtgttttattggccccacaataacaactacttagcttggtaccagcagaaagtaggacagccctcctaaactcctgatttactggtcttctacccgggcacgtccgggttcctaaccgnttcattggcaggcgggtntgggaccgtatttcgactctcaccatcagcagctgcaggctagaagatgtggctaagtttacttactgtacagacaactattactactttctttcgtctacgtttcgcgggagaccaaggtgagatacgaaagactgtgctgcaccattctctcttctac

SEQ ID NO: 65052 - DNA, 520 bp, Homo sapiens
  misc_feature: GYAE6OF02FY1DQ.31.78.H01.1.454.CMB.1.raw
  modified_base (509)..(509): a, c, t, g, unknown or other
  misc_feature (509)..(509): n is a, c, g, or t
  modified_base (517)..(517): a, c, t, g, unknown or other
  misc_feature (517)..(517): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccaccaataacaactacttagcttggtaccagcagaaagtaggacagcctcctaaactcctgatttactgggcttctacccgggcacgtccggggttcctaaccgattcattggcagcgggtctgggaccgatttcactctcaccatcagcagcctgcaggctgaagatgtggctagtttatactgtcagcaacattatactttctttcgtctactttcggcggacgggaccaaggtggagatacgaaacgactggtgctgcaccntctgtctntac

SEQ ID NO: 65053 - DNA, 595 bp, Homo sapiens
  misc_feature: GYAE6OF02IZ3Y2.31.78.H01.1.454.CMB.1.raw
  modified_base (317)..(317): a, c, t, g, unknown or other
  misc_feature (317)..(317): n is a, c, g, or t
  modified_base (334)..(334): a, c, t, g, unknown or other
  misc_feature (334)..(334): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagttgttttattcggccccacaataacaactacttagcttggtaccagccaagaaagtaggacagcctactaaactcctgatttacgngggcttcgtacccgggnacgttccggggttacctaacgattcgattggcaggtcgggtctcggggacctatttcactctcaccatcagcagcctgcagctagaagagtgtaggctagtttattacgtgtacagactaactattattacttctttcgtacttacgtttcggacgggtacggtaccgtaagggtcggagtagtaacgtaaaccggtaacgttcgggtacggtacgtacggaccgtaacctacgttcgtcgtttaccgttaccgttaaccg

SEQ ID NO: 65054 - DNA, 607 bp, Homo sapiens
  misc_feature: GYAE6OF02IOUBW.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagacctccctggctgtgtctcgtgggcgaggagggccaccatcaactgcaagtccagccagagttgttttattcggccccaacaataacaactacttagcttaggtaccagcaagaaagtaggacagcctactaaactcctagtactttacgtgggtccttcgtacccgggctacggttcccggggttacctaaccggtattccgagttcggacacggtccgggtcgtaggggtaccctatttccactctaccacctactcacgcacgtcctagcaggctagaagtagtggtggtacttagtttacttacgtgtactagactaacttattacttactttctttcgtactacgtttcggcgggtaaggaccgtagggtacgagtactacgaaacgtacgtggtcgacgtgaccacgtatcgtacgttccttactacg

SEQ ID NO: 65055 - DNA, 585 bp, Homo sapiens
  misc_feature: GYAE6OF02HNEV4.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggccccacaataacaactacttagcttggtaccagcagaaagtagacagcctcctaaactcctgactttactgggtcctttcgtaccccgggctaacgttcccgggggtttaccctaaaccgtacttccagtttcggcctaagggtccgggttcgtcggggacccgtattttccacttcctcaccatcagcagccctgccagggctaggaagtagtgtggctaggtttattacgtgtcagtcaacgtatttatactttctttcgtctacgtttcggcggtacggacctagggtggagacgtacgaaacgtacgtggtaggctggcctacagtctcgttctctac

SEQ ID NO: 65056 - DNA, 574 bp, Homo sapiens
  misc_feature: GYAE6OF02GD5JA.31.78.H01.1.454.CMB.1.raw
  modified_base (313)..(313): a, c, t, g, unknown or other
  misc_feature (313)..(313): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggccccacaataacaactacttagcttggtaccagcaagaaagtaggacagcctctaaactcctgatttacngggcttctacccgggcagtcccggggttcctaaccgtattcatttggcaggcgggtctggggaccatttccactctcaccatcagcacgcctgcaggctagaacgatgtggctagtttattactgtcagtcaactatttactactttctttcgtactaccgttttcgggacggtacgggtacctaaggggtggtagagtaccgtaaaacggaacttcggtacggtactggacctaccgtattccgtcgttaccttctaccg

SEQ ID NO: 65057 - DNA, 560 bp, Homo sapiens
  misc_feature: GYAE6OF02IWL6D.31.78.H01.1.454.CMB.1.raw
  modified_base (313)..(313): a, c, t, g, unknown or other
  misc_feature (313)..(313): n is a, c, g, or t
  modified_base (555)..(555): a, c, t, g, unknown or other
  misc_feature (555)..(555): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacgggggacatcgtgatgagccagtttccagactccctggctgtgtctctgggcgagagggccaccatcaactgcaagtccagccagagtgttttattcggccccaccaataacaactacttagcttggtaccagcagaagtaggacagcctcctaaactcctgatttacngggtcttcctacccgggcacgttccggggttcctaaccgattcagttcggcaggcgggtctgggaccgatttcactctcaccatcagcagcctgcaggctgaagatgtggctagtttatacgtgtcgagaccaactattattacctttcgtttctctacgtttcgggacggacggaaccgaagggtggagactacgaaacgtaacttggtcggtactagaccacctagtccgtagttccttntaacg

SEQ ID NO: 65058 - DNA, 522 bp, Homo sapiens
  misc_feature: GYAE6OF02GYZ4T.31.78.H01.1.454.CMB.1.raw
  modified_base (519)..(519): a, c, t, g, unknown or other
  misc_feature (519)..(519): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactcgcaagtccagccagagtgttttattggccccacaataacaactacttagcttggtaccagcagaaagtaggacagcctcctaaactcctgatttactgggcttcgtacccgggcacgtccggggttcctaaccgattcattggcaggcgggtctgggacctatttcactctcacatcagcagcctgcaggctagaagatgtgctagtttattactgtcagcaactattatactttctttcgtctacgtttcggcggacggaccaggtgagatacgaaacgactggtgctgacaccatctgtctntac

SEQ ID NO: 65059 - DNA, 612 bp, Homo sapiens
  misc_feature: GYAE6OF02IBT2E.31.78.H01.1.454.CMB.1.raw
  modified_base (343)..(343): a, c, t, g, unknown or other
  misc_feature (343)..(343): n is a, c, g, or t
  modified_base (370)..(370): a, c, t, g, unknown or other
  misc_feature (370)..(370): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggcccaccatcaactgcaagtccagccagagttgttttattcggcccccaacaataaccaacttacttagcttggtaccagcaagaaagtaggacacgcctacctaaactcctagtactttacgtggccttcgaccccgggnacggttccccgggtttaccaaaccgtnttccgattcggacaggcgggtctacggggaccctatttccacctctccaaccatcacgccacgtccctgcgacggtctaggaacgtatcggtggtactaagttttactacgtgtacacgtactaactatttactacctttcgtttcgtctaccgtttcgggacggaggtaccaagggtcgacgtaactacgaaacgtacgttggcggtctacggccaacgtattccgtgttcctacttaccg

SEQ ID NO: 65060 - DNA, 702 bp, Homo sapiens
  misc_feature: GYAE6OF02HS4WD.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattggccccacaataacaactacttagcttggtaccagcagaaagtaggacacgcctacctaaactcctagtatttactgggtcctttccgtacccgggctacgtcccggggtttaccctaaaccgtattccaatttcggacctaggccgggttctcggggacccgtattttccacgttctccaacctatccagccacgtccctagaccgaggcgtagaacgtagttcggtaggtctaaggttttaactttacgtgttaccagtacctaaaccttatttaacttaccttttccgtttaccgtccgtttaaccgttttcggggacccgggtaagggtaaacccgttaagggtacgggtaacggtaccttaaccgaaaaacggtaaccgttacgggtacggtacccgttagggaaccccttaaccgtaacgtttaccgttacgtttacccgtttaccgttaaccccg

SEQ ID NO: 65061 - DNA, 761 bp, Homo sapiens
  misc_feature: GYAE6OF02JODKM.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagttccagcctccgtggctgtgtctcgtaggcgaggacgggccaccatcaactgacaagtccagccagtagttgttttattcggaccccaacaaataacactacttagtcttaggaccagacaagaaagtaggacacgtcctaacctaactcctagtaactttaccgtcggtccttaccgtacccgggactacggttcccgggttaccctaaacggtacttcgtagttcggctaacgggtccgggtacgtacggggacccttactttccgacttccgtacctaacccgtagtaccacggacctacggtccctaggccgtaacgggtctagggtaaatacggttcgggtacggtacttaacggtttttaacttacgttacgtacgtaacgtaaccgttaaacttaagtttaacctttacccgttttaccgttttacccgtaccgtttaccggttttaccggggaaccggggtaaccggtaaccggttaagggtacgggtaacgtaacgttaaacccggaaacggtaacgttggtaaccggtccttacggaccgttaaccgtacgttaccgtttaccggttaccttaacccgttacccg

SEQ ID NO: 65062 - DNA, 840 bp, Homo sapiens
  misc_feature: GYAE6OF02IHG7W.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaaactcctagtatttactgggactttccgtaaccccggggctaacgttcccgggggtttaccctaaacccggtattttccgaagttttcgggacctagggtccgggggttccttggggggaaccccgtaatttttccgaaccgtttccttacccaaacccctattccgaaacggtcctaacggtccccttaggacccgtaaggggtaccctttagggaaaaacggaagtttcgggttacggggacccttaaagggtttttttaaactttaaccgttggttacccgtaaggtaccctaaaacgttaactttttaaacgtttaaaccttttttccgttttttaccgtttaccgttaacccggttttttcccggggaccggggtaaaccgggggtaaaccctaaaagggggtttcgggaaacgggttaacgtttaacccggaaaaaaaccgggttaaccgtttaggggttaccgggtaccgttacgggtacccgtaaaccccgttaacgttacccgtttacgggtttacccctttaccgttaacccg

SEQ ID NO: 65063 - DNA, 587 bp, Homo sapiens
  misc_feature: GYAE6OF02HL11A.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgacaagtccagccagagtgttttattcggccccacaataacaactacttagcttaggtaccagcaagaaagtaggacagcctacctaaactcctgatttacgtgggtccttacgtacccgggcacgttcccggggttacctaaccgtattcagttcggcaggcgggtctggggacctattttcactctcaccatcagcacgcctgcaggctagaagagtggtggactagtttacttactgtacagacaatattacttacttctttcgtactacgtttcggacgggtacgggtaaccgtaagggtaggagtacgtaaccgaaacgtaacgtgtacggtcgtgacctacctacttaccgtcgttaccttactacc

SEQ ID NO: 65064 - DNA, 553 bp, Homo sapiens
  misc_feature: GYAE6OF02IWEE9.31.78.H01.1.454.CMB.1.raw
  modified_base (442)..(442): a, c, t, g, unknown or other
  misc_feature (442)..(442): n is a, c, g, or t
  modified_base (548)..(548): a, c, t, g, unknown or other
  misc_feature (548)..(548): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagtcagtttccagactccctggctgtgtctctgggcgagagggccaccatcaactgcaagtccagccagagtgttttattcggccccacaataacaactactagcttggtaccagcagaaagtaggacagcctacctaaactcctgatttactgggcttctacccgggcagtccggggttcctaaccgattcattcggcagcgggtctgggaccgtatttcactctcaccatcagcagcctgcaggctagaagatgtggactagtttatactgtcagcaactnttactactttctttcgtctacgtttcggcgggtaaggaccgtaagggtggagtaataccgaaaacgtactggtcggtactggaccaccgtattactcgttaccttntaccg

SEQ ID NO: 65065 - DNA, 582 bp, Homo sapiens
  misc_feature: GYAE6OF02JJITF.31.78.H01.1.454.CMB.1.raw
  modified_base (267)..(267): a, c, t, g, unknown or other
  misc_feature (267)..(267): n is a, c, g, or t
  modified_base (315)..(315): a, c, t, g, unknown or other
  misc_feature (315)..(315): n is a, c, g, or t
  modified_base (331)..(331): a, c, t, g, unknown or other
  misc_feature (331)..(331): n is a, c, g, or t
  modified_base (349)..(349): a, c, t, g, unknown or other
  misc_feature (349)..(349): n is a, c, g, or t
  modified_base (374)..(374): a, c, t, g, unknown or other
  misc_feature (374)..(374): n is a, c, g, or t
tcagcagtagacgtcacgaccggtgctcgatttagtgtgagtagtttgggtttgggggtaggcgtacaacaggcaggcaggggcgagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttancttggtacccagcagaaagtaggacagcctctaaactcctgatttacngggcttctacccgggnatccggggttccaaccgnttcattggcagtcggtctgggaccntttcactctcaccatccagtccagcctgcacggctgaagatgtcggctaggtttactatcgtcagaccaatacttatacctttacttttccgtactaccgttttcgggccgggtaacgggtaccctaagggtggtacgaagtccgtaaaacgaaccgttggtacgggtacttcggacctaaccgtatccgtttgttcccttactaacg

SEQ ID NO: 65066 - DNA, 572 bp, Homo sapiens
  misc_feature: GYAE6OF02FXK0K.31.78.H01.1.454.CMB.1.raw
  modified_base (417)..(417): a, c, t, g, unknown or other
  misc_feature (417)..(417): n is a, c, g, or t
  modified_base (449)..(449): a, c, t, g, unknown or other
  misc_feature (449)..(449): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcagtttccagactccctggctgtgtctctgggcgagagggccaccatcaactgcaagtccagccagacgttgttttattcggccccaccaataacaactacttagcttggtaccagcagaaagtaggactagcctcctaaactcctgatttacgtggcttctaccccgggcactcccggggttcctaaccgattcattggcagcgggtctgggaccgtatttcactctcaccatcagcagcctgcaggtctgaagntgtggctagtttactacttggtcagtcaactntttaactactttctttacgtctacgtttcgggaccgtagggaacccaagggtggagtagtaccgaaacggtaacctgggtaggccttggacctacgtactccgtttcgttaccttacgtaccg

SEQ ID NO: 65067 - DNA, 558 bp, Homo sapiens
  misc_feature: GYAE6OF02FLX8N.31.78.H01.1.454.CMB.1.raw
  modified_base (417)..(417): a, c, t, g, unknown or other
  misc_feature (417)..(417): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacaactacttagcttggtaccagcagaaagtaggacagcctacctaaactcctagatttactgggtcttctaccccgggcacgttcccggggttcctaaccgattcattggcagcgggtctggggaccatttcactctcaccatcagcagcctgcaggctgaagntgtggctagtttattactgtcagctaactattatactttctttcgtcctacgttttcgggcggtacgggacctaagggtggtagactacgtaaacgaacgttggtacggtctacgactaccgtatcctcgttcttctaccg

SEQ ID NO: 65068 - DNA, 586 bp, Homo sapiens
  misc_feature: GYAE6OF02G1D80.31.78.H01.1.454.CMB.1.raw
  modified_base (313)..(313): a, c, t, g, unknown or other
  misc_feature (313)..(313): n is a, c, g, or t
  modified_base (329)..(329): a, c, t, g, unknown or other
  misc_feature (329)..(329): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggcccaccaataacaactacttagcttggtaccagcagaaagtaggacagcctacctaaactcctgatttacngggcttctacccgggnacgtccgggttacctaacgattcattcggcagcgggtctgggacccgtatttccactctccaccatccagctacgcctgcaggctagaagagtgtacggactaggtttacttacgtgtcagactaactaagttacttacctttcgtttccgtacttaccgtttcgggacggtaggaaccgaaggtcggagtattaccggaaaacgtaacgttggtacggtctcggacctacctacgttctacggttccttacgtaac

SEQ ID NO: 65069 - DNA, 556 bp, Homo sapiens
  misc_feature: GYAE6OF02IVYP0.31.78.H01.1.454.CMB.1.raw
  modified_base (553)..(553): a, c, t, g, unknown or other
  misc_feature (553)..(553): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggcccccaacaataacaactacttagcttggtaccagcaagaaagtaggacagcctacctaaactcctgtactttacgtgggtcttccgtacccgggctacgttcccggggttacctaaccgtattcattcggcaggcgggtctcgggacctatttcacttctacaccatcagcacgcctgcaggctagaagatggtggactagtttattactgtcagacaactattactactttctttcgtctacgttcggcggtaggacgaaggtgagactacgaaacgtacgtggtcgctagacactatctacgtcttntac

SEQ ID NO: 65070 - DNA, 551 bp, Homo sapiens
  misc_feature: GYAE6OF02JDM5T.31.78.H01.1.454.CMB.1.raw
  modified_base (420)..(420): a, c, t, g, unknown or other
  misc_feature (420)..(420): n is a, c, g, or t
  modified_base (547)..(547): a, c, t, g, unknown or other
  misc_feature (547)..(547): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggccccaccaataacaactacttagcttggtaccagcagaaagtaggacagcctcctaaactcctgatttacgtgggcttcgtacccgggctacgtccggggttacctaaccgattcattggcagcgggtctgggaccgatttcactctcaccatcagcagcctgcaggctgaagatgngctagtttatactgtcagcaactattatacttcgtttacgtctacgtttcgggacggtacggtaccaagggtcgagtatacgtaaacgtaacgtgtacggtactcgacaccgtatcgttagtccttntacg

SEQ ID NO: 65071 - DNA, 525 bp, Homo sapiens
  misc_feature: GYAE6OF02IQFC7.31.78.H01.1.454.CMB.1.raw
  modified_base (415)..(415): a, c, t, g, unknown or other
  misc_feature (415)..(415): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttactgggcttcgtacccgggcagttcccggggttacctaaccgattcattggcagcgggtctgggacctatttccactctacaccatcagcagcctgcaggctgaacntgtgctagtttactactgtcagcaatattatacttcttcgtctacgtttcgcggaggaccgtaggtgatatcgaaagtactggtcgacgtgcactactctgtcttctacg

SEQ ID NO: 65072 - DNA, 573 bp, Homo sapiens
  misc_feature: GYAE6OF02GQE7H.31.78.H01.1.454.CMB.1.raw
  modified_base (332)..(332): a, c, t, g, unknown or other
  misc_feature (332)..(332): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcaagaaagtaggacagcctacctaaactcctgatttacgtgggccttcgtacccgggntacgtccgggttcctaacgattcattggcaggcgggtctgggacctatttcactctcaccatcagcagcctgcaggctagaagatgtggctagtttattactgtcagcaactattactactttctttcgtctacgtttcgggacggtacgggacctaagggtcggagtacgtaaccgaaaacggtaacgttggtacggcctaggaccctaaccgtagttcccgttagttccttacgtaccg

SEQ ID NO: 65073 - DNA, 663 bp, Homo sapiens
  misc_feature: GYAE6OF02HA06X.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctagtactttacgtgggtccttccgtacccgggctacggttcccggggttacctaacccggtactttacagtttcggactacggtccgggttcgtcggggaacccgtattttccacttcctaccaaccctattccgaacgcctacgccctgaccgaggtccgtaggaaagtacgtggtcggacgttaagtttacttacgttgtcacgtactaactatttacttaccttttacgtttcgttaccttaccgtttcgggacgggtaacggtaccgtaagggtacggacgtacgttaccgaaaacggtaacgttcggtacggtaccgtcgtaccaccgtacgttccgtacgtttccttacttaccg

SEQ ID NO: 65074 - DNA, 626 bp, Homo sapiens
  misc_feature: GYAE6OF02IT9W4.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggccccacaataacaactacttagcttggtaccagcaagaaagtaggacagcctacctaaactcctagtactttactgggccttccgtaccccgggctaacgttccccgggggtttacctaaaccggtattccaagtttcgggcctaacggtccgggtctcggggaacccgtattttcgaaccttctaccaaccatccagcacgccctgcgaggctagaaagactggtaggtctaaggtttattacgtagtacgagtacaactatttactactttctttacgtacttacgtttcgggacggtacggaaccgtaagggtacgagtactacgaaaacgtaccgttggtacggtctacgaccaacctagttctcgttacttctaaccg

SEQ ID NO: 65075 - DNA, 517 bp, Homo sapiens
  misc_feature: GYAE6OF02H3283.31.78.H01.1.454.CMB.1.raw
  modified_base (399)..(399): a, c, t, g, unknown or other
  misc_feature (399)..(399): n is a, c, g, or t
  modified_base (437)..(437): a, c, t, g, unknown or other
  misc_feature (437)..(437): n is a, c, g, or t
  modified_base (510)..(510): a, c, t, g, unknown or other
  misc_feature (510)..(510): n is a, c, g, or t
  modified_base (514)..(514): a, c, t, g, unknown or other
  misc_feature (514)..(514): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctacctaaactcctgatttactgggcttctacccgggcatccggggttcctaaccgattcattggcagcgggtctgggaccgattcactctcaccatcagcagcctgcnggctgaagatgtggctagtttattactgtcagcaaacnttaattacttctttcgtctacgtttcggcggaggaccaaggtggagatacgaaacgactgtgctgcacatctntctntac

SEQ ID NO: 65076 - DNA, 848 bp, Homo sapiens
  misc_feature: GYAE6OF02GDGNC.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagtttccagacctccctggctgtgtctcgtgggcgaggacgggccaccatcaactgcaagtccagccagagttgttttattcggccccaacaataacaactacttagcttaggtaccagcaagaaagtaggacagccctacctaaactcctagtactttacgtgggtcctttaccgtaccccgggctaccggttcccggggtttacccctaaaccggtacttactagttcggactacggccggggttcgtacgggggaacccttacgttttccaaccgttcctaccctaacccgtaactcccgtaacgccgtaacggtccccgttacggaccgtaacgggtacccgttagggtaaaacgtaacggttcgggttacgggtaccgtttaagggttttttaactttaacgtttacggttaccgaacggtaacctaaaccgttaaacttttaaccgtttaaccgttttttcccgttttaccggtttacccgtttaacccgggtttttaccgggggtaaccggggtaaaccggggtaaacccggtaagggggttaacggggtacggttaacgtaacccggtaaaaaccgggttaaaccgttacggggtttaccggggtaacccgttacggtacccgtaaccccgttaacgtttcccgtttaccggttttaccctttaccggttaacccc

SEQ ID NO: 65077 - DNA, 527 bp, Homo sapiens
  misc_feature: GYAE6OF02GQ14L.31.78.H01.1.454.CMB.1.raw
  modified_base (524)..(524): a, c, t, g, unknown or other
  misc_feature (524)..(524): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgtttattggccccacaataacaactacttagcttaggtaccagcaagaaagtaggacagcctacctaaactcctagactttactgggcttcgacccgggcagtccggggttacctaaccgattcattggcagcgggtctgggaccgtatttcactctcaccatcagcagctgcgagctagaagatggtgctagtttatactgtcagacaactattattacttctttcgtctactttcgggcggtaggacgaaggtgagatacgaaacgaactgtacgctgacacatctgtctntac

SEQ ID NO: 65078 - DNA, 615 bp, Homo sapiens
  misc_feature: GYAE6OF02IB9XK.31.78.H01.1.454.CMB.1.raw
  modified_base (280)..(280): a, c, t, g, unknown or other
  misc_feature (280)..(280): n is a, c, g, or t
  modified_base (338)..(338): a, c, t, g, unknown or other
  misc_feature (338)..(338): n is a, c, g, or t
  modified_base (466)..(466): a, c, t, g, unknown or other
  misc_feature (466)..(466): n is a, c, g, or t
  modified_base (479)..(479): a, c, t, g, unknown or other
  misc_feature (479)..(479): n is a, c, g, or t
tcagcagtagacgtcacgaccggtgctcgatttagtgtgagtagtttgggtttgggggagctacaacaggcaggcaggggcagcaagatggtgttgcagacccaggtcttcattttctctgttgctctggatctctggtgcctacggggacatcgtgatgagccagtttccagacctccctggctgtgtctcgtgggcgagagggccaccatcaactgaccaagtccagccagagttgttttattggcccccaacaataacaactattagcttggtaccngcaagaaagtgacagcctacctaaactcctgtatttacgtggtcttaccgacccgggntacgttcccggggttaccaaccgtatttccagttcggctaggccgggttctcggggacctatttcgactctcaccatcgagcacgccctgcgaggctaggaagtatggtggactaggttttactacgngtcagacaaactntttactactttcgtttccgtactacgttttccgggcgggaacggtaaccgtaagggtagacgtaacgttacgaaaaccggtaacgttggacggttcctaggtacctaccgtattaccgttgttcccgttactaccg

SEQ ID NO: 65079 - DNA, 539 bp, Homo sapiens
  misc_feature: GYAE6OF02G0328.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctacctaaactcctgatttactgggcttctacccgggcacgtccggggttcctaaccgattcattggcaggcgggtctgggaccgtatttcactctcaccatcagcacgcctgcaggctagaagatgtggctagtttatactgtcagcaactattatacttctttcgtctacgtttcggcggaggaccgaagggtgagatacgaaacggtaacttggtggctagacctaccattctcgttccttctacc

SEQ ID NO: 65080 - DNA, 542 bp, Homo sapiens
  misc_feature: GYAE6OF02IAE2W.31.78.H01.1.454.CMB.1.raw
  modified_base (312)..(312): a, c, t, g, unknown or other
  misc_feature (312)..(312): n is a, c, g, or t
  modified_base (441)..(441): a, c, t, g, unknown or other
  misc_feature (441)..(441): n is a, c, g, or t
  modified_base (459)..(459): a, c, t, g, unknown or other
  misc_feature (459)..(459): n is a, c, g, or t
  modified_base (510)..(510): a, c, t, g, unknown or other
  misc_feature (510)..(510): n is a, c, g, or t
  modified_base (519)..(519): a, c, t, g, unknown or other
  misc_feature (519)..(519): n is a, c, g, or t
  modified_base (527)..(527): a, c, t, g, unknown or other
  misc_feature (527)..(527): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcttgatgagcctagtttccagctccctggctgtgtctctgggcgagagggccaccatcaactgcaagtccagccagagtgttttatggccccacaataacaactactagcttggtaccagcagaaaagtagacagcctacctaaactcctgaatttacgnggcttctacccgggctagtccgggttcctaaccgattcattggcagcgggtctgggacatttcactcgtcaccatcaagcagcctgctaggctagaagattgcggctagttaattactgccaagccaanattataaccttcgtttcnctacttcggacgagggaaccaagggttgacgagtacaaaccgaagttacgnggtctcganacccttancgtgtccttgtaacc

SEQ ID NO: 65081 - DNA, 827 bp, Homo sapiens
  misc_feature: GYAE6OF02JHNAJ.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggccccacaataacaactacttagcttggtaccagcagaaagtaggacagcctacctaaactcctagtaactttacgtgggtccttccgtaccccggggctacggtttcccggggttaccctaaacccggtatttaccgaagtttgggaccgaacgggtccggggttaccgttacgggggtaacccgttagttttaccgaccttccttaccaacccgtaacttaccaaggtcccgtaacggtccccgttacggaccgtaacggggtaccgttaacggtaaaacggtacgttacgggttaccggggtacctttaaggtttttaaactttaaccgttacggttaccgaacggtaaccgtaaaccttaagttttaacgttaacctttttacccgtttttaccgttacccgtttaaccggtttttaccggggtaaccggggtaaacggggtaaacccgtaaacgggggtttacgggtaggtaaccgttaacccgtaaaaccggtaaccggttacgggttaccgggtaccgttacggtaaccctaaccgttaacgtttaccggtttacgtttacccgtttacgttaacccg

SEQ ID NO: 65082 - DNA, 696 bp, Homo sapiens
  misc_feature: GYAE6OF02IXQO1.31.78.H01.1.454.CMB.1.raw
  modified_base (61)..(61): a, c, t, g, unknown or other
  misc_feature (61)..(61): n is a, c, g, or t
tcagcagtagacgtcacgaccggtgctcgatttagtgtgagtagtttgggtttgggggganctacaacaggcaggcaggggcgagcaagatggtggttgcagacccgacggtcttcatttctctgttgctctggatctctggtgcctacggggacatcgtgatgagccagtttccagactccctggcttgtctctcctgggcgagagggccacctatcaactgcaagtccagccagtagtgttttattcgggccccacaataacgaactacttagcttaggtacctagcagaagtaggacagacctacctaaacgttcctagtaagtttacctcggggactttccgtacccgggctacgttcccggggtttaccaaaccggtactttccagtttcggccgtaggtccggggtacgttacggggaaccctagttttccgactcctaccgacctagttccgaagcctaacggccttaggactacgggcttaggaaacgtactggtcggactaacggttttattacctggttacaccgtactaaacgtatttaacgttaactttccgttttacgttcgttaccgtttcgggaacgggtaaacggtaaccgtaagggttcggacgtaacgttacggaaaacggtaacgtcgggtacggaccgtagtacccgaacctagttcctacggttcttactacccg

SEQ ID NO: 65083 - DNA, 597 bp, Homo sapiens
  misc_feature: GYAE6OF02H3SLE.31.78.H01.1.454.CMB.1.raw
  modified_base (322)..(322): a, c, t, g, unknown or other
  misc_feature (322)..(322): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctcgtgggcgaggagggccaccatcaactgcaagtccagccagagttgttttattcggacccccaacaataacaactacttagcttggtaccagcagaaagtaggacagcctacctaaactcctgtatttacgngggtccttccgtacccgggctacgttcccggggttacctaaccgtattcagttggccaggtcgggtcgtcggggaccgtactttcacttctaccaccatcagcacgcctgcgaggctaggaacgagtgtggcttagttttacttactgtacagacaactattatactttctttcgtctacgtttcggacgggacggaccgtaaggtggagtactacgaaacggtaacgttggtacggtcgtagacctaaccgtattccgtacgttcttcctaccg

SEQ ID NO: 65084 - DNA, 678 bp, Homo sapiens
  misc_feature: GYAE6OF02JO81H.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacaactactagcttggtaccagcaagaaagtaggacagcctacctaaactcctagtatttaccgtgggcctttaccgtaccccgggcaacgttcccgggggttacctaaccggtatttccaagttcggaccaaggccggggttactagggggacccgtacttttcgaacttcctcctaaccctattccgaagtccacgtaccctggccaagggtccttaggaaacgtagttggtacggtaccgtaaggttttaacttacgttgtaccaaggtacctaaacgtatttacgttacctttcgtttcgtaccttaacgtttcgggacgggtaacgggtaacccgtaagggtggtacgtagtaaccgaaaacgtacggtacggtacggtacttacggaccacgtaacgttcgttacgttacttacctaccg

SEQ ID NO: 65085 - DNA, 714 bp, Homo sapiens
  misc_feature: GYAE6OF02H5XDG.31.78.H01.1.454.CMB.1.raw
  modified_base (214)..(214): a, c, t, g, unknown or other
  misc_feature (214)..(214): n is a, c, g, or t
  modified_base (221)..(221): a, c, t, g, unknown or other
  misc_feature (221)..(221): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaacngactacncacgacgagtagttagttttagtccgacccaactaactaactaacttacgtactcgtacgtacacgacaaagtaagacgaacacgtcctaaacctaacctcgtagtttaacttacggtcggttccttacccgggtaccggacttaccgggttacccgggttaacctaacgttctacgtacggtcgacgcgggtcgggttcggtacgggtaacgtttactacctacctctaccacctactacgtacgacaccgtccgtcgaacgggtcgtacgaaagaactggttcggacgtacttttaagttacttacgctaacgactaactaaatttcttaacttttcgttttccgtacgttaacttacccggggttcgggaacgggaacccgtaaaggttacgggagaaacttaccgtaaaaccgtaaacggtcggtttgggtaacccggtactaccgaaccctaacttcgttaccgtttcgtttaccaacgtttaccccg

SEQ ID NO: 65086 - DNA, 535 bp, Homo sapiens
  misc_feature: GYAE6OF02H5QLP.31.78.H01.1.454.CMB.1.raw
  modified_base (328)..(328): a, c, t, g, unknown or other
  misc_feature (328)..(328): n is a, c, g, or t
  modified_base (410)..(410): a, c, t, g, unknown or other
  misc_feature (410)..(410): n is a, c, g, or t
  modified_base (532)..(532): a, c, t, g, unknown or other
  misc_feature (532)..(532): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctacctaaactcctgatttactgggcttctacccgggnacgtccggggttcctaaccgattcattggcagcgggtctgggaccatttcactctcaccatcagcagcctgcaggctgaagntgtggctagtttattactgtcagcaactattattacttctttcgtctacctttcgggcggagggacctaagggtggagactacgaaacgtactggtacggctagcaccattctcgttccttntac

SEQ ID NO: 65087 - DNA, 535 bp, Homo sapiens
  misc_feature: GYAE6OF02H4EUZ.31.78.H01.1.454.CMB.1.raw
  modified_base (418)..(418): a, c, t, g, unknown or other
  misc_feature (418)..(418): n is a, c, g, or t
  modified_base (532)..(532): a, c, t, g, unknown or other
  misc_feature (532)..(532): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggcccccacaataacaactacttagcttggtaccagcagaaagtaggacagcctcctaaactcctgatttactgggcttctacccgggcacgtccggggttcctaaccgattcattggcaggcggtctgggtacgatttcactctcaccatcagcagcctgcaggctgaagatgtcggntagtttattactgtctagacaactattaattactttctttcgttctacgtttcggcggacggaccgaaggtggagatacgaacgtaactggtggctgcacctatcctgtccttntac

SEQ ID NO: 65088 - DNA, 531 bp, Homo sapiens
  misc_feature: GYAE6OF02GOH18.31.78.H01.1.454.CMB.1.raw
  modified_base (375)..(375): a, c, t, g, unknown or other
  misc_feature (375)..(375): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggccccacaataacaactacttagcttggtaccagcagaaagtaggacagcctacctaaactcctgatttactgggcttctacccgggcagtccgggttcctaacgattcagttggcagcgggtctgggaccgntttcactctcaccatcagcacgcctgcgaggctgaagatgtggctagtttatactgtacagcaactattattactttctttcgtctacgtttcgacggtacggaaccgaggtgagatacgaaacgaactgtggtactgacacgatctgttctctac

SEQ ID NO: 65089 - DNA, 567 bp, Homo sapiens
  misc_feature: GYAE6OF02ID97R.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgtttattggccccacaataacaactactagcttggtaccagcagaaagtaggacagcctcctaaactcctagactttactggtcttcgtacccgggcaagtcccggggttacctaaccgtattctattggcctaaggtccgggtcgtcgggacccgtatttaccgactctccaaccctagtccagccagccctagcaggtctagaagactggtggctaagtttacttactgtctagctaacattactactttagttctactacgttcggacggtaggacctaaggtagagtatacgaaacgactaggtcgacgtgaccacagtcctgtcctatacg

SEQ ID NO: 65090 - DNA, 764 bp, Homo sapiens
  misc_feature: GYAE6OF02G4KBR.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactcctggctgtgtctcgtgggcgagagggccaccatcaactgcaagtccagccagagttgttttattcggcccccacaataaccaactacttagcttaggtaccagcaagaaagtaggacagcctactaaactcctagtactttacgtgggtcctttaccgtacccgggctacgttcccggggttaccctaaaccggtattcgaagtttcggacacggtccggggttctacgggggtacccgtaattttccgaaacctttccgtaccgaaaccctaagttacccgaaacggtcccgtaacggtcccttacggaccgaacgggtaccgtaggaaacgtaggttacgggtacgggtacttaaaggtttttaacgttacgttacgtaccgaacgtacctaaacttatttaacgttaaccttttccgttttaccgttaccttaaccggttttccggggaaccggggtaaacgggtaaccggtaacggggttacggaacgtaacgttaaccggtaaaaccggtaacggttacgggtacgaccgttacggaccctaaccgtacgtttaccgtttacggttcccttaaccgtaacccg

SEQ ID NO: 65091 - DNA, 527 bp, Homo sapiens
  misc_feature: GYAE6OF02JED0E.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactactagcttggtaccagcagaaagtaggacagcctacctaaactcctgatttacgtgggcttctacccgggcagtccggggttcctaaccgattcattggcagcgggtctgggaccgatttcactctcaccatcagcagcctgcaggctagaagatgtggctagtttatactgtcagacaactattaatactttctttcgtctacgtttcggcggacggaccaagggtgagatacgaaacgtactggtggctgacacatctcgttctctac

SEQ ID NO: 65092 - DNA, 518 bp, Homo sapiens
  misc_feature: GYAE6OF02HIG5R.31.78.H01.1.454.CMB.1.raw
  modified_base (515)..(515): a, c, t, g, unknown or other
  misc_feature (515)..(515): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctacctaaactcctgatttactgggcttctacccgggcatccggggttcctaaccgattcattggcaggcgggtctgggaccgatttcactctcaccatcagcagcctgcaggctgaagatgtggctagtttatactgtcagcaactattatactttctttcgtctacgtttcggcggaggaccaagggtgagatacgaaacgactggtgctgcacatctgtctntac

SEQ ID NO: 65093 - DNA, 525 bp, Homo sapiens
  misc_feature: GYAE6OF02FM8HU.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttatttggccccaccaataacaactacttagcttggtaccagcagaaagtaggacagcctcctaaactcctgatttactgggcttctacccgggcatccggggttcctaaccgattcattggcagcgggtctgggaccgatttcactctcacccatcagcagcctgcaggctgaagatgtggctagtttattactgtcagcaacatttaatactttctttcgtctacgtttcggcggtaggacctaagggtgagtactcgaaacgactgtggctgcacatctgtcttctac

SEQ ID NO: 65094 - DNA, 562 bp, Homo sapiens
  misc_feature: GYAE6OF02H27ZU.31.78.H01.1.454.CMB.1.raw
  modified_base (265)..(265): a, c, t, g, unknown or other
  misc_feature (265)..(265): n is a, c, g, or t
  modified_base (313)..(313): a, c, t, g, unknown or other
  misc_feature (313)..(313): n is a, c, g, or t
  modified_base (328)..(328): a, c, t, g, unknown or other
  misc_feature (328)..(328): n is a, c, g, or t
  modified_base (369)..(369): a, c, t, g, unknown or other
  misc_feature (369)..(369): n is a, c, g, or t
  modified_base (422)..(422): a, c, t, g, unknown or other
  misc_feature (422)..(422): n is a, c, g, or t
  modified_base (557)..(557): a, c, t, g, unknown or other
  misc_feature (557)..(557): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccctacggggacatcgtgatgagccagtttccagactccctggctgtgtctctgggcagagggccaccatcaactgcaagtccagccagagttgttttattggccccaacaataacaactactagnttggtacagacagaaagtggacagcctacctaaactcctgatttacgnggcttcgacccgggnacgtccggggttcctaaccgatctagttggcaggccgggtntcgggaccgtatttccgatctcaccatcacgcacgcctgcaggctgaagatgnggtctagttattactgtacgagcaactattactactttctcgtctacgtttccggcggaggtaaccgaggtcggagtacgtacgaaaccgtaagtcggtaggtacctgaccgaacctataccgttcgttaccttntaccg

SEQ ID NO: 65095 - DNA, 552 bp, Homo sapiens
  misc_feature: GYAE6OF02G02NT.31.78.H01.1.454.CMB.1.raw
  modified_base (414)..(414): a, c, t, g, unknown or other
  misc_feature (414)..(414): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctacctaaactcctgatttactgggcttccgtacccgggcacgtcccggggttcctaaccgattcattggcagcgggtctgggaccatttcactctcaccatcagcagcctgcaggctagaagntggtggctagtttattactgtcagcaatattattacctttctttcgtctacgtttcgggacgggtacggaaccgtaagggtggagtagtaccgaaaacggtaactggtggcttagaccactattcgtgttccttctac

SEQ ID NO: 65096 - DNA, 532 bp, Homo sapiens
  misc_feature: GYAE6OF02JEA7N.31.78.H01.1.454.CMB.1.raw
  modified_base (312)..(312): a, c, t, g, unknown or other
  misc_feature (312)..(312): n is a, c, g, or t
  modified_base (328)..(328): a, c, t, g, unknown or other
  misc_feature (328)..(328): n is a, c, g, or t
  modified_base (373)..(373): a, c, t, g, unknown or other
  misc_feature (373)..(373): n is a, c, g, or t
  modified_base (438)..(438): a, c, t, g, unknown or other
  misc_feature (438)..(438): n is a, c, g, or t
  modified_base (529)..(529): a, c, t, g, unknown or other
  misc_feature (529)..(529): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctggcgagagggccaccatcaactgcaagtccagccagagtgttttattggccccacaataacaactacttagcttggtaccagcagaaaagtaggacagcctcctaaaactcctgatttacngggcttctacccgggnatccggggttcctaaccgattcattggcagcgggtctgggaccgntttcactctcaccatcagcagcctgcaggctgaagatgtggctagtttattactgtcagcaaacnttactacttctttcgtctacttttcggcggtagggacctaaggtggagagtacgaaacggtaacttggtggctaggcaccatctgtccttntac

SEQ ID NO: 65097 - DNA, 542 bp, Homo sapiens
  misc_feature: GYAE6OF02H2E2Q.31.78.H01.1.454.CMB.1.raw
  modified_base (421)..(421): a, c, t, g, unknown or other
  misc_feature (421)..(421): n is a, c, g, or t
  modified_base (425)..(425): a, c, t, g, unknown or other
  misc_feature (425)..(425): n is a, c, g, or t
  modified_base (452)..(452): a, c, t, g, unknown or other
  misc_feature (452)..(452): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtggacagcctcctaaactcctgattacgtgggtcttccgtacccgggcacgttcccggggtttaccctaaaccggatttccatttggcaggcgggtctggggaccatttcactctcaccatcagcagcctgcagctgaanatgnggctagtttattactgtcagcaaactnttaatactttctttcgtctacgtttcgggcggaggaccagggtgagtactacaaacggactgtggctcgacacacttctagttcttatac

SEQ ID NO: 65098 - DNA, 566 bp, Homo sapiens
  misc_feature: GYAE6OF02GMFTV.31.78.H01.1.454.CMB.1.raw
  modified_base (386)..(386): a, c, t, g, unknown or other
  misc_feature (386)..(386): n is a, c, g, or t
  modified_base (414)..(414): a, c, t, g, unknown or other
  misc_feature (414)..(414): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacaactacttagcttggtaccagcagaaagtaggacagcctacctaaactcctgatttactgggcttcctacccgggcacgtccggggttcctaaccgattcattggcagcgggtctgggaccgatttcactcncaccatcagcagcctgcaggctagaagntgtggctagtttacttactgtcagtcaactatttatactttctttcgtctacgtttcgggacggagggtacccaagggtcggagtagtaccgtaaaacggtaacttggtcggcgttacgacctaaccctattccgtcgttacctttctaccg

SEQ ID NO: 65099 - DNA, 568 bp, Homo sapiens
  misc_feature: GYAE6OF02IQU8Q.31.78.H01.1.454.CMB.1.raw
  modified_base (340)..(340): a, c, t, g, unknown or other
  misc_feature (340)..(340): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggccccaacaataacaactacttagcttggtaccagcagaaagtaggacagcctacctaaactcctagtactttacgtgggtcttccgtaccccggggntacgttccccggggttacctaaccggtattcatttcggcaggtcgggtcgtgggaccgtatttccactctcacctatcagcacgctgcgaggctagaagatgtggctagtttattactgtacagacaactattatactttcttcgtctacgtttcggcggtaacggtaccgaagggtcggagtaactacgaaacgtactggtcgacgtgacactactctgttctctac

SEQ ID NO: 65100 - DNA, 519 bp, Homo sapiens
  misc_feature: GYAE6OF02F6OPK.31.78.H01.1.454.CMB.1.raw
  modified_base (430)..(430): a, c, t, g, unknown or other
  misc_feature (430)..(430): n is a, c, g, or t
  modified_base (507)..(507): a, c, t, g, unknown or other
  misc_feature (507)..(507): n is a, c, g, or t
  modified_base (516)..(516): a, c, t, g, unknown or other
  misc_feature (516)..(516): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacaactacttagcttggtaccagcagaaagtaggacagcctcctaaactcctgatttactgggcttctacccgggcatccggggttcctaacgattcattggcagcgggtctgggaccgatttcactctcaccatcagcagcctgcaggctgaagatggtgctagtttatactgtcancaactattatacttctttcgtctacgtttcggcggtacggaccaggtggagatacgaaacgactggtgctgccactntctgttctntac

SEQ ID NO: 65101 - DNA, 523 bp, Homo sapiens
  misc_feature: GYAE6OF02GLW55.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttactgggcttctacccgggcatccggggttcctaaccgattcattggcagcgggtctgggaccgatttcactctcaccatcagcagcctgcaggctgaagatgtggctagtttattacttgtcagcaactattactactttctttcgtctactttcggcggtaggaccaaggtgagatacgaaacgaacttgtggctgacacctatctgtcttcac

SEQ ID NO: 65102 - DNA, 656 bp, Homo sapiens
  misc_feature: GYAE6OF02I1CQ9.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccaccaataacaactacttagcttggtaccagcagaagtaggacagcctacctaaactcctgatttacgtgggtcttccgtacccgggctaacgttcccgggggttacctaaacccggtactttaccaagtttcggacaggtccggggttcgtacggggacccgtattttccacttctccaccactccaagcacgcccttggaccacgggtcctaggaaacgtagttggtggtacttaaggttttaattcgttagtcaacgtacctaaacgtatttaattaccttttctttccgttacttaccgttttacgggacggtaacgggtaaccgtaaggggttggagtaacgtaaccgtaaacgtaactggtacgtcgtacggacctaaccgtacttcgtacgttaccttcgtacc

SEQ ID NO: 65103 - DNA, 539 bp, Homo sapiens
  misc_feature: GYAE6OF02GCBJD.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacaactacttagcttggtaccagcagaaagtaggacagcctacctaaactcctgatttactgggcttcgtacccgggctacgtcccggggttacctaaccgattcagttggcaggcgggtctgggaccgtatttcactctcaccatcagcagcctgcaggctgaagatgtgctagtttatactgtcagctaatattatactttctttcgtctacgtttcgacggtacggacgaaggtggagactacgtaaacgacttggtggctgaccactatcgtcgttcttctac

SEQ ID NO: 65104 - DNA, 529 bp, Homo sapiens
  misc_feature: GYAE6OF02GHN11.31.78.H01.1.454.CMB.1.raw
  modified_base (346)..(346): a, c, t, g, unknown or other
  misc_feature (346)..(346): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttactgggcttctatccgggcatccggggttcctaaccgnttcattggcagcgggtctgggaccatttcactctcaccatcagcagcctgcaggctgaagatgtggctagtttattactgtacagcaatattattactttctttcgttctacgtttcggcggtagggacctaaggtgaagagtacaaacgtaacgtggtaggcgtagctaccatctgtcttac

SEQ ID NO: 65105 - DNA, 537 bp, Homo sapiens
  misc_feature: GYAE6OF02I1IYX.31.78.H01.1.454.CMB.1.raw
  modified_base (275)..(275): a, c, t, g, unknown or other
  misc_feature (275)..(275): n is a, c, g, or t
  modified_base (495)..(495): a, c, t, g, unknown or other
  misc_feature (495)..(495): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacaactacttagcttggtaccancagaaagtaggacagcctacctaaactcctgatttactgggcttcctacccgggcacgtccggggttcctaaccgattcattggcagcgggtctgggaccgtattcactctcaccatcagcagcctgcaggctgaaagatggtggctaggtttatactgtcagcaactattattactttctttcgtctactttcgggacggtacggaaccgaaggtgganatacgaaacgtaactgtaggctgcacctatctcgttctctac

SEQ ID NO: 65106 - DNA, 519 bp, Homo sapiens
  misc_feature: GYAE6OF02FOIEH.31.78.H01.1.454.CMB.1.raw
  modified_base (481)..(481): a, c, t, g, unknown or other
  misc_feature (481)..(481): n is a, c, g, or t
  modified_base (516)..(516): a, c, t, g, unknown or other
  misc_feature (516)..(516): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccaccaataacaactacttagcttggtaccagcagaaagtaggacagcctacctaaactcctgatttactgggcttctacccgggcacgtccggggttcctaaccgattcattggcagcgggtctgggaccgtatttcactctcaccatcagcagcctgcaggctagaagatgtgctagtttatactgtcagcaactattatacttctttcgtctactttcgacgaggaccaggtganactacgaaacgactggtgctgacactatctgtctntac

SEQ ID NO: 65107 - DNA, 517 bp, Homo sapiens
  misc_feature: GYAE6OF02ICPB1.31.78.H01.1.454.CMB.1.raw
  modified_base (310)..(310): a, c, t, g, unknown or other
  misc_feature (310)..(310): n is a, c, g, or t
  modified_base (326)..(326): a, c, t, g, unknown or other
  misc_feature (326)..(326): n is a, c, g, or t
  modified_base (514)..(514): a, c, t, g, unknown or other
  misc_feature (514)..(514): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctctaaactcctgatttacngggcttctacccgggnatccgggttccaacgatcattggcagcgggtctgggaccgatttcgactctcaccatcagcagcctgcaggctgaagatgtggcagtttattactgtcagcaacatttataacttctttcgtctactttcggcggaggacaaggtgagatcgaaaacgaactgtcggactgacaccatctacgtcttntac

SEQ ID NO: 65108 - DNA, 590 bp, Homo sapiens
  misc_feature: GYAE6OF02G6PUU.31.78.H01.1.454.CMB.1.raw
  modified_base (439)..(439): a, c, t, g, unknown or other
  misc_feature (439)..(439): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagttgttttattcggccccacaataacaactacttagcttggtaccagcagaaagtaggacagcctactaaactcctgatttacgtgggtccttccgtaccccggggctacgttcccgggggtttccctaaacccggtatttccatttcggcaggcggggttctggggacccatttcactctcaccatcagcacgcctgcaggctgaagntgtggctagtttatactgtcagacaactattaactactttctttcgtctacgtttcgggacggtacggaaccgtaagggtcggagtactaaccgaaacggtaacgttggtacggctagaccgtacctattccgttcgttaccttcgtaccg

SEQ ID NO: 65109 - DNA, 526 bp, Homo sapiens
  misc_feature: GYAE6OF02IK4WC.31.78.H01.1.454.CMB.1.raw
  modified_base (329)..(329): a, c, t, g, unknown or other
  misc_feature (329)..(329): n is a, c, g, or t
  modified_base (505)..(505): a, c, t, g, unknown or other
  misc_feature (505)..(505): n is a, c, g, or t
  modified_base (513)..(513): a, c, t, g, unknown or other
  misc_feature (513)..(513): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctggcgagagggccaccatcaactgcaagtccagccagagtgttttacttggcccctacaattaacaactacttagcttggtaccagcagaaagtaggacagcctctaaactcctgatttactgggcttcgtacccgggnatccggggttccaaccgattcattggcagcgggtctgggaccatttcactctcaccatcagcagcctgcagctgaagacgtgtggctagtttattactgtcagcaaacattatacttcttcgtctacttcggcggaggaccgaaggtcggagataccgaaaggtaacctggtcggntcgcactntctagtctactac

SEQ ID NO: 65110 - DNA, 559 bp, Homo sapiens
  misc_feature: GYAE6OF02I43LK.31.78.H01.1.454.CMB.1.raw
  modified_base (411)..(411): a, c, t, g, unknown or other
  misc_feature (411)..(411): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccaccaataacaactacttagcttggtaccagcagaaagtaggacagcctcctaaactcctgtatttactgggcttctacccgggcacgtccggggttcctaaccgtattcatttcggcaggcgggtcgtgggaccgtatttcactctcaccatcagcacgcctgcnggctgagatgtgctagtttattactgtcagcactattatactttctttacgtctacgtttcggacggtacggacctaagggtcgagtaactacgaaacggtaactggtacggtcgtagaccaccgtactaccgtgttccttactaccg

SEQ ID NO: 65111 - DNA, 570 bp, Homo sapiens
  misc_feature: GYAE6OF02JCCUL.31.78.H01.1.454.CMB.1.raw
  modified_base (298)..(298): a, c, t, g, unknown or other
  misc_feature (298)..(298): n is a, c, g, or t
  modified_base (324)..(324): a, c, t, g, unknown or other
  misc_feature (324)..(324): n is a, c, g, or t
  modified_base (400)..(400): a, c, t, g, unknown or other
  misc_feature (400)..(400): n is a, c, g, or t
tcagcagtagacgtcacgaccggtgctcgatttagtgtgagtagtttgggtttggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctctaaacncctgatttactggcttctacccgggnatccgggttctaacgattcattggcagcgggtctgggacgatttcactctcacatcagcagcctagcaggctgaanatgtggcagtttactatgtcagcaacattatactttctttcgtctaacgttttcggacggtacgggaacctaagggtcggtagtactaccgtaaaaccggaaacttggttacggaccgttaggtaccctaaccgtacgttaacccgtttcgggttcctttaccgtaaccg

SEQ ID NO: 65112 - DNA, 536 bp, Homo sapiens
  misc_feature: GYAE6OF02F2OX2.31.78.H01.1.454.CMB.1.raw
  modified_base (311)..(311): a, c, t, g, unknown or other
  misc_feature (311)..(311): n is a, c, g, or t
  modified_base (326)..(326): a, c, t, g, unknown or other
  misc_feature (326)..(326): n is a, c, g, or t
  modified_base (407)..(407): a, c, t, g, unknown or other
  misc_feature (407)..(407): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttacngggcttcacccgggnagtccgggttcctaaccgattcattggcagcgggtctggggaccatttcactctcaccatcagcagcctgcaggctgaagntgtggctagttttatactgtcaagcaaactatttaactactttctttcgtctacgttttcgggcggtagggaccaagggtggagatacgaaacgacttggtaggctaggcaccattctgttcttctacg

SEQ ID NO: 65113 - DNA, 543 bp, Homo sapiens
  misc_feature: GYAE6OF02GG18F.31.78.H01.1.454.CMB.1.raw
  modified_base (540)..(540): a, c, t, g, unknown or other
  misc_feature (540)..(540): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacaactacttagcttggtaccagcagaaagtaggacagcctacctaaactcctgtatttactgggcctttcgtacccgggctacgttcccggggtttacctaaccgtattcaagtttggcaggcgggtctggggacccgtatttcactctcaccatcagcacgcctgcaggctagaagagtgtggctagtttatactgtcagcaactattactacttctttacgtctactttcgggacgtaggacgtaggtgagatacgaaacggactgtgctgactacatctgtctntac

SEQ ID NO: 65114 - DNA, 536 bp, Homo sapiens
  misc_feature: GYAE6OF02FXCPN.31.78.H01.1.454.CMB.1.raw
  modified_base (408)..(408): a, c, t, g, unknown or other
  misc_feature (408)..(408): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccaccaataacaactacttagcttggtaccagcagaaagtaggacagcctacctaaactcctgatttactgggcttctacccgggcatccggggttcctaaccgattcattggcagcgggtctgggaccatttcactctcaccatcagcagctgcaggctgaagntgtggctagtttatactgtacagctaacatttatactttctttcgtcctacgtttcgggacggtaggtaccgaggtaggagactacgaaacgtacgtgtcggctgacctaccagtctgttcttctacc

SEQ ID NO: 65115 - DNA, 534 bp, Homo sapiens
  misc_feature: GYAE6OF02HMVWN.31.78.H01.1.454.CMB.1.raw
  modified_base (519)..(519): a, c, t, g, unknown or other
  misc_feature (519)..(519): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattggccccacaataacaactacttagcttggtaccagcagaaagtaggacagcctacctaaactcctgatttacgtgggcttccgtacccgggcagtcccggggttcctaaccgattcattggcagcgggtctgggacctatttcactctcaccatcagcacgcctgcaggctgaagagtgtggctagtttattactgtcagacaactattacttacttctttcgtctacgtttcggcggaggacctaggtcgagactacgaaacgactgtgactgccacnttcgtcgtcttctac

SEQ ID NO: 65116 - DNA, 798 bp, Homo sapiens
  misc_feature: GYAE6OF02IW530.31.78.H01.1.454.CMB.1.raw
  modified_base (317)..(317): a, c, t, g, unknown or other
  misc_feature (317)..(317): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagttgttttattcggccccacaataacaactactagcttggtaccagcaagaaagtaggacagccctactaaactcctgaactttacngggtaccttccgtacccgggctacgttccccggggttacctaaaccggtattccgaagttcggaccaaggtccgggtcgttacgggggacccttagttttccgaaccttccttaccgaacctaagtccaacggcctaaccgcccgtacggtaccgaacgggtaccttaggaaacggtacgttagggtacggtaccgttaaggttttaactttaccgttcggttaccgtaacggtaccctaaacgttaactttaaccgtttaccgtttttaccgttttaccgttaaccgtttaacccggtttttaccggggaacccggggttaaacggggtaaacccggttaaacggggtttaacgggaacggttaaaccgttaaacccggtaaaaaccgggttaaacccggtttgggttaaccgggtaccgttacggtaaccctacccgttaaacgttcccgtttacggtttaccctttaccgttaacccg

SEQ ID NO: 65117 - DNA, 559 bp, Homo sapiens
  misc_feature: GYAE6OF02G7511.31.78.H01.1.454.CMB.1.raw
  modified_base (535)..(535): a, c, t, g, unknown or other
  misc_feature (535)..(535): n is a, c, g, or t
  modified_base (540)..(540): a, c, t, g, unknown or other
  misc_feature (540)..(540): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgacaagtccagccagagttgttttattcggaccccacaataacaactacttagcttggtaccagcagaagtaggacagcctacctaaactcctagtatttacgtgggtccttccgtacccgggctacgtcccggggttacctaaccggtattcagttcggccaggtcgggtctgggaccgtatttcactctccaccatcagcacgcctgcgaggctagaagagtgtaggctagtttactacgtgtcagactaactattattacttctttacgtctacgtttcggaggacggaacgagggtgagactacgaaacgtactggngactnacactatctagttctctac

SEQ ID NO: 65118 - DNA, 542 bp, Homo sapiens
  misc_feature: GYAE6OF02G4B9I.31.78.H01.1.454.CMB.1.raw
  modified_base (387)..(387): a, c, t, g, unknown or other
  misc_feature (387)..(387): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttactgggcttctacccgggcagtccggggttcctaaccgattcattggcagcgggtctgggaccgatttcactctcaccntcagcagcctgcaggctagaagatgtggctagtttatactgtcagcaactattactactttctttacgtctacgtttcggcggacggtaaccagggtcggagtataccgaaacgtaactggtgacgttgcctaaccgattcgtagttccttctac

SEQ ID NO: 65119 - DNA, 533 bp, Homo sapiens
  misc_feature: GYAE6OF02JY3K5.31.78.H01.1.454.CMB.1.raw
  modified_base (311)..(311): a, c, t, g, unknown or other
  misc_feature (311)..(311): n is a, c, g, or t
  modified_base (383)..(383): a, c, t, g, unknown or other
  misc_feature (383)..(383): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacactacttagcttggtaccagcagaaagtaggacagcctacctaaactcctgatttacngggcttcgacccgggcagtcccgggttctaaccgattccattggcagcgggtctgggaccgatttcacttcncaccatcagcagcctgcaggctagaagactgtggactagtttattactgtcagcaactattatacttctttcgtctacgtttcggcgacggtaccgtaggtcgagactacgaaacgacgttgcgtctggcctacattctagttctctacg

SEQ ID NO: 65120 - DNA, 608 bp, Homo sapiens
  misc_feature: GYAE6OF02HN8SM.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacaactacttagcttggtaccagcagaaagtaggacagcctacctaaactcctagactttacgtgggtcctttccgtaccccggggctacgttcccgggggtttaccctaaacccggtatttcaagtttcggaccacggtcggggtcctggggacccgtatttccacttctccaacccatccagcagccctgccaggcctgaagatgtggctagtttatactgtcagaccaactactttattacctttctttcgtacttaccgtttacgggcgggtaacggacctaagggtggacgtataccgaaaacgtacgtggtacggcttacgcctacctattaccttcgttccttctaccg

SEQ ID NO: 65121 - DNA, 624 bp, Homo sapiens
  misc_feature: GYAE6OF02HP4J4.31.78.H01.1.454.CMB.1.raw
  modified_base (384)..(384): a, c, t, g, unknown or other
  misc_feature (384)..(384): n is a, c, g, or t
tcagcagtagacgtcacgaccggtgctcgatttagtgtgagtagtttggggtttgggggagcgtacaacagggccaggcaggggcagcaagattcggtgttgcagtacccaggtcttcatttctctgttgctctggatctcttgggtgccttacgggggacagttccgtgtatgagtccagtttccagactccctggctgtgtctctggggcgaggtagggccgaccagtcaactgccaaggtcccacgccagagttgttttacttcggccccaacaataaccaacttacttagcttggtaaccagcaagtaagtggacagcctcctaaactccgtgacttacgtggtccttcgtaccgggcagttccggggttacctaacggnttcagtttggctaggtcgggtctgggaccgtatttcgactctcacatcagcacgcctgccaggctagaacgtacgtagtaggactaagtttactacgtcgtacagtacaactattactactttcgttacgtctacgtttccggacggtagggaccgtaagggtggacgtacgttaacgaaacgtaacgttcggtaggtcgtaggtaccgaaccgtagttaccgtcgttaccgttctaccg

SEQ ID NO: 65122 - DNA, 576 bp, Homo sapiens
  misc_feature: GYAE6OF02IHCWQ.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcaggagggccaccatcaactgcaagtccagccagagttgttttattggccccacaataacaactactagcttgtaccagcaagaaagtagacagcctccaaactcctgtatttactgggtacttcgtacccgggctatcccggggtttacctaaccgtattccattcggacagtccgggtctgggaccgtatttcgactctcaaccatcagcagcctgcaggctagaacgtatgtgctagtttattactgtaccagtcaaactattactaactttctttcgtccttaactttcgggcggaaggtaacctaagggtggtactacgtacaaacggtacttaggtcggtacgttcgaccacctgtaccgtagttcctacttacg

SEQ ID NO: 65123 - DNA, 577 bp, Homo sapiens
  misc_feature: GYAE6OF02IUT55.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggcccacaataacaactacttagcttggtaccagcaagaaagtaggacacgcctacctaaacctcctagtatttacgtgggtccttacgtacccgggctacgttcccggggttacctaaccgattcattcggcgaggtcgggtcgtacgggaccgtatttcactctacaccatcagcacgcctgcaggctagaagagtgtggctagtttacttactgtcacgcaactattattacctttcgtttacgtccttacgtttcgggacgggaacggtaccgaagggtgagtactacgaaacggtactaggtaggctgacctaccgtatcgtctcgtctac

SEQ ID NO: 65124 - DNA, 539 bp, Homo sapiens
  misc_feature: GYAE6OF02H3P6U.31.78.H01.1.454.CMB.1.raw
  modified_base (312)..(312): a, c, t, g, unknown or other
  misc_feature (312)..(312): n is a, c, g, or t
  modified_base (355)..(355): a, c, t, g, unknown or other
  misc_feature (355)..(355): n is a, c, g, or t
  modified_base (528)..(528): a, c, t, g, unknown or other
  misc_feature (528)..(528): n is a, c, g, or t
  modified_base (536)..(536): a, c, t, g, unknown or other
  misc_feature (536)..(536): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcttgatgagccagtttccagactccctggctgtgtctctgggcgagagggccacatcaactgcaagtccagccagagtgttttattggccccacaataacaactactagcttggtaccagcagaaagtaggacagcctacctaaactcctagatttacgngggtcttccgtacccgggctacgtcccggggttacctaaccgnttcattcggctaggcgggtctgggacctatttcactctccaccatccagcacgcctgcaggctagaagagtggtggcttagtttattactgtcagacaactatttactacttctttcgtctacgtttcggcggaggaaccgaggtgagatacgaacgtaactgtggctgcacntctgtctntac

SEQ ID NO: 65125 - DNA, 532 bp, Homo sapiens
  misc_feature: GYAE6OF02F2J4J.31.78.H01.1.454.CMB.1.raw
  modified_base (415)..(415): a, c, t, g, unknown or other
  misc_feature (415)..(415): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacaactacttagcttggtaccagcaagaaagtaggacagcctacctaaactcctgatttactgggcttcgtacccgggcagtcccggggttacctaaccgattcattggcaggcggtctgggaccgtatttcactctcaccatcagcagcctgcagctgaagngtgtggctagtttactacttgtcagcaactattatactttctttcgtctacgtttcggacggtacggaccgtaggtcgagatacgaaacgacgtgtgctgcactatctgttctctac

SEQ ID NO: 65126 - DNA, 552 bp, Homo sapiens
  misc_feature: GYAE6OF02H6MYN.31.78.H01.1.454.CMB.1.raw
  modified_base (436)..(436): a, c, t, g, unknown or other
  misc_feature (436)..(436): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggccccacaataacactacttagcttggtaccagcagaaagtaggacagcctacctaaactcctgtatttacgtgggccttccgtacccggggctacgtcccggggttacctaaaccggatttccgagtttcggacaggtcgggtctggggaccgtatttcactcctcaccatcagcagcctgcaggctagaagntgtggtctagtttatactgtacagcaactattatactttctttcgtctacgttcgggacggaggaacctaaggtgagatacgaaacgtactgtacgctgcacatcgtagtatctac

SEQ ID NO: 65127 - DNA, 515 bp, Homo sapiens
  misc_feature: GYAE6OF02FM2CB.31.78.H01.1.454.CMB.1.raw
  modified_base (512)..(512): a, c, t, g, unknown or other
  misc_feature (512)..(512): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttactgggcttctacccgggcatccggggttcctaaccgattcattggcagcgggtctgggaccgatttcactctcaccatcagcagcctgcaggctgaagatgtggctagtttatactgtcagcaactattatactttctttcgtctactttcggcggtaggaccaagggtgagatacgaaacgactgtgctgcacatctgtctntac

SEQ ID NO: 65128 - DNA, 600 bp, Homo sapiens
  misc_feature: GYAE6OF02HMDFC.31.78.H01.1.454.CMB.1.raw
  modified_base (323)..(323): a, c, t, g, unknown or other
  misc_feature (323)..(323): n is a, c, g, or t
  modified_base (361)..(361): a, c, t, g, unknown or other
  misc_feature (361)..(361): n is a, c, g, or t
  modified_base (596)..(596): a, c, t, g, unknown or other
  misc_feature (596)..(596): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagtttccagactccctggctgtgtctctgggcgagagggccaaccatcaactgcaagtccagccagagttgttttattcggacccccaacaataacaactacttagctaggtaccagacaagaaagtaggacagtcctactaaactctagtatttacgnggccttccgacccggctacgtccgggttacctaaccgnttcattcggcagtcgggtcgtagggacctatttccactctacacctatcgacgtcagtcctgacaggctagaagacttggcggtactaagtttacttacgtcgtacaacgtacaaactatttaacgtacttttccgtttcgtacctacgtttccgggaccgggtaacggaccgtaagggtcgagtaactacgaaacgtacgtggtcggactcgaccgtacagttcctgttacctntacg

SEQ ID NO: 65129 - DNA, 595 bp, Homo sapiens
  misc_feature: GYAE6OF02GCPZF.31.78.H01.1.454.CMB.1.raw
  modified_base (312)..(312): a, c, t, g, unknown or other
  misc_feature (312)..(312): n is a, c, g, or t
  modified_base (325)..(325): a, c, t, g, unknown or other
  misc_feature (325)..(325): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgaggagggccaccatcaactgcaagtccagccagagttgttttattcggccccacaataacaactactagcttggtaccagcaagaagtaggacagcctactaactcctgattacnggcttcgaccggnacgtccgggttcctaacgtatcagttcgacaggtcggtctcgggacctactttcacttctccaccactcacgcacgcctgacaggtcgtagaacgatggtcggtacgttagtttactacttgtacgtagactaaacgtatttactacctttctttaccgtctacgtttcgggacggtaacgggtaccgtaagggtggaagacgtaacgaaaaccggtacttgggtacgtcgtacggtacctaccgtagttcctacggttccttactaccg

SEQ ID NO: 65130 - DNA, 601 bp, Homo sapiens
  misc_feature: GYAE6OF02JXCOW.31.78.H01.1.454.CMB.1.raw
  modified_base (228)..(228): a, c, t, g, unknown or other
  misc_feature (228)..(228): n is a, c, g, or t
  modified_base (286)..(286): a, c, t, g, unknown or other
  misc_feature (286)..(286): n is a, c, g, or t
  modified_base (311)..(311): a, c, t, g, unknown or other
  misc_feature (311)..(311): n is a, c, g, or t
  modified_base (330)..(330): a, c, t, g, unknown or other
  misc_feature (330)..(330): n is a, c, g, or t
  modified_base (355)..(355): a, c, t, g, unknown or other
  misc_feature (355)..(355): n is a, c, g, or t
  modified_base (429)..(429): a, c, t, g, unknown or other
  misc_feature (429)..(429): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctggcgagagggccaccatcaactgcaagtccagccagngttgtttattcggccccacaataacaactactagcttggtaaccagcagaagtggacngcctacaaactcctgaactttacgngggcctttccaacccgggnacgttcccggggttcctaaaccggnttccagttcggacagcgggtctgggacccgtatttacgcctctcgaccatccagcacgcctgcaggctagaagntggtcgctaaggtttacttatcggctagacctaaacgttatttaagttacctttcgtttaacgtccgttaccgtttcggccgggaagtaaccgtaaggtcgacgtacttaccgaaacggtaaccttgggaacgtctacggactaccgattcccgttaggttccttactaccg

SEQ ID NO: 65131 - DNA, 532 bp, Homo sapiens
  misc_feature: GYAE6OF02G537V.31.78.H01.1.454.CMB.1.raw
  modified_base (529)..(529): a, c, t, g, unknown or other
  misc_feature (529)..(529): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttactgggcttctaccccgggcacgtcccgggggttcctaaccgattcactttggccaggcgggtctggggacccgtattttccactctcaccatcagcagcctgcaggctgaagatgtggctaggtttattactgtcagcaacattactacttctttcgtctactttcggcgtaggaccaagggtgagatacgaaacgtactggtgctgcacatctgtcttntac

SEQ ID NO: 65132 - DNA, 538 bp, Homo sapiens
  misc_feature: GYAE6OF02IBJUM.31.78.H01.1.454.CMB.1.raw
  modified_base (424)..(424): a, c, t, g, unknown or other
  misc_feature (424)..(424): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcagagggccaccatcaactgcaagtccagccagagttgttttattggccccacaataacaactacttagcttggtaccagcagaaagtaggacagcctacctaaactcctagactttacgtgggtccttccgtacccgggcacgttcccggggttacctaaccgattcattggcaggtcgggtctgggacctatttcactctcaccatcagcagcctgcaggctagaagntgtggctagtttatactgtcagcaactattactacttctttcgtctacgttcggcggacggacctagggtgagactacgaaacgtactggtacgctgcacatctcgttctctac

SEQ ID NO: 65133 - DNA, 543 bp, Homo sapiens
  misc_feature: GYAE6OF02HDTGI.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctacctaaactcctgatttactgggcctttcgtacccgggcacgttccgggggttccctaaccggtattcaatttcggcagcgggtctgggacccgatttcgactctcaccatcagcagcctgcaggctagaagactgtggctagtttatacgtgcagcaactattatacttctttcgtctacgtttcggcggtaggaccgaaggtgagtactacgaaacgacgtggtggactgacaccatcctgttctctac

SEQ ID NO: 65134 - DNA, 815 bp, Homo sapiens
  misc_feature: GYAE6OF02HCO4N.31.78.H01.1.454.CMB.1.raw
tcagcagtagacgtcacgaccggtgctcgatttagtgtgagtagtttgggttgggggacgaactacaaccaggtcgaggacacgggcagcaagatggtcgttgccagacccgaggtcgttccagtttctctgttcgtcttcgtgggatctctaggtagccgtacggggaccattccgtaggtatggacgccgtaagtttccagtacgtcccgtggtctgtgtcgtcgtagggccgagggacggccaaccgagtacgaacctcgacgaacgtaccgacgtcctaggtacgttacgtttttacttacggacccccacgtaataaccaacgttacgttacgccgttaggtacccgacgtacgaaggaaaggtacggtacgagccgtaccgtaaacgtccttaggtactttacgtgggtcctttccgtacccgggactacgtcccggggttacctaaaccggtaatttcagttcggacctaagggaccgggttcgtaggggacccgtagtttaccgactacctacaccgactacgaagaccacgtcctacgaccgaggaccgtacggaaacgtacgtaggtacggaccgttaggtttacgttaccgtacgttacgacggtacctaacgtacgtttaacgttaaccgttttaccgtttaccggttacctttaaccgttttacccgggtacgggtacgggtaaccgtaagggttacgggaagttaacggttaacgttaaaacggttaacgttacggttacgggttaccttacggtaccgtaaccgtacgttaccggtacggtttaccgttaccgttaccgg

SEQ ID NO: 65135 - DNA, 646 bp, Homo sapiens
  misc_feature: GYAE6OF02GB37X.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccacatcaactgcaagtccagccagagttgttttattcggccccacaataacaactactagcttggtaccagcaagaaagtaggacacgcctacctaaactcctagtactttacgtgggtccttaccgtaccccggggctacgttcccggggttaccctaaaccggtattcaatttcggaccagggtccgggtcgtaggggacccgtatttccgactctccaaccatccaagccacgcctgacgacggtcgtagaaagtgtaggtggactaagttttactacgttcgtacacgtactaaactatttaacttacctttcgtttacgtccttacgtttcgggacgggtaacggtaaccgtaagggtcggaagtactaaccggaaaacgtacgttacggtacggtacctaggaccaaccgttacttccgttcgttccttactaccg

SEQ ID NO: 65136 - DNA, 848 bp, Homo sapiens
  misc_feature: GYAE6OF02FQOSY.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagattgttttattcggccccacaataacaactacttagcttggtaccagcaagaaagtaggacagcctacctaaactcctgtactttacgtgggtccttccgtaccccggggctacgttcccgggggtttaccctaaaccggtactttccgaacgtttcgggaccacgggtccgggggttcctacgggggtaaccccgtaacgtttttaccgaacccgtttcccttacccgaacccctaacgtttacccgaaacgggtcccgtaaccgggtacccctttcgggacccgtaacggggtcccgttaagggtaaaacggtacggtttaggggttacggggtaccctttaaagggttttttaaccttttaaccgtttcggttaccgtaacggtaaccctaaaaaccgttaacgtttttaaacctttaacccgtttttaccgttttttacccggtttaccgtttaacccggttttttaccggggaaccggggttaaaccggggtaaacccggttaaaggggttacgggtaacggtaacgttaaccggtaaaaaccggtaaaccgttgggtacggtaccgtacggtacctaaccgtaacgttccgttacgttacccgttacgtacccg

SEQ ID NO: 65137 - DNA, 593 bp, Homo sapiens
  misc_feature: GYAE6OF02IREEY.31.78.H01.1.454.CMB.1.raw
  modified_base (414)..(414): a, c, t, g, unknown or other
  misc_feature (414)..(414): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctacctaaactcctgtatttacgtgggcttcgtaccccgggctacgttcccggggttaccctaaaccggtattcagttcggcacggcggggttcgtcgggtaccgtatttcacgtcctcaaccntcagcacgcctgcgagctagaagagtgtggctagtttatactgtcagcaactatacttacttcgtttacgtctacgtttcgggcgggtaagggtaccgaagggtggtacgtagttaccgaaaacggtaaccttgggtcggtcgtacgcgtaccgtacttcgtacgttccttacctaccg

SEQ ID NO: 65138 - DNA, 534 bp, Homo sapiens
  misc_feature: GYAE6OF02GGFN2.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttactgggcttcgtacccgggcactccggggttcctaaccgattcattggcagcgggtctgggaccgatttcactctcaccatcagcagcctgcaggctgaagatgtgctagtttatactgtcagcaactattactacttctttcgtctacgtttcggcggtacggaccgaaggtgagtatacgaaacgtacgtggtcggactgactacctattctcgtcttcgtacc

SEQ ID NO: 65139 - DNA, 870 bp, Homo sapiens
  misc_feature: GYAE6OF02F07SM.31.78.H01.1.454.CMB.1.raw
  modified_base (334)..(334): a, c, t, g, unknown or other
  misc_feature (334)..(334): n is a, c, g, or t
tcagcagtagacgtcacgaccggtgctcgatttagtgtgagtagtttgggtttgggggggagctacgaacaggcgaggcaggggcagcaaggatggtgttgcaggacccagggtccttcactttctcttcgttgctcttggatctctggtgcctacggggacatcgtgatgagccagtttccagacctccctggctgtgtctcgtgggcgagaggccacatcactgcaagtccagccagtagtgttttaattcggaccctaactaataacaactactagacttaggtaccagcaaggaacgtaggactagcctactaaactcgtgactttacgngggcctacgtacccgggctacggttccgggttacctaacggtattacgtaagtttcggacgtacggtcccgggttacgtacggggtacccgtagttttccgaacttcgtacctaacccgtattccgaaacgtcctaacggtcccgttacgggaccgtacggggtacgtaagggaaacggtacggttacgggtaccgggtacctttaaacgggttttttaaactttaaccggtttaccgggttacccgaaacgggtaaccctaaaacggtttacgttttaaaccgttaacccggtttttccggttttacccgttaaccggtttaacccggggtttttacggggggtaacccggggttaaaccggggtaaacccgggttaaaagggggttaccgggttaaacggttaaccggttaaacccggttaaaaccggtaaccggtttaccggggtacgggtaccccgtttaacgggtaaccccttaacccgggttaacccgtttcccggtttacggtttacccgtttacccgtttaaccccgg

SEQ ID NO: 65140 - DNA, 906 bp, Homo sapiens
  misc_feature: GYAE6OF02HB6Q6.31.78.H01.1.454.CMB.1.raw
tcagcagtagacgtcacgaccggtgctcgatttagtgtgagtagtttggggtttgggggaggcgtacaacaggcaggcaggggcagcaagatggtgttgcagacccaggtcttcatttctctgttgctcgtgatctctggtgccgtacgggacatcgtgatgagcctagttccagacctcccgtggctgtcgtctcgtgggacgaggacgggccacatcaactgacaacgtccacgaccaggagttgttttacgttcggacccccaataaactaacctaaaccttaacgttacggtcgtttacgggtaaccacggaaccgtaaaaggtaaaacgggtacgggaaccaacggtacccccttaacccgttaaaaccttacccgttttaactttaacggtaccggggttccttttaccccggtaaccccggggtactaaaccggtttccccggggggtttaaccctaaaacccgggtacttttaccgtaacggttttacggggacccgtaacggggtcccgggggtttaccggttaccgggggtaacccgtttaagttttacccggaacctttccgtacccgtaaacccgtaacgttaccaacgggtacctaaccggtcccgtacggaaccgtacgggtaccgtacggaaagtacgtcggttacggacgttaggtttaacttacgttacgtacgtagtaaccgtaaacttactttaacgttaccgttttaccgtttaccgtacgttaaccggttttaccgggaccgggttaaaccgggtaaccgtaacgggggttacgtaacggttacgttaaccggtaaaccggtaaccggttagggttaccggtaccgttacggtacccgaaccgttccggttaccgttcggtttaccgtttactaccgtttccccg

SEQ ID NO: 65141 - DNA, 547 bp, Homo sapiens
  misc_feature: GYAE6OF02GGMTZ.31.78.H01.1.454.CMB.1.raw
  modified_base (543)..(543): a, c, t, g, unknown or other
  misc_feature (543)..(543): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggcccccacaataacaactacttagcttggtaccagcagaaagtaggacagcctactaaactcctgatttactgggcttcgtacccgggcatccggggttcctaaccgattcattggcagcgggtctgggacctatttcactctcaccatcagcagcctgcaggctgaagagtgtggctaggtttattactgtcagacaactattatacctttctttccgtctaccgtttcgggcggacgggtaccgtaagggtggagtagtaccgaaacggaactggtcggctgaccacagtctcgttccttntacc

SEQ ID NO: 65142 - DNA, 526 bp, Homo sapiens
  misc_feature: GYAE6OF02GL9N0.31.78.H01.1.454.CMB.1.raw
  modified_base (522)..(522): a, c, t, g, unknown or other
  misc_feature (522)..(522): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattggccccacaataacaactacttagcttggtaccagcagaaagtaggacagcctacctaaactcctagatttactgggcttctacccgggctagtcccggggttcctaacgattcattggcaggcgggtctgggaccgtatttcactctccaccatcagcacgcctgcaggctgaagatgtgctagtttatactgtcagcaactattatactttcttcgtctacgtttcggcggtaggaccaaggtgagtatacgaaacgactgtcgctgcactatctgtctntacg

SEQ ID NO: 65143 - DNA, 544 bp, Homo sapiens
  misc_feature: GYAE6OF02FXX82.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacaactacttagcttggtaccagcagaaagtaggacagcctcctaaactcctgatttactgggcttcgtacccgggcattctcggggttcctaaccgattcattggcagcgggtctgggacctattcactctcaccatcagcagcctgcaggctagagatgtgctagtttattactgtacagaccaactattacttacctttcttttacgtcttacgtttcggacggtacgggacctaagggtgagacgtacaaacggtactggtacgctcggaccaccatcttcgtcttac

SEQ ID NO: 65144 - DNA, 689 bp, Homo sapiens
  misc_feature: GYAE6OF02F8NRU.31.78.H01.1.454.CMB.1.raw
  modified_base (317)..(317): a, c, t, g, unknown or other
  misc_feature (317)..(317): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagacgggccaccatcaactgcaagtccagccagagttgttttattggccccacaataacaactacttagcttggtaccagcaagaaagtaggacagcctacctaaactcctgactttacgngggctttcgtacccggggctaagttcccggggttcctaaccggtattcgaagtttcggactaggccggggttctaggggacccgtattttccgaacttcctaccacccgtatccgaagtccgacgtcctggaccgagggtctaggaacgtagtacggtaggtacctaaggttttaactacgttcgtactagtacctaaagtaactttacttaactttccgttttccgttactaaccgtttttccgggacgggtaacgggtaacccgtaaggggttacggacgtaacgttaaccggaaaaacggtaacgttcggtacgggtaccgttacgaccgtaacccgtacttacgttcggttaccttaccgttaacccg

SEQ ID NO: 65145 - DNA, 552 bp, Homo sapiens
  misc_feature: GYAE6OF02GH5AU.31.78.H01.1.454.CMB.1.raw
  modified_base (328)..(328): a, c, t, g, unknown or other
  misc_feature (328)..(328): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggccccacaataacaactacttagcttggtaccagcagaaagtaggacagcctactaaactcctgatttactgggcttcacccgggnatccggggttctaacgattcattgcagcggtctggaccgattcactctcaccatcagcagcctgcagctgaagatgtggctagtttatctgtcagacaacattataactttctttcgtctacgtttcgggacggtacggtaccgtaagggtggagtacgtacgaaaaccgtaacgttggtacggctaggacctaaccgtacttcgttacggttccttactaccg

SEQ ID NO: 65146 - DNA, 531 bp, Homo sapiens
  misc_feature: GYAE6OF02F8G21.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctactaaactcctgatttactgggcttctacccgggctacgttccggggttcctaaccgattcagttggcagcgggtctgggaccgtatttcactctcaccatcagcagcctgcaggctagaagatgtggctagtttatactgtcagcaactattatacttctttcgtctacgtttcggcggtacggaccaaggtgagatcgaaacgtactaggtcggctgacactatctcgtacttctac

SEQ ID NO: 65147 - DNA, 609 bp, Homo sapiens
  misc_feature: GYAE6OF02FE0CC.31.78.H01.1.454.CMB.1.raw
  modified_base (515)..(515): a, c, t, g, unknown or other
  misc_feature (515)..(515): n is a, c, g, or t
  modified_base (526)..(526): a, c, t, g, unknown or other
  misc_feature (526)..(526): n is a, c, g, or t
tcagcagtagacgtcacgaccggtgctcgatttagtgtgagtagtttgggtttgggggagctaacaacaggcaggcacggggtcagtcaagatggtgttggcagacccaggtcttccatttctctgttgctctcggatcctctggtgcccttacgggggaccagtccgtagatgagcccgacgttttccgagactcccgtggctgtgtctcgtgggcgagagggccaccatccaacgtcgccaacgttccagcccgaggacgttcgtttttatttcggccccctacgaataaaccgaactacttagcttggtacctagccagaaagtaggactaggaccctacccgtaaacctcctagtagtttaactgggcttcgtacccgggcagtccggggttccctaaacccgattcgacttcggactagcgggtcttgggaccgtagtttcaccgtctcaccatcagcagcctgcgaggctgaagatgtgctagtttatacgtgtcagcaacgtagttancttcgttcgtntacgtttggcgtaggacaggtcgtagatacgaaacgtactggtcggtcgtggtaccgaccgtagtcgtacggtcttacgtacg

SEQ ID NO: 65148 - DNA, 580 bp, Homo sapiens
  misc_feature: GYAE6OF02HD89O.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattggccccacaataacaactacttagcttggtaccagcagaaagtaggacagcctacctaaactcctagtaatttacgtgggcctttccgtacccggggcaacgttcccggggttaccctaaaccggtattcagtttcggcgaaggcgggttctaggggacccgtattttccactcctcaaccatccagcacgcctgcaggctagaagatgtaggctagtttatactgtacagacaactattatactttctttcgtctacgtttcgggacggtacgggaacctaaggtcggagactacgaaacgaacttggtacggctgacacctatctagttcttactacg

SEQ ID NO: 65149 - DNA, 577 bp, Homo sapiens
  misc_feature: GYAE6OF02JCSHP.31.78.H01.1.454.CMB.1.raw
  modified_base (318)..(318): a, c, t, g, unknown or other
  misc_feature (318)..(318): n is a, c, g, or t
  modified_base (436)..(436): a, c, t, g, unknown or other
  misc_feature (436)..(436): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagacgggccaccgatcaactgcaagtccagccagagttgttttattcggccccacaataacaactacttagcttaggtaccagcagaaagtaggacagcctactaaactctagtatttacgngggtcttccgtacccggtcacgtccggggttacctaaccggtattacattcggcacggtcgggtcgtacgggaccgtattcgacgttcctacacatcagcagcctgcaggctagaagntggtgcgtatttatactgtacagctaactattattacttcttcgtctacgtttcgacggtaggtaccgaggtacggagtaacgtacgaaacgtacgtaggtaggaccttgacgtactcgttcgtacgttacctcgtaaccg

SEQ ID NO: 65150 - DNA, 556 bp, Homo sapiens
  misc_feature: GYAE6OF02GD1I7.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccaccaataacaactacttagcttggtaccagcagaaagtagacagcctacctaaactcctagtatttactgggtccttcgtaccccgggctacgttcccggggttaccctaaccggtattccattcggcaggcgggtctgggaccgtatttcactctcaccatcagcagctgcaggctagaagagtgtggctagtttatacttgtcagtacaactattactactttctttcgttctacgtttcggcggaggtaccgagggtgagactacgaaacgtacgtggtcggctgacgactactctcgttcttctac

SEQ ID NO: 65151 - DNA, 548 bp, Homo sapiens
  misc_feature: GYAE6OF02IUXCM.31.78.H01.1.454.CMB.1.raw
  modified_base (535)..(535): a, c, t, g, unknown or other
  misc_feature (535)..(535): n is a, c, g, or t
  modified_base (545)..(545): a, c, t, g, unknown or other
  misc_feature (545)..(545): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccaccaataacaactacttagcttggtaccagcagaaagtaggacagcctacctaaactcctagactttacgtgggcttccgtacccgggcacgttcccggggttacctaaccggtattcatttcggcaggtcggggtctggggacctatttcactctcaccatcagcagcctgcaggctagaagatgtggctagtttattactgtacagacaactattacttactttctttcgtctacgtttcggcggacggtaccgaggtgagatacgaaacgactggtagctcgcacntctcgttctntac

SEQ ID NO: 65152 - DNA, 536 bp, Homo sapiens
  misc_feature: GYAE6OF02HAH8O.31.78.H01.1.454.CMB.1.raw
  modified_base (532)..(532): a, c, t, g, unknown or other
  misc_feature (532)..(532): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccaccaataacaactacttagcttggtaccagcagaaagtaggacagcctcctaaactcctagatttactgggcttctacccgggcatccggggttcctaaccgattcattggcagcgggtctgggaccatttcactctcaccatcagcagcctgcaggctgaagatggtgctagtttattactgtcagcaacattatactttctttcgtactacttttcggcggtagggacctaagggtggagagtacgaaacggtaactggtaggctgccactagttctgttccttntaac

SEQ ID NO: 65153 - DNA, 580 bp, Homo sapiens
  misc_feature: GYAE6OF02JVSYP.31.78.H01.1.454.CMB.1.raw
  modified_base (240)..(240): a, c, t, g, unknown or other
  misc_feature (240)..(240): n is a, c, g, or t
  modified_base (321)..(321): a, c, t, g, unknown or other
  misc_feature (321)..(321): n is a, c, g, or t
  modified_base (361)..(361): a, c, t, g, unknown or other
  misc_feature (361)..(361): n is a, c, g, or t
  modified_base (415)..(416): a, c, t, g, unknown or other
  misc_feature (415)..(416): n is a, c, g, or t
  modified_base (427)..(427): a, c, t, g, unknown or other
  misc_feature (427)..(427): n is a, c, g, or t
  modified_base (432)..(432): a, c, t, g, unknown or other
  misc_feature (432)..(432): n is a, c, g, or t
  modified_base (476)..(476): a, c, t, g, unknown or other
  misc_feature (476)..(476): n is a, c, g, or t
tcagcagtagacgtcacgaccggtgctcgatttagtgtgagtagtttgggtttgggggtaggcgtacaacaggcaggcgagggcgagcaagatggtgttgcagacccaggtcttcatttctctgttgctctggatctctggtgcctacggggacatcgtgatgagccagtttccagactccctggctgtgtctcgtgggcgagagggccaccatcaacgtgccaagtccagccagagttnttttagttcgcccccaacaataacaactactagcttggaccagcaagaaagtggacagaccctccaaactcctgatttacngggcttacacccgggcaggttcccggggttacctaaccgnttctagttcggcagcgggtacttgggacctattttcactctcgaccatcgagcnncctgccgagcngaagntgtgactagttatactgtacagtcatattattaccttcttttcncgttacgttcggtacggtaggaacctaagggtcggtagtactaccggaaacgtagtcggtaacggcttacgacgaccctagttacctcggttacttaccctacg

SEQ ID NO: 65154 - DNA, 601 bp, Homo sapiens
  misc_feature: GYAE6OF02GS2UG.31.78.H01.1.454.CMB.1.raw
  modified_base (314)..(314): a, c, t, g, unknown or other
  misc_feature (314)..(314): n is a, c, g, or t
  modified_base (332)..(332): a, c, t, g, unknown or other
  misc_feature (332)..(332): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcaagaaagtaggacagcctacctaaactcctagatttacngggctttcgtacccgggntagttcccggggttacctaaaccgtatttcaagtttggaccaggcgggtctggggaccctatttcactctcaccatcagcacgcctgcaggctagaagatggtcgctagtttattacgtgtcagacaactattacttactttactttcgtctacgtttcgggacggtacggaacctaagggtggagactaaccggaaaacgtaaccgttgggttacggaccgttacggacctaacccgtaagttccgttacgttacccttacgtaaccg

SEQ ID NO: 65155 - DNA, 603 bp, Homo sapiens
  misc_feature: GYAE6OF02IUUL2.31.78.H01.1.454.CMB.1.raw
  modified_base (399)..(399): a, c, t, g, unknown or other
  misc_feature (399)..(399): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagacgggccaccatcaactgcaagtccagccagagttgttttattcggccccacaataacaactacttagcttggtaccagacagaaagtaggacagcctacctaaactcctagactttacgtgggccttccgtacccgggctacgtcccggggttacctaaccgtattcattggcaggcgggtctgggacctatttcactcncaccatcagcacgcctgcaggctagaagagtgtcgctagtttattacgtgtacagctaactatttacttactttctttcgtacttaccgtttcgggacggtaacgggaaccgtaagggttacggagtacgtaaccgaaaacggttaaccgtcggtacggaccttacgaccctaaccgtacttacgttacgttccttactacccg

SEQ ID NO: 65156 - DNA, 596 bp, Homo sapiens
  misc_feature: GYAE6OF02HY3VH.31.78.H01.1.454.CMB.1.raw
  modified_base (317)..(317): a, c, t, g, unknown or other
  misc_feature (317)..(317): n is a, c, g, or t
  modified_base (441)..(441): a, c, t, g, unknown or other
  misc_feature (441)..(441): n is a, c, g, or t
  modified_base (590)..(590): a, c, t, g, unknown or other
  misc_feature (590)..(590): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggttcctacggggacatcgtgatgagccagtttccagactccctggctgtgtctctgggcgagagggccaccatcaactgcaagtccagccagagtgttttattcggcccactaataacaactacttagcttggtaccagcagaaagtaggacagccctacctaaactcctgaattttacgnggtcctttctacccgggctacgtcccggggttacctaaccgtattcaagttcggacaggtccggggtctaggggacccgtattttcacttctaccacctagtcaggccagcctgccagctgaanatggtggacgtagtttaatacgtgtcagtcaatattacttactttctttcctacgttactttcgggcggtaagggtaccagggtacgagtacgtacgaaacgtagtcggttcggacttagacctactccgtaattcgttgttaccgttntaaccg

SEQ ID NO: 65157 - DNA, 763 bp, Homo sapiens
  misc_feature: GYAE6OF02GSVVJ.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacaactacttagcttggtaccagcagaaagtaggacagcctacctaaactcctagtactttacgtgggtccttccgtacccgggctacgttcccgggggtttaccctaaaccggtacttcctaagtttcggacctaacggtccggggttccgtacgggggtacccgtaagtttttacccaaccgtttcccttaccaacccgtaacttacccgaaggtaccctaacggtccccttaggacccgagggtccctaggaaagtacgttcgggttacgggtaccttaaggtttttaacttaccgttggttaccgaacgtacctaaaacctatttaacttaacctttttccgtttacccgttaccgtaaccgtttttccggggaccgggtaaacgggtaacccgtaaagggttcgggaacgtaacgttaaccgaaaaaccggttaacgttacgggttacggtacccgttacggaccctaaccgtactttcccgtacgtttacccttacgttaacccg

SEQ ID NO: 65158 - DNA, 558 bp, Homo sapiens
  misc_feature: GYAE6OF02J08M4.31.78.H01.1.454.CMB.1.raw
  modified_base (351)..(351): a, c, t, g, unknown or other
  misc_feature (351)..(351): n is a, c, g, or t
  modified_base (390)..(390): a, c, t, g, unknown or other
  misc_feature (390)..(390): n is a, c, g, or t
tcagcagtagacgtcacgaccggtgctcgatttagtgtgagtagtttgggtttgggggaggctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacactactagcttggtaccagcagaaagtaggacagcctacctaaactcctgatttactgggtccttctacccggggcagtcccggggttcctaaccgnttcattggcagcggtctgggacctatttcactctcaccntcagcagcctgcaggctgagatgtgctagtttatacgtgtcagcaactattactactttctttacgtctacgtttcggaccggtaggacctaagggtggagtacgtaccgaaacggtacgttggtagggtcctagtaccaccctagttcctcggttaccttctaaccg

SEQ ID NO: 65159 - DNA, 537 bp, Homo sapiens
  misc_feature: GYAE6OF02GNNPJ.31.78.H01.1.454.CMB.1.raw
  modified_base (526)..(526): a, c, t, g, unknown or other
  misc_feature (526)..(526): n is a, c, g, or t
  modified_base (534)..(534): a, c, t, g, unknown or other
  misc_feature (534)..(534): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactcctggctgtgtctctgggcgagagggccaccgatcaactgcaagtccagccagagtgttttattggccccacaataacaactacttagcttggtaccagcaagaaagtaggacagcctacctaaactcctagatttacgtgggtcttcgtacccgggctaacgttcccggggttacctaaccgatttcagtttcggcaggcgggtctgggacctatttcactctcaccatcagcagcctgcaggctagaagatgtgctagtttattactgtcagcaatattactactttctttcgtctacgtttcggcggtacggaccaggtgagatacgaaacgtactgtggctgcactntctgtctntac

SEQ ID NO: 65160 - DNA, 535 bp, Homo sapiens
  misc_feature: GYAE6OF02IF297.31.78.H01.1.454.CMB.1.raw
  modified_base (426)..(426): a, c, t, g, unknown or other
  misc_feature (426)..(426): n is a, c, g, or t
  modified_base (497)..(497): a, c, t, g, unknown or other
  misc_feature (497)..(497): n is a, c, g, or t
  modified_base (522)..(522): a, c, t, g, unknown or other
  misc_feature (522)..(522): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgaggagggccaccatcaactgcaagtccagccagagtgttttattcggccccacaataacaactacttagcttggtaccagcagaaagtaggacagcctccctaaactcctgatttactgggtcttccgtacccgggcacgtcccggggttaccctaaccggattcagttcggctagcgggtctgggaccgtatttcactctcaccatcagcagcctgcaggctagaagntggtgctagtttatactgtcagcaaacattatactttcttcgtctacgtttcgggcgaggaccaggtgganatacgaaacgatggtgctgccactntctgttcctatcc

SEQ ID NO: 65161 - DNA, 522 bp, Homo sapiens
  misc_feature: GYAE6OF02GCNBD.31.78.H01.1.454.CMB.1.raw
  modified_base (519)..(519): a, c, t, g, unknown or other
  misc_feature (519)..(519): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttactgggcttctacccgggcatccggggttcctaaccgattcattggcagcgggtctgggaccgatttcactctcaccatcagcagcctgcaggctgaagatgtggctagtttatactgtcagcaacattatactttctttcgtctactttcgggcgagggtaccaagggtggagactacgaaacgactggtcggctgcaccatctgttctntac

SEQ ID NO: 65162 - DNA, 512 bp, Homo sapiens
  misc_feature: GYAE6OF02FV2NR.31.78.H01.1.454.CMB.1.raw
  modified_base (504)..(504): a, c, t, g, unknown or other
  misc_feature (504)..(504): n is a, c, g, or t
  modified_base (509)..(509): a, c, t, g, unknown or other
  misc_feature (509)..(509): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttactgggcttctacccgggcatccggggttcctaaccgattcattggcagcgggtctgggaccgatttcactctcaccatcagcagcctgcaggctgaagatgtggcagtttatactgtcagcaacattatacttctttcgtctactttcggcggaggaccagggtgagatcgaaacgactgtgctgcaccatcgtntcttntac

SEQ ID NO: 65163 - DNA, 587 bp, Homo sapiens
  misc_feature: GYAE6OF02H9DXH.31.78.H01.1.454.CMB.1.raw
  modified_base (337)..(337): a, c, t, g, unknown or other
  misc_feature (337)..(337): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccacatcaactgcaagtccagcagagttgttttattggcccccaacaataacaactacttagcttaggtaccagcaagaaagtaggacacgcctacctaaactcctagatttacgtgggccttcgtaccccgggntacgttcccggggttaccctaaccggtattactagttggccaggtccggggtcgtacggggacccgttatttccactcctaccaacccatccagccacgcctgcaggctagaagatgtggctaagtttattactgtacagacaactatttacttactttctttacgtctacgtttcggcggaggaccgaaggtgagtactacgaaacgacgtggtacggtctacgacaccgattacctgttcttactacc

SEQ ID NO: 65164 - DNA, 586 bp, Homo sapiens
  misc_feature: GYAE6OF02GE38Z.31.78.H01.1.454.CMB.1.raw
  modified_base (393)..(393): a, c, t, g, unknown or other
  misc_feature (393)..(393): n is a, c, g, or t
  modified_base (424)..(424): a, c, t, g, unknown or other
  misc_feature (424)..(424): n is a, c, g, or t
tcagcagtagacgtcacgaccggtgctcgatttagtgtgagtagtttgggtttgggggtagctacaacaggtcaggcaggggcagcaagatggtgttgcagacccagggtcttcatttctctgttgctctggatctctggtgcctacggggacatcgtgatgagccagtttccagactccctggctgtgtctctgggcgagagggccaccatcaactgcaagtccagccagagtgttttattcggccccacaataacaactacttagcttggtaccagcagaaagtaggacagacctactaaactcctgaatttactgggtcttcgtacccgggctacgtccggggttacctaaccgattcgattggcagcgggtctgggacctatttcactntacacagtcagcagcctgcagtctagaagtntcggtgctagtttactacgtgtacacgtcaacgtattacttaccttctttacgaccttacgtttccgggacggtacgggtaaccgagggtcggacgacgtaccgaaaccggtagttcggtacggtctacggaccaccgtactcgtcgttaccttcgtaaccg

SEQ ID NO: 65165 - DNA, 526 bp, Homo sapiens
  misc_feature: GYAE6OF02GY9S9.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccaccaataacaactacttagcttggtaccagcagaaagtaggacagcctcctaaactcctgatttactgggcttctacccggggcatccggggttcctaaccgattcattggcagcgggtctgggaccgatttcactctcaccatcagcagcctgcaggctgaagatggtggctagtttattactgtcagcaacattatactttctttcgtctactttcgggcggtacggaccaagggtggagatacgaaacgaacttgtggctgcaccatctgtcttctac

SEQ ID NO: 65166 - DNA, 529 bp, Homo sapiens
  misc_feature: GYAE6OF02FI2J0.31.78.H01.1.454.CMB.1.raw
  modified_base (311)..(311): a, c, t, g, unknown or other
  misc_feature (311)..(311): n is a, c, g, or t
  modified_base (409)..(409): a, c, t, g, unknown or other
  misc_feature (409)..(409): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccggactccctggctgtgtctctgggcgagagggccaccatcaactgcaagtccagccagagtgttttattggccccacaataacaactacttagcttggtaccagcagaaagtaggacagcctcctaaactcctgatttacngggcttctacccgggcatccggggttcctaaccgattcattggcagcgggtctgggaccgtatttcactctcaccatcagcagcctgcaggctgaagntgtggctagtttattactgtcagcaactattatacttctttcgtctacgtttcggacggtacgggaccaaggtggagatacgaaacgtaactgtcggctgcacatctgtcttcattcccg

SEQ ID NO: 65167 - DNA, 524 bp, Homo sapiens
  misc_feature: GYAE6OF02HIG97.31.78.H01.1.454.CMB.1.raw
  modified_base (312)..(312): a, c, t, g, unknown or other
  misc_feature (312)..(312): n is a, c, g, or t
  modified_base (412)..(412): a, c, t, g, unknown or other
  misc_feature (412)..(412): n is a, c, g, or t
  modified_base (521)..(521): a, c, t, g, unknown or other
  misc_feature (521)..(521): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctacctaaactcctgatttacngggcttctacccgggcagtccgggttcctaaccgattcattggcagcgggtctgggaccattcactctcaccatcagcagcctgcaggctagaagagtgngctagttttattacgtgtacagactaacatttactactttctttcgtctactttcgggcgtaggaccagggtgagtatacgaaagactgcgctgcaccatcgtgttctntac

SEQ ID NO: 65168 - DNA, 671 bp, Homo sapiens
  misc_feature: GYAE6OF02G6LMB.31.78.H01.1.454.CMB.1.raw
  modified_base (330)..(330): a, c, t, g, unknown or other
  misc_feature (330)..(330): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagacctccctggctgtgtctcgtgggcgaggacgggccaccatcaactgcaagtccagccagtagttgttttattcggaccccaacaataacaactacttagcttaggtaccagcaagaaagtaggacagccctacctaaactcctagtactttacgngggtcttccgtacccgggctacggttcccggggttacctaaccgtattcagttcggcaggtcgggtcgtgggacctatttcactctacacctatcaagcacgtcctgcgaggctagaacgtagttggtacggtcttaaggttttacttacgttgtacctaagtacctaaacgttaatttacttaccttttcgtttaccgttaccgttaaccgttttccggggaccgggtaacgggaaccgttaaggggtcggtacgtaacgtaaccgaaaacggtaacgttgggtacggtaccgttacggaccctaaccgtagttaccgttacgtttaccttaccgtaacc

SEQ ID NO: 65169 - DNA, 516 bp, Homo sapiens
  misc_feature: GYAE6OF02G77LP.31.78.H01.1.454.CMB.1.raw
  modified_base (327)..(327): a, c, t, g, unknown or other
  misc_feature (327)..(327): n is a, c, g, or t
  modified_base (345)..(345): a, c, t, g, unknown or other
  misc_feature (345)..(345): n is a, c, g, or t
  modified_base (405)..(405): a, c, t, g, unknown or other
  misc_feature (405)..(405): n is a, c, g, or t
  modified_base (431)..(431): a, c, t, g, unknown or other
  misc_feature (431)..(431): n is a, c, g, or t
  modified_base (504)..(504): a, c, t, g, unknown or other
  misc_feature (504)..(504): n is a, c, g, or t
  modified_base (513)..(513): a, c, t, g, unknown or other
  misc_feature (513)..(513): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttactgggcttctacccgggnatccgggttcctaaccgnttcattggcagcggtctgggaccatttcactctcaccatcagcagcctgcaggctgaagntgtggcagtttatactgtcagcaacnttatactttctttcgtctacgtttcggcggtaagggtaccaggtgagtagtcgaaacgactgtgctgctacgntctgtcttntac

SEQ ID NO: 65170 - DNA, 525 bp, Homo sapiens
  misc_feature: GYAE6OF02GNDDW.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctactaaactcctgatttactgggcttcgtacccgggcacgtccggggttcctaaccgattcattggcagcgggtctgggaccgtatttcactctcaccatcagcagcctgcaggctgaagatgtggctagtttatactgtcagcaatattatacttctttcgtctacgtttcggcggtacggacctaagggtggagatacgaaacgacttgagtctgacactatctgtctctac

SEQ ID NO: 65171 - DNA, 543 bp, Homo sapiens
  misc_feature: GYAE6OF02IZWGY.31.78.H01.1.454.CMB.1.raw
  modified_base (413)..(413): a, c, t, g, unknown or other
  misc_feature (413)..(413): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctacctaaactcctagatttactgggcttcgtacccgggcagtccggggttacctaaccgattcattggcagcgggtctgggaccgatttcactctcaccatcagcagcctgcaggctgaagntgtgactagtttattactgtacagacaatattatactttcttcgtctacgttttcggcggtacggaacctagggtgagtagtaccgaaacgactggtcggtactgaccaccgtatctacgttcttctacc

SEQ ID NO: 65172 - DNA, 587 bp, Homo sapiens
  misc_feature: GYAE6OF02JKZJN.31.78.H01.1.454.CMB.1.raw
  modified_base (314)..(314): a, c, t, g, unknown or other
  misc_feature (314)..(314): n is a, c, g, or t
  modified_base (334)..(334): a, c, t, g, unknown or other
  misc_feature (334)..(334): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgtttattggccccacaataacaactacttagcttggtaccagcagaaagtaggacagcctacctaaactcctagatttacgngggacttccgtaccccgggnacgtccggggttcctaaaccgattcattggcaggtcgggtctggggacctatttcacttctcacctatccagcagcctgcaggctagaagatggtaggctagtttattactgtcacgtcaaactatttacgtactttctttacgtccgttacgttttccgggcgggtaagggtaccaagggtaggacgtataccgtaaacggtaacgtaggtacggtcctaggtaccaccgtatccgtcgttacgttactacg

SEQ ID NO: 65173 - DNA, 601 bp, Homo sapiens
  misc_feature: GYAE6OF02ITCJL.31.78.H01.1.454.CMB.1.raw
  modified_base (317)..(317): a, c, t, g, unknown or other
  misc_feature (317)..(317): n is a, c, g, or t
  modified_base (336)..(336): a, c, t, g, unknown or other
  misc_feature (336)..(336): n is a, c, g, or t
  modified_base (425)..(425): a, c, t, g, unknown or other
  misc_feature (425)..(425): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggccccacaataacaactacttagcttggtaccagcaagaaagtaggacagcctacctaaactcctagatttacgngggtcttccgtacccgggntacgtcccggggttacctaaccgattcattggacaggcgggtctgggacctatttcactctcaccatcagcagcctgcaggctagaagntggtggtactagtttacttacgtgtcacgactaactattacttacctttctttcgtccttacgtttaccgggacgggtacggtaaccgaagggttcggagtaacgttaaccgaaaacggtaaccgttggtacggtacttacggacctaacctagttacctcgttaccttactaccg

SEQ ID NO: 65174 - DNA, 640 bp, Homo sapiens
  misc_feature: GYAE6OF02I5E3J.31.78.H01.1.454.CMB.1.raw
  modified_base (235)..(235): a, c, t, g, unknown or other
  misc_feature (235)..(235): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagacgggccaccatcaactgcaagtccagccagagttnttttattcgccccaacaataacaactacttagcttggtaccagcaagaaagtaggacagcctacctaactcctagtactttacgtggtacttccgtacccggctaacgttcccgggttacctaaccgtacttccgtattcggccgaaggtccgggtccgttacggggaacccgttatttccgaaccgttcctaccgtaaccgtacttccgaacggtccacggtccctaggaccgtacggtacgtagaaacgtagtcgtaggtacctagtttacttacgtcgtacacgactaactattacttacttcgtttacgtacttacgttccggacggtaacggtacgtaaggtcgacgtatacgaaacggtactaggtcgtactagactaccgtatctagttcctataccg

SEQ ID NO: 65175 - DNA, 533 bp, Homo sapiens
  misc_feature: GYAE6OF02GJ2U6.31.78.H01.1.454.CMB.1.raw
  modified_base (529)..(529): a, c, t, g, unknown or other
  misc_feature (529)..(529): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccaccaataacaactacttagcttggtaccagcagaaagtaggacagcctcctaaactcctgatttactgggcttctacccggcatccggggttcctaaccgattcatttgcagcgggtctgggaccgatttcactctcaccatcagcagcctgcaggctgaagatgtggctagtttattactgtcagcaactattatacctttctttccgtctaccgtttcggcggtagggacctaagggtcgagtactaacgaaacgaactggtgctagcaccattctgtcttntacc

SEQ ID NO: 65176 - DNA, 680 bp, Homo sapiens
  misc_feature: GYAE6OF02IXA2M.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagacgggccaccatcaactgcaagtccagccagagttgttttattcggccccaccaataacaactacttagcttggtaccagcaagaaagtaggacagcctacctaaactcctagtactttacgtgggcctttccgtacccgggctacgttcccgggggtttaccctaaacccggtatttccgaagtttcggacctagggccggggttctggggaacccgtattttccgacttcctccaaccctatccgaagtccaacggtcccttacggaccgagggtcctaggaaacgtgtaggttcgggaccgttaagtttttaatttacctgttaccaacgtccaaacgtaatttaacttacctttttcgttttaccgtaccttaaccgttttccggggacgggtaacgggtaaccgaagggtgaggtactaaccgtaaacggtaactggtacgactggaccaaccgtataccgtcgttccttactaccg

SEQ ID NO: 65177 - DNA, 721 bp, Homo sapiens
  misc_feature: GYAE6OF02IUPN5.31.78.H01.1.454.CMB.1.raw
  modified_base (523)..(523): a, c, t, g, unknown or other
  misc_feature (523)..(523): n is a, c, g, or t
  modified_base (625)..(625): a, c, t, g, unknown or other
  misc_feature (625)..(625): n is a, c, g, or t
  modified_base (685)..(685): a, c, t, g, unknown or other
  misc_feature (685)..(685): n is a, c, g, or t
tcagcagtagacgtcacgaccggtgctcgatttagtgtgagtagtttgggtttgggggtaggtcgtacgaacaggcgaggcgagggcgagcgaagagtggtgttgcagacccgaggtcgttcatttctctgttgctctggatctctggtgcctacgggacatcgtgatgagccagtttccagactccctggctgtgtctctgggacgagagggcccacatcaacgtgcaacgtccagccagagtcgtttttattaggcccccaaccaaataaccgaacttacgtagccttaggtaccaggacaagaaacgtaggacacgaccctctaaaacctcctggacttttaacgtcggggactttccgtaaccccgggacattcccgggggtttcccaaaaccgatttacccattcggtccgaaggcccgggtagtttaccggggaccgtaaacttttgtaacccctttacccgaaaccgtctccgaaagggtcaaccggtcccgtacgtcgaacggccgttggaaaanaacgggttgttcgggaaccttagggtttaaacttttatcggtacagtccgaaactatttaaacgttcctttggtttccttacgaccgtttcgtacggggganaaaccggttaacggtgtagtaccgttaacaaacccggacggtttagtaagtcccgggttnacccggttaccaattcttaaccggtttctacctacg

SEQ ID NO: 65178 - DNA, 603 bp, Homo sapiens
  misc_feature: GYAE6OF02GB9EA.31.78.H01.1.454.CMB.1.raw
  modified_base (461)..(461): a, c, t, g, unknown or other
  misc_feature (461)..(461): n is a, c, g, or t
  modified_base (500)..(500): a, c, t, g, unknown or other
  misc_feature (500)..(500): n is a, c, g, or t
  modified_base (586)..(586): a, c, t, g, unknown or other
  misc_feature (586)..(586): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggcctgtctctggcggacgagggccgaccactacaactacgcgaacgtaccacgaccgacgagtgttttattttcggtccccgacccaactaaacaactaacttacgtcttgtaccgacgcagaaagtaaggacgacgacctcctaaacctacctgtatttaacgttcggtcgttccttacccgggcgacttccggggttcccgttaaccgaacgttctacgttggtcgacggtccggggtcgtgggaccgtatttctactctctaccatcacgcagcctancgaggcgtgaagatgtcggctacgtttattactgtcganacaactatttattacttctttacgtctacgtttcggcggacggacaagggtgtagataccaaagaacgtgtggctagccacacttntcgtcttaccattcccg

SEQ ID NO: 65179 - DNA, 527 bp, Homo sapiens
  misc_feature: GYAE6OF02GR45Z.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactactagcttggtaccagcagaaagtaggacagcctcctaaactcctagatttactgggcttctacccgggcactccggggttcctaaccgattcattggcagcgggtctgggaccgatttcactctcacatcagcagcctgcaggctgaagatgtggctagtttatactgtcagcaacattatactttctttcgtctactttcgggcggtaggacctaaggtggagtactacgaaacggaactgtaggcttggacaccatctgtcttctac

SEQ ID NO: 65180 - DNA, 545 bp, Homo sapiens
  misc_feature: GYAE6OF02FZ3I8.31.78.H01.1.454.CMB.1.raw
  modified_base (316)..(316): a, c, t, g, unknown or other
  misc_feature (316)..(316): n is a, c, g, or t
  modified_base (335)..(335): a, c, t, g, unknown or other
  misc_feature (335)..(335): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagaggccaccatcaactgcaagtccagccagagtgttttattcggccccaccaataacaactacttagcttggtaccagcaagaaagtaggacagcctacctaaactcctagtatttacngggccttcgtaccccgggnacgtcccggggttcctaaccgattcattgcagcgggtctgggaccatttcactctcaccatccagcagcctgcaggctagaagatggtgctagtttatactgtcagacaactattactaactttctttcgtctacgtttcggcggacgggacctaagggtgagtactacgaaaaacgtactcggtggactgcaccatcgtcgtcttctac

SEQ ID NO: 65181 - DNA, 553 bp, Homo sapiens
  misc_feature: GYAE6OF02HMOE4.31.78.H01.1.454.CMB.1.raw
  modified_base (318)..(318): a, c, t, g, unknown or other
  misc_feature (318)..(318): n is a, c, g, or t
  modified_base (547)..(547): a, c, t, g, unknown or other
  misc_feature (547)..(547): n is a, c, g, or t
tcagcagtagacgtcacgaccggtgctcgatttagtgtgagtagtttgggtttgggggaggctacaacaggcaggcaggggcagcaagatggtcgttgcagacccaggtcttcatttctctgttgctctggatctctggtgcctacggggacatcgtgatgagccagtttccagactccctggctgtgtcgtctgggcgagacgggccaccatcaactgcaagtccagccagagttgttttattcggccccacaataacaactacttagcttggtaccagccagaaagtaggacagcctcctaaactcctgatttacngggcttctacccgggcactccggggttcctaaccgattcattggcagcgggtctgggaccgatttcactctcaccatcagcagcctgcaggtctgaagtatggtgctagtttatactgtcagcaatcttatactttcgttcgtactacgttttcggcgggtacggaccgtaagggtagagattaccgaaacgtactaggtacggctgcctacctattcctgttcccgtntacccg

SEQ ID NO: 65182 - DNA, 559 bp, Homo sapiens
  misc_feature: GYAE6OF02I04T1.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgtttattggccccacaataacaactactagcttggtaccagcagaaagtaggacagcctacctaaactcctagatttactgggtcttccgtacccgggcacgtccggggttcctaaccgattcattggcagcgggtctgggacctattcactctcaccatcagcagcctgcaggctgaagatgtggactagtttattactgtcagcaactattatacttctttacgtctacgtttcggacggtacgggacctaagggtggagtacgtacgaaaacggtacctaggtaggtaccgtgaccaaccgtagttcctcggttccttactaccg

SEQ ID NO: 65183 - DNA, 577 bp, Homo sapiens
  misc_feature: GYAE6OF02GZNVE.31.78.H01.1.454.CMB.1.raw
  modified_base (355)..(355): a, c, t, g, unknown or other
  misc_feature (355)..(355): n is a, c, g, or t
  modified_base (396)..(396): a, c, t, g, unknown or other
  misc_feature (396)..(396): n is a, c, g, or t
  modified_base (402)..(402): a, c, t, g, unknown or other
  misc_feature (402)..(402): n is a, c, g, or t
  modified_base (417)..(417): a, c, t, g, unknown or other
  misc_feature (417)..(417): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggccccacaataacactactagcttggtaccagcaagaagtaggacacgcctacctaaactcctgatttacgtgggcttcgacccgggcacgttccggggttacctaaccggtnttcattggcaggtcgggtcgtgggaccgtatttccacttcnccaccntcagcacgcctgccnggctgaagatggtagctagtttactacgtcgtacgacgactaactattatacttctttacgtctacgtttcggcggtacggtacctagggtacgagactacgaaacgtaacgtggtacggtacctggacctaaccgtattcgttacgttccttactaccg

SEQ ID NO: 65184 - DNA, 510 bp, Homo sapiens
  misc_feature: GYAE6OF02HA7HP.31.78.H01.1.454.CMB.1.raw
  modified_base (311)..(311): a, c, t, g, unknown or other
  misc_feature (311)..(311): n is a, c, g, or t
  modified_base (345)..(345): a, c, t, g, unknown or other
  misc_feature (345)..(345): n is a, c, g, or t
  modified_base (508)..(508): a, c, t, g, unknown or other
  misc_feature (508)..(508): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttacngggcttcacccgggcatccggggttcctaaccgnttcattggcagcgggtctgggaccgatttcactctcaccatcagcagcctgcaggctgaagatgtcggctagtttattactgtcagcaacattatactttctttcgtctactttcggcggaggaccagggtgagatcgaaacgatgtgctgcacatctgtctnac

SEQ ID NO: 65185 - DNA, 565 bp, Homo sapiens
  misc_feature: GYAE6OF02JMMMW.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacactacttagcttggtaccagcagaaagtaggacagcctactaaactcctagatttactgggcttccgtaccgggcagttcccggggttacctaaaccggtattcattcggcaggcgggttctgggaccgtatttcactcctcaccatcagcacgcctgcacggctgaagtatggtcgactagtttattactgtcagacaactattatacttcgtttacgtctacgtttcgggcggtaggaccgtaaggtaggagtatacgaaacgtaacttggtacggtactagaccacctagtcgtcgttacttacctacg

SEQ ID NO: 65186 - DNA, 556 bp, Homo sapiens
  misc_feature: GYAE6OF02F86RR.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttactgggcttctacccgggcacgtccggggttcctaaccgattcattggcagcgggtctgggaccgatttcactctcaccatcagcagcctgcaggctgaagatgtggctagtttatactgtcagcaactattattaccttctttcgtctacgtttcggaccggtaggaccgtaagggtcggagagtaccgaaaacggtacgttaggtaggtccgtaggccgtaacctagttcgtcgttccttactacc

SEQ ID NO: 65187 - DNA, 571 bp, Homo sapiens
  misc_feature: GYAE6OF02GPTN5.31.78.H01.1.454.CMB.1.raw
  modified_base (566)..(566): a, c, t, g, unknown or other
  misc_feature (566)..(566): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggccccaacaataacaactacttagcttggtaccagcaagaaagtaggacagcctacctaaactcctgatttacgtgggtcttccgtaccccggggctacgtcccggggttacctaaccgattcaattcggcaggcgggtctgggacctatttcactctcacatcagcacgctgcaggctagaagagtgtggctagtttattacttgtcagactaactattaacttactttctttctacgtacgtttcgggacggtacgggtaacaagggtgagactacgaaacgtaactaggtggtactcgacctacgtattcctgttaccttntaacc

SEQ ID NO: 65188 - DNA, 589 bp, Homo sapiens
  misc_feature: GYAE6OF02IW2LB.31.78.H01.1.454.CMB.1.raw
  modified_base (305)..(305): a, c, t, g, unknown or other
  misc_feature (305)..(305): n is a, c, g, or t
  modified_base (319)..(319): a, c, t, g, unknown or other
  misc_feature (319)..(319): n is a, c, g, or t
  modified_base (335)..(335): a, c, t, g, unknown or other
  misc_feature (335)..(335): n is a, c, g, or t
  modified_base (351)..(351): a, c, t, g, unknown or other
  misc_feature (351)..(351): n is a, c, g, or t
  modified_base (365)..(365): a, c, t, g, unknown or other
  misc_feature (365)..(365): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacgggacatcgtgatgagccagtttccagactccctggctgtgtctcgtggcgagagggccaccatcaactgcaagtccagccagagtgttttatgcccacaataacaactactagcttggtaccagcagaaagtggacagcctactaaactcctgatttacnggcttcgacccggnagtccgggtacaacgnttcattgcagcggtcngggactattcactnaccacatcagcagcctgacgagctagaagagtgtagactaaggttttactacgtggtacaagtactaaacctatttaacgtacctttcgtttacgtacgtaaccggtttcggaccgggtaaggtaacccgtaagggtccgagtaacgttaccgaaaacggtaaccttgggtacggaccttcgaacccgtaaccgtagttccgttacggttctttaccgtaaccc

SEQ ID NO: 65189 - DNA, 567 bp, Homo sapiens
  misc_feature: GYAE6OF02JFAV6.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggcccccaaccaataacaactacttagcttggtaccagcaagaaagtaggacagcctacctaaactcctgactttacgtgggcttccgtaccccggggcacgttcccgggggttaccctaaaccggtattcagttggcaggcgggtctgggacccgtatttcactctcaccatcagcagcctgcaggctgaagatggtgctagtttatactgtcagacaactattatacctttctttcgtctacgtttccgggacggacgggtaaccaagggtcgagtatacgaaacggtaactaggtggctgacctacctatctcgtcttctacc

SEQ ID NO: 65190 - DNA, 536 bp, Homo sapiens
  misc_feature: GYAE6OF02I7S9H.31.78.H01.1.454.CMB.1.raw
  modified_base (398)..(398): a, c, t, g, unknown or other
  misc_feature (398)..(398): n is a, c, g, or t
  modified_base (515)..(515): a, c, t, g, unknown or other
  misc_feature (515)..(515): n is a, c, g, or t
  modified_base (524)..(524): a, c, t, g, unknown or other
  misc_feature (524)..(524): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacaactacttagcttggtaccagcagaaagtaggacagcctacctaaactcctagtactttacgtgggtcttccgtacccgggcacgttcccggggttacctaaccgtacttcattggcagcgggtctgggacctatttccactcncaccatcagcacgcctgcagctagaagatgtaggctagtttacttactgtacagcaactattattaccttctttcgtctaccgtttggacgacggacaggtgagatacgaagactgngtctgcacntctgttctctac

SEQ ID NO: 65191 - DNA, 564 bp, Homo sapiens
  misc_feature: GYAE6OF02HRA6E.31.78.H01.1.454.CMB.1.raw
  modified_base (363)..(363): a, c, t, g, unknown or other
  misc_feature (363)..(363): n is a, c, g, or t
  modified_base (424)..(424): a, c, t, g, unknown or other
  misc_feature (424)..(424): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagaggccaccatcaactgcaagtccagccagagttgttttattgcccacaataacaactacttagcttaggtaccagcaagaaagtaggacagcctactaaactcctgactttactgggcttcgtaccgggcatccggggttcctaacgattcattggcagcggtcngggaccagtttcactctcacatcagcagcctgcaggctgaagatgtggctagtttattacngtcagcaactattattaccttctttcgtctacgtttcggacggtacggaaccgtaagggtgagaacttaccgaaaacggtaaccttggtacgggaccttggacctaacccgtacttccgtacgttcctttaccgtaaccg

SEQ ID NO: 65192 - DNA, 536 bp, Homo sapiens
  misc_feature: GYAE6OF02FOTH8.31.78.H01.1.454.CMB.1.raw
  modified_base (533)..(533): a, c, t, g, unknown or other
  misc_feature (533)..(533): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggccccaacaataacaactacttagcttaggtaccagcagaaagtaggacagcctacctaaactcctagatttactgggcttcgtacccgggcagtccgggttcctaaccgattcattgcagcgggtctgggaccgtattcactctcaccatcagcagcctgcaggctagaagtatgtagctagtttatacgtgtcagacaactattactacttctttcgtctacgtttcggcggtaggacgagtggagataccgtaaacggattggtgtctgactactattctcgttcttntac

SEQ ID NO: 65193 - DNA, 893 bp, Homo sapiens
  misc_feature: GYAE6OF02GZ380.31.78.H01.1.454.CMB.1.raw
tcagcagtagacgtcacgaccggtgctcgatttagtgtgagtagtttggtttgggggagcgtacaacgaggcccacggcgtacgggcgagtcaagattggtgttgcagacccaggtcttcattctctagttgctctggagtcttcgtcgtgccgtacgggtacgttacttcgttgacttagttaaggcctacgtttccaggtacgtcccgtggcctggtcgttcgtcgtagggtccgaggggagggccctaccgtactacgaaccgttggggccctaaggtcccaacgccctacggtaggttggtttttaacttcgggcccccctaacgtaaacgtaaacctaaccttacctttagaccgtttaggttaacccaggacctaagtaaaggtacggaaccgtacggtccccgtacccgtaaaacgtcccctaggtaacgttttaaccggtcgggtacctttaccgtaccccggggtactaccgttacccggggtttaccttaaaccggtaatttaccgtaagtttcgggaccgtaaacggtaccgggttacttacggggtaaacccgttaagttttacccgaacccgttaccttacccgtaaccgtaagttaccggaacgtaccgtaacgtccctacgtacgtaccggtaccgtaacggtaaacgtaacgttacggtaacggtaccgttaacgtttaacgtttaaccgttcgttaccgtaacgtaacgtaaccgtaacgtttaacgttaccttttacgtttaccgttaccgtacgttttaccgggacgggtacggtaaccggtaacggtggtacgtacgttaccgtaaacggtaacgtaggtaggtacgtacgtacgtaccgttagttacggttacggttaccgttacgtaccgg

SEQ ID NO: 65194 - DNA, 514 bp, Homo sapiens
  misc_feature: GYAE6OF02JBUTX.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccaccaataacaactacttagcttggtaccagcagaaagtaggacagcctcctaaactcctagattactgggcttctacccgggcatccgaggttcctaaccgattcattggcagcggtctgggacgatttcactctcaccatcagcagcctgcaggctgaagatggtggctagtttattactgtcagcaacattatactttctttcgtctacgtttcggcggtagggaccaaggtgagtagtacaaacgactgtgctgcacatctgtctc

SEQ ID NO: 65195 - DNA, 583 bp, Homo sapiens
  misc_feature: GYAE6OF02IX29K.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacaactacttagcttggtaccagcagaaagtaggacagcctacctaaactcctagatttacgtgggcttccgtacccgggcaacgttcccggggtttacctaaaccggatttcagtttcggcaggcgggtctgggaccgtatttcactctcaccatcagcacgcctgcaggctgaagtatggtgactagtttatactgtcagcaatattattactttctttacgtctacgtttcgggacggtacgggtaaccaagggtggataacgtaccgaaacggtaacgttgggtacggtacgttcgacctacctagttccgtacgttccttctaccg

SEQ ID NO: 65196 - DNA, 661 bp, Homo sapiens
  misc_feature: GYAE6OF02FRAVQ.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctcgtggtcgccgtacggggacatcgtgatgacgcctagtttccagacctcccgtggctgtgtctcgtgggcgaggacggcccacatcaacgtgacaacgtccagccagtagttgttttagttccggacccccaaccaaataaaccaacttacttagtcttacggaaccagacaaggaaaggtacggacacgccctacctaaacctcctagtactttacgcgggtccttaccggtacccgggctacggttcccggggttacctaaccgtattcgtagttcggacacgggtccgggttcgtacggggtaaccttacgttttccacttcctaccaacctatccgacgcacgtcctgacgaggctagaagtagtggtcggacttaagtttactacgttcgtacacgtacaactattactactttctttacgtcttacgttcgggacggtacggtaaccgtagggtcggagacgtaacgtaaacgtacgtggtacggtacgtacgacctacctagtcgtcgttccttagtaccc

SEQ ID NO: 65197 - DNA, 641 bp, Homo sapiens
  misc_feature: GYAE6OF02H06DS.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctctgggcgagagggccaccatccaatgcaagtccagccagagttgttttattcgacccccacaaataacaactacttagctggtaccagcagaagtagacagcctacctaaactcctgattacgtggccttcgtacccgggcacgttccgggttacctaaccggattcagttggcagtcgggtctgggacctatttccacgtctacaccatcacgcacgcccgtgaccaggctaggaaacgtagtcggtacggacttaagttttactacgttcgttacgagacctaaactaactttaagttaccctttcttttaccgtaccgtacgttttcgggaccgggtaaacgggaaccgtaaaggggttacggaacgtactaacgaaaaccggtacgttacggtaggtaccgtaggtacccaaccctagtttaccgtacggttaccttccgttaaccg

SEQ ID NO: 65198 - DNA, 570 bp, Homo sapiens
  misc_feature: GYAE6OF02J2LT9.31.78.H01.1.454.CMB.1.raw
  modified_base (411)..(411): a, c, t, g, unknown or other
  misc_feature (411)..(411): n is a, c, g, or t
  modified_base (551)..(551): a, c, t, g, unknown or other
  misc_feature (551)..(551): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagaggccaccatcaactgcaagtccagccagagttgttttattcggccccaacaataacaactacttagcttggtaccagcaagaaagtaggacagccctacctaaactcctagatttacgtgggccttccgtacccggggctaacgtcccggggttaccctaaccgtattccagttcggcaggcgggtctgggacctatttccactcctcaccntcagcagcctgcaggctagaagtatgtggactagtttactacgtgtacagtacaactattacttaccttctttacgacttacgttcggacggtacgaacgaggtcgagtactacgaaacgtatagtcgtactcgaccacnctactcgtacttactaccg

SEQ ID NO: 65199 - DNA, 574 bp, Homo sapiens
  misc_feature: GYAE6OF02JHKCW.31.78.H01.1.454.CMB.1.raw
  modified_base (409)..(409): a, c, t, g, unknown or other
  misc_feature (409)..(409): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgtttatttggcccaccaataacaactacttagctggtaccagcagaaagtaggacacgcctacctaaactcctgattactggctctacccggcatccgggtcctaaccgattcattcgcgacgcggtcgtcgggaccgatttcactctacaccatcagcagccgtgcgaggctggaanagtcgtggctagtttatacgtgtcagcaactattactacttctttacgactacgtttcggacgggtacggaacctaagggttgagtactaaccgtaaaacggaaccttgggtacggtccgttacgacccgtaaccctaattccgtttacggttctttacctaccg

SEQ ID NO: 65200 - DNA, 526 bp, Homo sapiens
  misc_feature: GYAE6OF02GRCZE.31.78.H01.1.454.CMB.1.raw
  modified_base (410)..(410): a, c, t, g, unknown or other
  misc_feature (410)..(410): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttactgggcttctacccgggctagtccggggttcctaaccgattcattggcagcgggtctgggacctatttcactctcaccatcagcagcctgcaggctgaagntgtggctagtttatactgtcagcaatattatacttctttcgtctacgtttcggcggaggaccaagggtggagactacgaaacgactggtgctgaccaccgtatcgtgttcttctac

SEQ ID NO: 65201 - DNA, 581 bp, Homo sapiens
  misc_feature: GYAE6OF02IWFTR.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtctccatttctctgttgctctggatctctggtgccgtacggggacatcgtgatgagccagtttccagactccctggctgtgtctctgggcgagagggccaccatcaactgcaagtccagccagagttgttttattcggccccacaataacaactacttagcttggtaccagcagaaagtaggacagcctacctaaactcctagatttactgggcttcgtaccgggcacgtccggggttacctaacgattcagttggacaggcgggtctgggaccatttcactctcacatcagcagcctgcaggctagaagatggtcggactaagtttattactgtcagactaactattattacctttctttcgtacttacgttcgggtacggacggtaaccgagggtcgagtaactacggaaaaccggtaacttgggtacggtcgtacggaccctaacgtattaccgtcgttaccttgtaacccg

SEQ ID NO: 65202 - DNA, 557 bp, Homo sapiens
  misc_feature: GYAE6OF02GRFEK.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagccctctaaactcctgactttacgtgggctttccgtacccggggcacgttcccgggggttaccctaaccggtattcactttggcaggcggggtctggggaccgtatttcactctcaccatcagcagcctgcaggctagaagatgtggctagtttattactgtacagacaactattatactttctttcgtctacgtttcggcggtaggaccgaagggtgagactacgaaacgtactggtacggctagacaccgattctgttccttatacg

SEQ ID NO: 65203 - DNA, 732 bp, Homo sapiens
  misc_feature: GYAE6OF02H10NZ.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggcccccacaataacaactacttagcttggtaccagcagaaagtaggacagcctacctaaactcctgatttacgtcgggtcttccgtacccgggctacgtcccggggttacctaacccgtacttaccgtagttcggcgtacggtccggggtcgtcggggtaacccgtacttttccgaccttcctccaaccctatccgaacgccgacgcccgtacggccgacggccttaggaaacgtacgttggtaggtaccgttaagttttaacgtttacgttacgttacctaagtacctaaaccgttaatttaactttaccttttaccgttttaccgtttaccttaccgttttcccggggaccgggtaaacggggtaacccgtaaaggggtacgggaacgtaacgttaacccgaaaaccggtaaccgttagggtaccggtaccgttaccggaccctaacccgtactttacccgttacggtttcccttacccgttaacccg

SEQ ID NO: 65204 - DNA, 575 bp, Homo sapiens
  misc_feature: GYAE6OF02IUFX9.31.78.H01.1.454.CMB.1.raw
  modified_base (300)..(300): a, c, t, g, unknown or other
  misc_feature (300)..(300): n is a, c, g, or t
  modified_base (311)..(311): a, c, t, g, unknown or other
  misc_feature (311)..(311): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaacncctgatttacnggcttctacccgggcagtccggggttactaaccgattccattcgcagcggtctgggacctattcactctcacatcagcagctgcaggctagaagatggtgctagtttattacgtgtcaagtcaacgtattattacctttctttacgtctaccgttttcgggcggtaacgggaccgtaagggtgtagaacgtaccgtaaaacggtaacctaggttcggtaccgttagaccgtaacctaattccgtacgttcccgttacgtacccg

SEQ ID NO: 65205 - DNA, 568 bp, Homo sapiens
  misc_feature: GYAE6OF02ILLXY.31.78.H01.1.454.CMB.1.raw
  modified_base (452)..(452): a, c, t, g, unknown or other
  misc_feature (452)..(452): n is a, c, g, or t
tcagcagtagacgtcacgaccggtgctcgatttagtgtgagtagtttgggtttggggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggccccacaataacaactacttagcttggtaccagcagaaagtaggacagccctacctaaactcctagtatttactgggccttcgtacccgggcacgttccggggttacctaaccggattcgatttcggcaggcgggtctgggacccgtattttccacttctacacctatcagcagcctgcaggctagaagatgtggctagtttattacngtcagacaatattacttactttcttcgtctacgtttcggacggacggaccgtaaggtggagtaacgtacgaaacgtaacgtgtacggctcgacactatcgttcgttacctctaccg

SEQ ID NO: 65206 - DNA, 544 bp, Homo sapiens
  misc_feature: GYAE6OF02I4S7Q.31.78.H01.1.454.CMB.1.raw
  modified_base (315)..(315): a, c, t, g, unknown or other
  misc_feature (315)..(315): n is a, c, g, or t
  modified_base (331)..(331): a, c, t, g, unknown or other
  misc_feature (331)..(331): n is a, c, g, or t
  modified_base (385)..(385): a, c, t, g, unknown or other
  misc_feature (385)..(385): n is a, c, g, or t
  modified_base (398)..(398): a, c, t, g, unknown or other
  misc_feature (398)..(398): n is a, c, g, or t
  modified_base (492)..(492): a, c, t, g, unknown or other
  misc_feature (492)..(492): n is a, c, g, or t
tcagcagtagacgtcacgaccggtgctcgatttagtgtgagtagtttgggtttgggggtaggcgtacaacaggcaggcaggggcagcaagatggtgttgcagacccaggtcttcatttctctgttgctctggatctctggtgcctacggggacatcgtgatgagccagtttccagactccctggctgtgtctctgggcgaagagggccaccatcaactgcaagtccagccagagtgttttattggccccacaataacaatactagcttggtaccagcaagaaataggacagcctacctaaactcctagatttacngggcttctacccgggnatccggggttcctaaccgattcattggcagcgggtctgggacccgatttcactntccacatcagcancctgcaggctagaagatgtggcagtttaatactgtccagtcaacattactactttcttcgtctactttcggcggtaggtaaccaagggtcgganaacgtcgaaaacgaactcggagcttagcacctaagtctaggtcttacttccg

SEQ ID NO: 65207 - DNA, 542 bp, Homo sapiens
  misc_feature: GYAE6OF02I3ZU2.31.78.H01.1.454.CMB.1.raw
  modified_base (312)..(312): a, c, t, g, unknown or other
  misc_feature (312)..(312): n is a, c, g, or t
  modified_base (432)..(432): a, c, t, g, unknown or other
  misc_feature (432)..(432): n is a, c, g, or t
  modified_base (505)..(505): a, c, t, g, unknown or other
  misc_feature (505)..(505): n is a, c, g, or t
  modified_base (520)..(520): a, c, t, g, unknown or other
  misc_feature (520)..(520): n is a, c, g, or t
  modified_base (531)..(531): a, c, t, g, unknown or other
  misc_feature (531)..(531): n is a, c, g, or t
  modified_base (533)..(533): a, c, t, g, unknown or other
  misc_feature (533)..(533): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgtttattcggccccacaataacactacttagcttggtaccagcagaaagtaggacagcctcctaaactcctagactttacngggtcttccgtacccgggctaacgtccggggttcctaaacccggattccgaagtttcgggcctaggtcgggtctggggacctagtttcactctcaccatcagcagcctgcaggctgaagntgtggctagtttatactgtcagcaactattactactttcttcgtctacgtttcggcgtaggaccaaggtgganatcgtaaacgatggngctagactacntntgtctctac

SEQ ID NO: 65208 - DNA, 553 bp, Homo sapiens
  misc_feature: GYAE6OF02FPXJ1.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctacctaaactcctgtactttactgggcttcgtacccggggctacgttcccggggttcctaaaccgattccagttggcagcgggtctgggaccgtatttcactctcaccatcagcagcctgcaggctgaagatgtgctagtttatacgtgtcagcaactattatactttcttcgtctacgtttcggcggtacggtacgaaggtggacgtagtacgaaacgtacgtggtacggcgtgaccaccgtagttcctagttcttatacc

SEQ ID NO: 65209 - DNA, 605 bp, Homo sapiens
  misc_feature: GYAE6OF02JCHUD.31.78.H01.1.454.CMB.1.raw
  modified_base (423)..(423): a, c, t, g, unknown or other
  misc_feature (423)..(423): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgtttattggccccacaataacaactacttagcttggtaccagcagaaagtagacagcctacctaaactcctgatttactgggcttccgtacccgggctacgtcccggggttacctaaccgtattcatttcggcaggtccgggtctggggaccctatttccactctcaccatcagcagcctgcaggctgaagntgtcggctagtttattacgtgtcacgtcaactatttatacctttctttacgttctaacgttttcgggacgggtaacgggtaaccgtaagggtcggacgtaactaccggaaaacggtaaccgttacggttgggtaccgtggtaccctacccgtaagttccgttggttaccctttactaacccg

SEQ ID NO: 65210 - DNA, 759 bp, Homo sapiens
  misc_feature: GYAE6OF02JT9O1.31.78.H01.1.454.CMB.1.raw
  modified_base (390)..(390): a, c, t, g, unknown or other
  misc_feature (390)..(390): n is a, c, g, or t
  modified_base (411)..(411): a, c, t, g, unknown or other
  misc_feature (411)..(411): n is a, c, g, or t
  modified_base (433)..(433): a, c, t, g, unknown or other
  misc_feature (433)..(433): n is a, c, g, or t
tcagcagtagacgtcacgaccggtgctcgatttagtgtgagtagtttgggttgggggagctacaacaggcaggcaggggcagcgaagtatggtgttgctagacccaggtcttcatttctctgttgctctggatctctggtgcctaggggacatcgtgtatgagcctagtttccagacctccctggctggtgtctcgtgggcgagagggcccaaccgagtcgaacttggaccaaaggttcccaagggccctaaggacgtttcgtttttacttcgggaccccctaactaaattaaccaaccttacttaaggcctttcgggtaaacccctaggacctaaaggtaaaagtagggaacaggtaccctaccgtaaactccgtagaacttttaccgngggtaccttacgacccgggtnacgttccggggtacctaacggnttcgagttcggactaggtcgggtacgtagggaccctaattttccaacgttcctactaacccgtataccgaacggccgtacgtcccgtacgaccgtagggtccctaaggaaacgtattacgggtacgacttaacggtttacttacgtacgttacgacgtacctaacgttaatttacgtactttaccgtttacgtaccgttaaccgttccgggaccgggtaacggaaccgtaagggtcgtaagtaccgtaaccgtaaacggtaagttcggtaggtaccgttacgacccgttaccgtaagtttccggtactttaccgttacttacccgg

SEQ ID NO: 65211 - DNA, 534 bp, Homo sapiens
  misc_feature: GYAE6OF02H067J.31.78.H01.1.454.CMB.1.raw
  modified_base (304)..(304): a, c, t, g, unknown or other
  misc_feature (304)..(304): n is a, c, g, or t
  modified_base (354)..(354): a, c, t, g, unknown or other
  misc_feature (354)..(354): n is a, c, g, or t
  modified_base (418)..(418): a, c, t, g, unknown or other
  misc_feature (418)..(418): n is a, c, g, or t
  modified_base (421)..(421): a, c, t, g, unknown or other
  misc_feature (421)..(421): n is a, c, g, or t
  modified_base (423)..(423): a, c, t, g, unknown or other
  misc_feature (423)..(423): n is a, c, g, or t
  modified_base (432)..(432): a, c, t, g, unknown or other
  misc_feature (432)..(432): n is a, c, g, or t
tcagcagtagacgtcacgaccggtgctcgatttagtgtgagtagtttgggtttgggggtaggctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggcccctacaataacaactacttagcttggtaccagcagaaagtaggacagcctcctaaaacncctgatttactgggccttctaacccgggcagtccggggtttcctaaacgnttacattggcagcgggtctgggaccgattttcactctcaccatcagcagcctgcagctgaaagntgngnagtttatangtcagacaactattattacttcttcgtctacgttcggcggaggaacaaggtgagtactacgaaacgtactgtcgctagactacctattcctgttccttacac

SEQ ID NO: 65212 - DNA, 665 bp, Homo sapiens
  misc_feature: GYAE6OF02JY0WO.31.78.H01.1.454.CMB.1.raw
  modified_base (271)..(271): a, c, t, g, unknown or other
  misc_feature (271)..(271): n is a, c, g, or t
  modified_base (297)..(297): a, c, t, g, unknown or other
  misc_feature (297)..(297): n is a, c, g, or t
  modified_base (311)..(311): a, c, t, g, unknown or other
  misc_feature (311)..(311): n is a, c, g, or t
  modified_base (324)..(324): a, c, t, g, unknown or other
  misc_feature (324)..(324): n is a, c, g, or t
  modified_base (340)..(340): a, c, t, g, unknown or other
  misc_feature (340)..(340): n is a, c, g, or t
  modified_base (384)..(384): a, c, t, g, unknown or other
  misc_feature (384)..(384): n is a, c, g, or t
  modified_base (502)..(502): a, c, t, g, unknown or other
  misc_feature (502)..(502): n is a, c, g, or t
tcagcagtagacgtcacgaccggtgctcgatttagtgtgagtagtttgggtttgggggtaggcgtacaacaggcaggcgaggggcgagcaagatggtgttgcagacccaggtcttcatttctctgttgctctggatctctggtgcctacggggacatcgtgatgagccagtttccagactccctggctgtgtctctgggcgaggacgggccaccagtcaactgcagtccagccagagttgttttattcggccccacaataacaactactancgttggtacagcaagaacgtaggacngacctacctaaacncctagatttacgnggtcttcacccgggtnactccggggttacctaaccggattcgattggacaggtacgggtntacggggaccctagtttccactcgttaccactatccagtccagcctgcgacggtactacgaaggtagtcggtcggtacgtagttttaacttacttcgggttcaacgctaaaaccgttntttaaacttcctttccgttttaaccgtcttaacccgttttcgggtaccgggaacgggtaacccgttaaggggtacgtaaggtacgtttaacgaaaacccgggttaatcgggttacgtacgtccgtaaccgtaccgtacttgtttaccgttccgttactacccg

SEQ ID NO: 65213 - DNA, 545 bp, Homo sapiens
  misc_feature: GYAE6OF02IB5XE.31.78.H01.1.454.CMB.1.raw
  modified_base (530)..(530): a, c, t, g, unknown or other
  misc_feature (530)..(530): n is a, c, g, or t
  modified_base (541)..(541): a, c, t, g, unknown or other
  misc_feature (541)..(541): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactcctggctgtgtctctgggcgagaggaccaccatcaactgcaagtccagccagagtgttttattcggccccaaccaataacaactacttagcttggtaccagcagaaaagtaggacagcctcctaaaactcctgatttacgtggcttctaccgggcactccggggttcctaaccgattcattggcagcgggtctgggaccgtattcactctcaaccatcagcagtccctagcaggctagaagactgtggactagtttaattactgtcacgtcaaactattaatactttctttcgtctacgtttcggacggtaggaccgtaaggtggagactacgaaacgtactgtaggctgacacngtactgtactntacg

SEQ ID NO: 65214 - DNA, 564 bp, Homo sapiens
  misc_feature: GYAE6OF02GUPTW.31.78.H01.1.454.CMB.1.raw
  modified_base (312)..(312): a, c, t, g, unknown or other
  misc_feature (312)..(312): n is a, c, g, or t
  modified_base (327)..(327): a, c, t, g, unknown or other
  misc_feature (327)..(327): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccacatcaactgcaagtccagccagagtgtttattcggcccacaataacaactactagcttggtaccagcaagaaagtaggacagcctacctaaactcctgtatttacgnggcttcgacccgggnacgtcccgggttcctaaccgattcagttcggacaggtcgggtctcgggacctatttcacttctacacctatcagcacgcctgcgaggctagaagatgtggactagtttattacgtgtcacgacaactaattacttactttctttacgtctacgtttcggacggtaacggtactaagggtgacgtacgtacgtaaacgtacgtagtcggtactgaccaccgtatcctgttcctgtacc

SEQ ID NO: 65215 - DNA, 761 bp, Homo sapiens
  misc_feature: GYAE6OF02H22UE.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggaccccacaataacaactacttagcttggtaccagcaagaagtaggacagcctacctaaactcctagtatttacgtgggtccttccgtaaccccgggctaacgttcccgggggtttacctaaaccgtactttcagtttcggcctagggtccggggttactcgggggtaacccgtaattttccgaaccttccttaccaaccctaattccgaacgtcctacgtcccgttacggaccgtaacgggtcctaggaaacggtaattcgggtacgggtacgttaaggttttaacgtttaacgttcggttactaacggtacctaaaccttaagttttaactttaaccttttaccgttttccgttaacccgttaccggtttttaccggggaccggggtaaaccgggtaaaccgtaaggggttacggtagtaaccgttaaccggtaaaaaccggttaaccgttagggtacggtaccgttacggaccgtaacccgtagttaccgttacggtttcctttaccgttaacccg

SEQ ID NO: 65216 - DNA, 843 bp, Homo sapiens
  misc_feature: GYAE6OF02H8H6K.31.78.H01.1.454.CMB.1.raw
  modified_base (422)..(422): a, c, t, g, unknown or other
  misc_feature (422)..(422): n is a, c, g, or t
tcagcagtagacgtcacgaccggtgctcgatttagtgtgagtagtttgggtttgggggagctacaacaggcaggcgaggggcagcaagagtggtgttgcacgacccaggtcttctatttctctgttgctcgtggatctcgtggtcgccgtacggggacagtcgtgatgacgcctagtttccagacctcccgtggctgtcgtctcgtgggcgaggcggccacatacaacgtgacaacgtccgagccagtacgttgttttacgttcgacccccaactaaactaacaaccttacgttacgtacgttacggacagacgaaaggaaaaggtacggacacgtaccctaacctaaactccgtagtactttacggtcgggtccttaccggaccccgggtactaccgggttcccgggttaacctaaccgtnttaccgtaggttcggaccgtacgggtccggggtacgtaccgggtacccgttattaccgccgttaccctacctaacccgtacgtccgaacggtaccctaacggtccgtacggacgtaacgggtaccgttaagggaaaggttacggtacggggttacgggttaaccgttttaaaggttttaacctttacggttacggttaccgtaaacggtacctaaaacttaagtttttaaccgtttacctttttcccgtttaaccggttacccgttaaccgggttttaccggggaaccggggtaaacggtaacccggtaaggggtacggtaacggttaacgtaacccggtaaaacggtaccggttcgggtaccggttacgtaccggaaccctaccgtacgttcccgttcggtttacccttaccgttacccg

SEQ ID NO: 65217 - DNA, 525 bp, Homo sapiens
  misc_feature: GYAE6OF02GANCG.31.78.H01.1.454.CMB.1.raw
  modified_base (415)..(415): a, c, t, g, unknown or other
  misc_feature (415)..(415): n is a, c, g, or t
  modified_base (522)..(522): a, c, t, g, unknown or other
  misc_feature (522)..(522): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccaccaataacaactacttagcttggtaccagcagaaagtaggacagcctcctaaactcctgatttactgggcttctacccgggcatccggggttcctaaccgtattcagttggcagcgggtctgggaccgatttcactctcaccatcagcagcctgcaggctgaagatggnggctagtttaattactgtcagctaacatttaatactttctttcgtcctacgtttcggcggaggaccaaggtgagatacgaaacgatcgtgctgacacatctgtcttntac

SEQ ID NO: 65218 - DNA, 681 bp, Homo sapiens
  misc_feature: GYAE6OF02FKS8K.31.78.H01.1.454.CMB.1.raw
  modified_base (312)..(312): a, c, t, g, unknown or other
  misc_feature (312)..(312): n is a, c, g, or t
tcagcagtagacgtcacgaccggtgctcgatttagtgtgagtagtttgggtttggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacaactacttagcttggtaccagcagaaagtaggacagcctactaaactcctgtatttacncgggtcttccgtacccgggctacgttcccggggttaccctaaccggattcctaagtttcggcctaggtccggggtcgttacggggacccgtattttaccgaccttctaccgaccacttccaacgcacgacctggccgagggtccttaggaaaggtattgggtacggacttaggttttaactttaaccgtgttaccgagtactaactaagtttattaccttttccttttcgttaccttaccgttttaccggggacggtaacggggtaacccgtaagggtacggtaagacgttaaccggaaaacgtaaccgtagggttcggtaccgtaggacctaacccgtagttcccggttacgttccttaccttacccg

SEQ ID NO: 65219 - DNA, 548 bp, Homo sapiens
  misc_feature: GYAE6OF02F7RHW.31.78.H01.1.454.CMB.1.raw
  modified_base (421)..(421): a, c, t, g, unknown or other
  misc_feature (421)..(421): n is a, c, g, or t
  modified_base (446)..(446): a, c, t, g, unknown or other
  misc_feature (446)..(446): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactactagcttggtaccagcagaaagtaggacagcctacctaaactcctgatttactgggcttcgtacccgggctacgttccggggttacctaaccggattcagttggcaggcgggtcgtggggaccgtatttcactctcaccatcagcagcctgcaggctagaagngtggtggctagtttattactgtcancaactatttactacttctttcgttctacgtttcggtggaggaccgtaggtggagtatacgaaacgtaacgtggtacgcgtagcacctatctgttccttctac

SEQ ID NO: 65220 - DNA, 585 bp, Homo sapiens
  misc_feature: GYAE6OF02HET05.31.78.H01.1.454.CMB.1.raw
  modified_base (341)..(341): a, c, t, g, unknown or other
  misc_feature (341)..(341): n is a, c, g, or t
  modified_base (395)..(395): a, c, t, g, unknown or other
  misc_feature (395)..(395): n is a, c, g, or t
tcagcagtagacgtcacgaccggtgctcgatttagtgtgagtagtttgggtttgggggaaggctacaacaggcaggcaggggcagcaagatggtgttgcagacccaggtcttcactttctctgttgctctggatctctggtgcctacggggacatcgtgatgagccagtttccagactccctggctgtcgtctctgggcgagagggccaccatcaactgcaagtcagccagagtcgttttaattggccccacaataacaactactaagcttaggtaccagcagaaacgtaggaacaggtacctacctaaactcctagatttacgtgggcttcgtacccggnacgtccggggttcctaaccgattcagttcggacaggtcgggtctgggaaccgtntttcactctcgaccatcagcacgtctgcgaggctggaagagtgtaggctagtttattacgtgtactacgataactaattactactttacttacgttcgtaacgtttcggcggtaaggacgtaagggtcggagagtacgaaacgtacgtggtacgtcgtacggacacgaacttcgtacgttcctacctccg

SEQ ID NO: 65221 - DNA, 641 bp, Homo sapiens
  misc_feature: GYAE6OF02IODRZ.31.78.H01.1.454.CMB.1.raw
  modified_base (338)..(338): a, c, t, g, unknown or other
  misc_feature (338)..(338): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgtgctctggatctctggtgcctacggggacatcgtgatgagcctagtttccagctccctggctgtgtctcgtgggcgagaggccaccatcaactgcaagtccagccagagttgttttattcgaccccacaataaacaactacttagcttaggtaccagacaagaagtagacagccctacctaaaactcctgtattacgtggaccttcgtaaccccgggntaatcccggggttacctaacggacttctagtacggtcacgtcgggtctagggaccctatttccaactcgtacacccatctacgacgacgcctgacacggtacgtagtaacgaagtcggtaggtactagtttacgttactcgtaccacgtactaaccgtaatttactactttaccgtttcgtaccgttacgttttacgggccggaagggtacccgaaggtaccggtagaactacgaaacgtaacggtcgtacggtacctacggtccgtaaccctacgttacgttacgttacgttaccgtaaccc

SEQ ID NO: 65222 - DNA, 606 bp, Homo sapiens
  misc_feature: GYAE6OF02HIY8M.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagttgttttattcggccccacaataacaactacttagcttggtaccagcaagaaagtaggacagcctacctaaactcctagtatttacgtgggtcttccgtacccgggctacgttcccggggttacctaaccgtattcagttcggcaggcgggtcgtaggggaccgtatttcactctacaccatcagcacgcctgcgaggctagaagtatggtgtactagtttacttacgtgttacagtacaaactatttaacttacctttctttcgttacgttaccgtttacgggacgggtaacggtaaccgtaagggtggacgtaagtaacgaaacggtacgtggtacggtctaggaccaccgtattccttgttaccttcgtacc

SEQ ID NO: 65223 - DNA, 603 bp, Homo sapiens
  misc_feature: GYAE6OF02GVU2P.31.78.H01.1.454.CMB.1.raw
  modified_base (436)..(436): a, c, t, g, unknown or other
  misc_feature (436)..(436): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagttgttttattcggccccacaataacaactacttagcttggtaccagcaagaaagtaggacagcctacctaaactcctagtatttacgtgggtccttccgtacccgggctacgttcccggggttaccctaaccggtattcacgttcggcaggcgggtctcgggaccgtatttcactctcaccatcagcagcctgcgaggctgaagngtggtgacttagtttatacgttgtcagactaactattacttactttctttccgtactacgtttcgggacggtaacggtaaccgtaagggtacggtagtacgtaacgaaacgtaacgttcggtacggtacctacggaccctactagttccgtacgttaccttctaccg

SEQ ID NO: 65224 - DNA, 571 bp, Homo sapiens
  misc_feature: GYAE6OF02IECOO.31.78.H01.1.454.CMB.1.raw
  modified_base (276)..(276): a, c, t, g, unknown or other
  misc_feature (276)..(276): n is a, c, g, or t
  modified_base (355)..(355): a, c, t, g, unknown or other
  misc_feature (355)..(355): n is a, c, g, or t
  modified_base (424)..(424): a, c, t, g, unknown or other
  misc_feature (424)..(424): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgaggagggccaccatcaactgcaagtccagccagagttgttttattcggccccacaataacaactacttagcttggtaccngcagaagtaggacagcctacctaaactcctgatttactgggcttccgtacccgggctacgtccggggttcctaaccggnttcattggcagtcgggtcgtgggaccgatttcacgtctcaccatcagcagcctgcaaggctagaacgtntgtggctaagtttactactgtcagacaactagttattactttctttcgtcttaacgttcgggacggacgggaaccgtaagggtgtacgataacgaacgtaccgtggttcggcgtcgacctaacctagttccgtcgtaccttcgtacc

SEQ ID NO: 65225 - DNA, 526 bp, Homo sapiens
  misc_feature: GYAE6OF02GKNA2.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttactgggcttctacccgggcagtccggggttcctaaccgattcattggcagcgggtctgggaccgtatttcactctcaccatcagcagcctgcaggctgaagatggtggctagtttattactgtcagcaactattatactttctttcgtctacgtttcggcggaggacctaagggtggagatacgaaacgtaactggtggctgcacatctgtcttctac

SEQ ID NO: 65226 - DNA, 553 bp, Homo sapiens
  misc_feature: GYAE6OF02G6L3M.31.78.H01.1.454.CMB.1.raw
  modified_base (549)..(549): a, c, t, g, unknown or other
  misc_feature (549)..(549): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggccccacaataacaactacttagcttggtaccagcagaaagtaggacagcctcctaaactcctgatttacgtgggcttcgtacccgggctacgtcccggggttacctaaccgtattcattcggcaggcgggtctgggaccgtatttcactctcaccatcagcagcctgcgaggctagaagatgtggctagtttacttactgtcagctaactattatactttctttcgttctacgtttcggacggtacggaccgtaagggtgagtacgtacgaaacgtactggtggctgctacctagttctcgttctntacc

SEQ ID NO: 65227 - DNA, 604 bp, Homo sapiens
  misc_feature: GYAE6OF02IL54E.31.78.H01.1.454.CMB.1.raw
  modified_base (414)..(414): a, c, t, g, unknown or other
  misc_feature (414)..(414): n is a, c, g, or t
  modified_base (430)..(430): a, c, t, g, unknown or other
  misc_feature (430)..(430): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagttgttttattcggcccccacaataacaactacttagcttaggtaccagcaagaaagtaggacacgcctacctaaactcctgtatttactgggccttccgacccgggcacgttcccgggttacctaaccggtattcagttggcaggtcgggtctcgggactatttcactctcacactcagcacncctgcaggctagaagntggtggactagtttattactgtacagacaactattattaccgtttctttaccgtacttaccgtttacgggcgggtaacgggtaaccgaagggttggacgtaagttaaccgaaacggtaaccgttgggtacggacgttacgacctaccgtaactcgttcggttccttacgtaccg

SEQ ID NO: 65228 - DNA, 584 bp, Homo sapiens
  misc_feature: GYAE6OF02IS9FW.31.78.H01.1.454.CMB.1.raw
  modified_base (349)..(349): a, c, t, g, unknown or other
  misc_feature (349)..(349): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagacgggccaccatcaactgcaagtccagccagagttgtttattcggccccacaataacaactactagcttggtaccagcaagaaagtagacagcctactaaactctgtattacgtgggcttcgacccgggcacgtccgggttacctaacgnttcagttcgcgagtcggtcgtgggacctatttcactctcaccatacagcacgcctgcgaggctagaagagtgtggactagtttattacgtcgtacagactaatattattactttactttcgtactaccgtttcgggacggtacgggtaaccgtaagggtacggagtacgtaaccgaaacgtaacgtgggtacgacgtacggacctaccgtacgttccgttacgttccttactacc

SEQ ID NO: 65229 - DNA, 569 bp, Homo sapiens
  misc_feature: GYAE6OF02GK3PD.31.78.H01.1.454.CMB.1.raw
  modified_base (316)..(316): a, c, t, g, unknown or other
  misc_feature (316)..(316): n is a, c, g, or t
  modified_base (335)..(335): a, c, t, g, unknown or other
  misc_feature (335)..(335): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacaactactagcttggtaccagcaagaaagtaggacagcctacctaaactcctgtaatttacgngggctttcgtacccggggntacgtcccggggttacctaaccgattcagtttggcaggcgggtctgggaccctatttcactctcaccatcagcagcctgcaggctaggaagagtggtcggctagtttacttactgtacagcaactatttactactttctttcgtactacgtttcgggcggtagggacctaagggtagagactacgaaacgtagtcgtacggtctcggactacctagtccgtagttacctctacg

SEQ ID NO: 65230 - DNA, 552 bp, Homo sapiens
  misc_feature: GYAE6OF02JLBBX.31.78.H01.1.454.CMB.1.raw
  modified_base (324)..(324): a, c, t, g, unknown or other
  misc_feature (324)..(324): n is a, c, g, or t
  modified_base (399)..(399): a, c, t, g, unknown or other
  misc_feature (399)..(399): n is a, c, g, or t
  modified_base (417)..(417): a, c, t, g, unknown or other
  misc_feature (417)..(417): n is a, c, g, or t
  modified_base (424)..(424): a, c, t, g, unknown or other
  misc_feature (424)..(424): n is a, c, g, or t
  modified_base (427)..(427): a, c, t, g, unknown or other
  misc_feature (427)..(427): n is a, c, g, or t
  modified_base (440)..(440): a, c, t, g, unknown or other
  misc_feature (440)..(440): n is a, c, g, or t
  modified_base (501)..(501): a, c, t, g, unknown or other
  misc_feature (501)..(501): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaaactgcaagtcccagccagtagtgttttattcggcccccaccaaataaccaacgtacttagcttggtaaccagcaagaaagtaggaacacgcctactaaactcctgatttacngggctttcacccgggcagttccgggtcctaacgattcaattggcaggcggtctgggacccgtatttccgatcctnaccatcagcacgcctgcngctgaantgngctagttcttacngtcagcaactattaacttacttcctttgtacctacgtttcgcgggtagaaccgtaggtganagttacgaaacgacttggtacgccgtgctaccgtatcgtgttacttctacg

SEQ ID NO: 65231 - DNA, 563 bp, Homo sapiens
  misc_feature: GYAE6OF02F5PWK.31.78.H01.1.454.CMB.1.raw
  modified_base (313)..(313): a, c, t, g, unknown or other
  misc_feature (313)..(313): n is a, c, g, or t
  modified_base (404)..(404): a, c, t, g, unknown or other
  misc_feature (404)..(404): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacaactacttagcttggtaccagcagaaagtaggacagcctacctaaactcctgatttacngggcttcgtacccgggcacgtccggggttacctaaccgtattcattggcagcgggtctgggaccgtatttcactctcaccatcagcagccngcaggctgaagagtgtggctagtttatacttgacacgacaaactattattactttcgttttctaccttacgtttccgggacggacgggtaaccgaagggttggagtactacgaaacggtaactcggtaggtctagacctactatcgttcgttctcgtac

SEQ ID NO: 65232 - DNA, 651 bp, Homo sapiens
  misc_feature: GYAE6OF02JBGT7.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctcgtgggcgaggagggccacatcaactgcaagtccagccagagttgtttattcggcccacaataacactactagcttaggtaccagcaagaagtaggacagcctacctaaactcctagtatttacgtgggtaccttaccgtaccccgggataacgttcccggggttacctaacccggtatttaccgaagtttcggactacggtccgggttaccgtaggggacccgttaatttccgaacctctacacctatccagccagcctgcaggctagaacgagtaggtgtctaagtttacttacgtcgtacacgactaactaagtttacttacttctttaccgtctacgttttaccgggaccggtaaaggtaacccgtaagggtacggaacgtagtaccgtaaacggaacctttaggtacggtacgttcgaccgtaccgtacgtttcgtacgtttaccttccgtaaccg

SEQ ID NO: 65233 - DNA, 544 bp, Homo sapiens
  misc_feature: GYAE6OF02G9C5U.31.78.H01.1.454.CMB.1.raw
  modified_base (422)..(422): a, c, t, g, unknown or other
  misc_feature (422)..(422): n is a, c, g, or t
  modified_base (532)..(532): a, c, t, g, unknown or other
  misc_feature (532)..(532): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcaagaaagtaggacagcctacctaaactcctgtatttacgtgggccttcgtaccccggggctacgtcccggggttacctaaccgattcattggcaggcgggtctgggacctatttcactctcaccatcagcagcctgcaggctgaagngtgtggctaggtttattactgtcagcaactattatactttctttcgtctacgtttcggacggtacggacctaagggtggagactacgaaacgtacttgtggctgacaccntctgtcttctac

SEQ ID NO: 65234 - DNA, 580 bp, Homo sapiens
  misc_feature: GYAE6OF02HWWD5.31.78.H01.1.454.CMB.1.raw
  modified_base (324)..(324): a, c, t, g, unknown or other
  misc_feature (324)..(324): n is a, c, g, or t
  modified_base (339)..(339): a, c, t, g, unknown or other
  misc_feature (339)..(339): n is a, c, g, or t
  modified_base (352)..(352): a, c, t, g, unknown or other
  misc_feature (352)..(352): n is a, c, g, or t
  modified_base (380)..(380): a, c, t, g, unknown or other
  misc_feature (380)..(380): n is a, c, g, or t
  modified_base (394)..(394): a, c, t, g, unknown or other
  misc_feature (394)..(394): n is a, c, g, or t
  modified_base (416)..(416): a, c, t, g, unknown or other
  misc_feature (416)..(416): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctctgggcgagagggccaccatcaactgcaagtccagccagagtgttttattggccccacaataacaactacttagcttggtaccagcaagaaaagtggacagcctcctaaactcctgattactggctcacccggnagtccgggtcaacgntcatgcagcggtngggaccatttcactctcaccatcagcancctgcagcagaagntagtgacagtttaattacgttnacgtacacgtaactagttaacttactttcgtttacgtctaaccgttttcggacgggtaacggtaaaccgtaacgggttaggaacgtactaacgtaaaacgtaaaccgttgggtacggtacctcggaccgtaccctaagttcccttggttaccttaccttaaccg

SEQ ID NO: 65235 - DNA, 132 bp, Homo sapiens
  misc_feature: GYAE6OF02I1Q76.31.78.H01.1.454.CMB.1.raw
  modified_base (131)..(132): a, c, t, g, unknown or other
  misc_feature (131)..(132): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggann

SEQ ID NO: 65236 - DNA, 535 bp, Homo sapiens
  misc_feature: GYAE6OF02GCYSL.31.78.H01.1.454.CMB.1.raw
  modified_base (411)..(411): a, c, t, g, unknown or other
  misc_feature (411)..(411): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgtatttactgggcttctacccgggcatccggggttcctaaccgattcattggcagcgggtctcgggaccgtatttcactctcaccatcagcagcctgcaggctgaagntgtggctagtttatactgtcagcaactatttactactttctttcgtctacgttttcggcggtacggactaaggtgagatacgaaacgtactagtggtctgccactacttcgtcgttactctacg

SEQ ID NO: 65237 - DNA, 547 bp, Homo sapiens
  misc_feature: GYAE6OF02I6ERO.31.78.H01.1.454.CMB.1.raw
  modified_base (375)..(375): a, c, t, g, unknown or other
  misc_feature (375)..(375): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttactggcttcgtacccgggcagtccggggttcctaaccgattcattggcaggcgggtctgggaccgtntttcactctcaccatcagcagcctgcaggctagaagatggtggctagtttacttactgtcagtacaactatttatactttctttcgtctaccgtttcgggcggtacggaccaagggtgagagtacgaaacgtactggtcggtctgacctacctattcgtcgttccttctacg

SEQ ID NO: 65238 - DNA, 581 bp, Homo sapiens
  misc_feature: GYAE6OF02HZTWC.31.78.H01.1.454.CMB.1.raw
  modified_base (335)..(335): a, c, t, g, unknown or other
  misc_feature (335)..(335): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattggccccacaataacaactacttagcttggtaccagcaagaaagtaggacagcctacctaaactcctagtatttacgtgggtcttcgtacccgggnacgttccggggttacctaacgattcattcggcaggtcgggtctcgggacctagtttccactctcaccatcagcagcctgcaggctagaagtatggtaggactagtttattactgtacagacaactattactactttctttcgtctacgttcggacgggaggaccgtaagggtgagtagtaccgaaaacgtacgttggtacggtacctaggacctaaccgtattaccgttcgttcccttactaaccg

SEQ ID NO: 65239 - DNA, 846 bp, Homo sapiens
  misc_feature: GYAE6OF02JC4GZ.31.78.H01.1.454.CMB.1.raw
  modified_base (205)..(205): a, c, t, g, unknown or other
  misc_feature (205)..(205): n is a, c, g, or t
tcagcagtagacgtcacgaccggtgctcgatttagtgtgagtagtttgggtttgggggtaggtcgtacgaacaggcaggcaggggcgagcaagatggtgttgcagacccaggtcttcatttctctgttgctctggatctctggtgcctacggggacatcgtgatgagccagtttccagactccctggctgtgtctctgggcgagngggccaccatcaactgcaagtccagccagagttgttttattcggcccctaaccaataaccaactacttagcttggtaccagcagaaagtaggacagcccttacctaaactcctagacttttacgcgggtctttaccgtaccccggggcaacggttcccgggggtttacccaaaccggtacctttcgaacgttttcggaccaacggggttccggggttaccgttagggggtaacccgtaccttttttaccggaaccttccccgtttacccaaacccgtaacgtttacccgaaggtacccgtaaccgggtacccccttacgggtacccgaacggggtacccgtaacggtaaacgggtacgttacgggttacgggtacgtttaacggtttttaacgtttaccgtttcgttaaccgtaacggtaccctaaacgttaactttaacgttacccttttaccgttttaccggtttaaccgttaccgttttacccggggtaaccgggttaacgggtaaacccgtaagggggttacggtacgttaacggtaaccgttaaaaaccggttaaaccggtttacggtaacgggttaccgttaggtaaccccgttaacccgtaagttacccgtttcgttaccgtttacttaacccg

SEQ ID NO: 65240 - DNA, 518 bp, Homo sapiens
  misc_feature: GYAE6OF02FV690.31.78.H01.1.454.CMB.1.raw
  modified_base (516)..(516): a, c, t, g, unknown or other
  misc_feature (516)..(516): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccaccaataacaactacttagcttggtaccagcagaaagtaggacagcctcctaaactcctgatttactgggcttctacccgggcagtccggggttcctaaccgattcattggcagcgggtctgggaccgattcactctcaccatcagcagcctgcaggctgaagatgtggctagtttatactgtcagcaactattactacttcttcgtctacgtttcggcggaggaccaaggtgagatacgaaacgactaggtgctagcaccatctgtcttnac

SEQ ID NO: 65241 - DNA, 696 bp, Homo sapiens
  misc_feature: GYAE6OF02GD1MD.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagaggccaccatcaactgcaagtccagccagagtgttttattcggccccacaataacaactactagcttggtaccagcaagaaagtaggacagcctacctaaactcctagtactttactgggcctttccgtaccccgggtctaacgttcccgggggtttaccctaaaccggtatttcgtacgtttcggaccagggtccggggttcctcgggggaacccgtattttccaacgttcctaccaaccctatccgaacgccacgtccctgaccgaggtcctaggaaacgtattcggtcggtacttaaggttttaacttacgttcgtaccgaacgtacctaaacttactttaacttaccttttcgttttaccgttaccgttaccggttttccgggacgggtaacgggtaaccgtaaggggtacggtaagtacgttaaccgaaaacggtaacgttggtacggtacttacggacctaaccgtacgttcttacgttaccttacttaccg

SEQ ID NO: 65242 - DNA, 541 bp, Homo sapiens
  misc_feature: GYAE6OF02H6FH0.31.78.H01.1.454.CMB.1.raw
  modified_base (314)..(314): a, c, t, g, unknown or other
  misc_feature (314)..(314): n is a, c, g, or t
  modified_base (353)..(353): a, c, t, g, unknown or other
  misc_feature (353)..(353): n is a, c, g, or t
  modified_base (390)..(390): a, c, t, g, unknown or other
  misc_feature (390)..(390): n is a, c, g, or t
  modified_base (516)..(516): a, c, t, g, unknown or other
  misc_feature (516)..(516): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaatgcaagtccagccagagttgttttattggccccacaataacaactacttagcttggtaccagcaagaaagtaggacagcctacctaaactcctagatttacnggtcttccgtacccgggctacgtccgggttcctaaccgnttcagttcggcaggcggtctgggacctatttcactcncaccatcagcagcctgcgaggctgaagatgtggactagtttattactgtcagacaatattatacttctttcgtactacgtttcggcggaggtaccgaggtgagactacgaaacgtactggtacgcncgacacctagttctcgtctataccg

SEQ ID NO: 65243 - DNA, 625 bp, Homo sapiens
  misc_feature: GYAE6OF02H3BXR.31.78.H01.1.454.CMB.1.raw
  modified_base (381)..(381): a, c, t, g, unknown or other
  misc_feature (381)..(381): n is a, c, g, or t
  modified_base (570)..(570): a, c, t, g, unknown or other
  misc_feature (570)..(570): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgacgcctagtttccagactccctggctgtgtctcgtgggcgaggacgggccaccgatcaactgacaagtccagccagagttgttttatcggccccaacaattaacaaccttacgttacgcttcggtacagcaagaaagtagacagcctaccctaaactcctagtacttacgtcgggtacttccgaacccgggctaacggtccccggggtttacctaaaccgnttaccgaagttcggccgtagggccgggttacgtcggggaacccgtattttaccacgtccttcaacctagtcaagccacggcctagccacggtctagaacggtatggcgtataggtttaatcgttgacgagacaactatttactacgtttctttcgtactacgttcgggacgtaggaccgtaggtcgganacgttaccgaaagtactcggagtacgcgacgactgtaccttcggtcttacgtccg

SEQ ID NO: 65244 - DNA, 839 bp, Homo sapiens
  misc_feature: GYAE6OF02JCAQ3.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacaactacttagcttaggtaccagcaagaaagtaggacagcctacctaaactccgtagtatttacgtgggtcttccgtaccccggggctaacggttcccgggggtttaccctaaacccggtatttaccgaagtttcgggacgtaacgggtccgggggttccgttacggggggtaaccccgttaacgttttttccgaacctttcccgttacccgaacccctaacttacccgaacggtacccgaacggtccccgttaggacccgtaacggggtaccttagggaaaacggtagtttagggttcgggtaccgtttaaaggttttttaacgtttaccgtttacggttacccgtaacggtaccctaaaacgtttaacgttttaaactttaacccgttttcccgtttttaccgttaccgtttacccggtttttaccggggaccggggtaaaccggggtaaaccgtaacgggggttacggaacgtaacgttaaccggtaaaaccggtaaccgttacggggttaccggaccgtttaacggacccgtaaccgttaccgtttacccggtttacggtttaccgtttacccgtaacccgg

SEQ ID NO: 65245 - DNA, 780 bp, Homo sapiens
  misc_feature: GYAE6OF02J2Z4H.31.78.H01.1.454.CMB.1.raw
  modified_base (401)..(401): a, c, t, g, unknown or other
  misc_feature (401)..(401): n is a, c, g, or t
tcagcagtagacgtcacgaccggtgctcgatttagtgtgagtagtttgggtttggggagctacaacaggcaggcagggcagcaagatggtgttgcagacccaggtcttcattctctgttgctctggatctctggtgccgtacgggacatcgtgatgacgcctagtttccagtcctccctggctgtcgtctcgtgggacagacggccaccagtccaactgacaacgtccaagccagtagtttgttttacgtccggacccctaaacaaataaacctaacttacgttacgctttacggaaccagaccgtaaaggtaaaacgtacggactaccgtacccttaaccctaaaacgttccgtagtaacgttttaccggcgggttaccctttaccggaaccccggggtntaccggttaccccggggtttacctaaaacgtcgttcgtaacggttcgggacctacggggtccgggttacgtacggggaaccccttatttccaaccgttcctaccgaacctacgtcgaagtcccgacgtcccgtaccggtacgtacggtacgtacggtaaacgtacgttacggtacggtaaccgttaagtttacgtttaccgtacgttaccgtaacgtaacctaacgttaaacgtttaccttacctttaccgtttaccgttaccgtaccggttttaccgggacgggtaaccggaacgtaagggtacgtacgtaacgtacgtaaacgtacgtacggtcgtacgtcgaccgtacctacgttacctacgttcctacgtacccg

SEQ ID NO: 65246 - DNA, 601 bp, Homo sapiens
  misc_feature: GYAE6OF02GL0X5.31.78.H01.1.454.CMB.1.raw
  modified_base (431)..(431): a, c, t, g, unknown or other
  misc_feature (431)..(431): n is a, c, g, or t
  modified_base (450)..(450): a, c, t, g, unknown or other
  misc_feature (450)..(450): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggcccacaataacaactacttagcttggtaccagcagaaagtaggacagcctacctaaactcctgtactttactgggaccttcgtaccccgggcaacgttcccggggttacctaaccggattcattggcaggcgggtctgggaccgtatttcactcgtaccaccatccagcacgccctgcaggctgaaagntggtggctagtttatactntcagcaatattatactttctttacgtctacgtttccgggacggtaacgggtaccgtaagggtacggagtaacgtaaccgaaaaccggtaacgttcggtacgggtacttacggaccaacccgttactaccgttcggtttacccttctaaccg

SEQ ID NO: 65247 - DNA, 621 bp, Homo sapiens
  misc_feature: GYAE6OF02JVEVF.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggccccacaataacaactacttagcttggtaccagcaagaaagtaggacagcctacctaaactcctagtactttacgtgggtacctttccgtaacccggggctacgttccccgggggtttaccctaaaccggtattccagttcgggcctaggggtccgggttcgtacgggggaacccgtattttccgaacttcctaccaaccctatccacgccacgcctgcaggctagaagtatggtaggactagtttacttactgtacacgtacaactaattacttactttctttacgtctaccgtttcggacggtaacgggaccgtaagggtggagtataaccgaaacgtacgtggtcggctagaccacctatctcgttcctactacg

SEQ ID NO: 65248 - DNA, 864 bp, Homo sapiens
  misc_feature: GYAE6OF02IWDZF.31.78.H01.1.454.CMB.1.raw
  modified_base (321)..(321): a, c, t, g, unknown or other
  misc_feature (321)..(321): n is a, c, g, or t
  modified_base (342)..(342): a, c, t, g, unknown or other
  misc_feature (342)..(342): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagacgggccaccatcaactgcaagtccagccagtagtgttttattcggccccaacaataacaactacttagcttggtaccagacaagaaagtaggacagccctactaaactcctagactttacgngggtccttccgtaccccgggntacgttcccggggttacctaaaccggtatttccgaagttcggacctaagggtcccggggttcttacggggggaaccccttagtttttccgaaccttcccgttacccaaaccccgtaatttacccgaacggtacccgtaaccggtccccgttacggaccggtaaccggggtaccgtttaacgggaaaacgggtaacgtttacgggttacggggtaacccgtttaaaggttttttaaacgtttaaccgtttacggttacccgtaacggtaacctaaaaccttaaacgttttaaacgttttaaccgtttttaccgtttttacccgtttacccgttaacccggttttttacccgggggaaccggggttaaaccggggtaaaccccggtaaaggggttacgggtaacggtaacgttaaacccggtaaaaaccgggtaaccgtttacggggttaacgggtacccgttaacggtacccgttaacccgtaacgtttcccggtttacggttaccgtttacccgttaacccg

SEQ ID NO: 65249 - DNA, 570 bp, Homo sapiens
  misc_feature: GYAE6OF02GV1RE.31.78.H01.1.454.CMB.1.raw
  modified_base (314)..(314): a, c, t, g, unknown or other
  misc_feature (314)..(314): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacaactacttagcttggtaccagcaagaaagtaggacagcctacctaaactcctgatttacngggtcttacgtacccgggctagtcccggggttacctaaccgtattcattggcaggcgggttctgggaccgtatttcactctcaccatcagcagcctgacagctagaaagagtgtcgctagtttatactgtacagactaactattacttactttctttacgtactacgtttcggaccggaggtaaccgtagggtcggtagtacttaacgaaacgtaactggtacggcgtagaccacctattccgtgttccttatacc

SEQ ID NO: 65250 - DNA, 541 bp, Homo sapiens
  misc_feature: GYAE6OF02IIFEY.31.78.H01.1.454.CMB.1.raw
tcagcagtagacgtcacgaccggtgctcgatttagtgtgagtagtttgggtttgggggagctacaacaggcaggcaggggcagcaagatggtgttgcagaaccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcaagaaagtaggacagcctcctaaactcctgtattactgggtcttcacccgggcagtccggggttcctaaccgattcattggcagcgggtctgggaccgtatttcactctcaccatcagcagctgcaggctgaagatgtggctagtttactactgtcagcaactattattacttctttacgtctacgtttcggcggtaacggaccgaagggtgagtagtacgaaacgtactggtacgctacggacaccgtatccgtgttcctatacc

SEQ ID NO: 65251 - DNA, 561 bp, Homo sapiens
  misc_feature: GYAE6OF02GTCVQ.31.78.H01.1.454.CMB.1.raw
  modified_base (439)..(439): a, c, t, g, unknown or other
  misc_feature (439)..(439): n is a, c, g, or t
  modified_base (555)..(555): a, c, t, g, unknown or other
  misc_feature (555)..(555): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttactgggcttctacccgggcatccggggttcctaaccgattcattggcagcgggtctgggaccgatttcactctcaccatcagcagcctgcaggctagaagatgtggctagtttatacgtgtcagcaaactnttactactttctttcgtctaccgttttcgggcggtacgggaacctaagggtggtacgagtaccgaaaacggtaacgttggtcggaccttaggccaaccgagttccgtgttcccttntacccg

SEQ ID NO: 65252 - DNA, 605 bp, Homo sapiens
  misc_feature: GYAE6OF02IOCPR.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactcctggctgtgtctctgggcgagagggccaccatcaactgcaagtccagccagagtgtttattggccccacaataacaactactagcttggtaccagcagaaagtaggacagcctacctaaactcctagacttttacgtggggcctttaccgtaaccccggggctaacgttccccgggggttttaccctaaacccggtatttccgaagtttcgggaccaagggtccggggttccgttgggggaacccgtattttccaacttcctacaacccatccaagcacgccctgcgaggctagaagatgtacggctagtttattacgtgtacagacaactattatactttctttcgtctacgtttcggtacggacggtaaccgaaggtaggagatacgaaacgtaacgtgtaggacgtgacactatctcgtctactac

SEQ ID NO: 65253 - DNA, 614 bp, Homo sapiens
  misc_feature: GYAE6OF02I5B5R.31.78.H01.1.454.CMB.1.raw
  modified_base (337)..(337): a, c, t, g, unknown or other
  misc_feature (337)..(337): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactactagcttggtaccagctagaaagtaggacagacctcctaaaactcctagaactttacgagggcttcgtaaccccggggnacttccgggggttacctaaccggattcaatttcgggacagtcgggtctggggaacccgattttccgacttccgtctaaccagttcaacggctaacgccctagcgaggcttagaagtattcgtggcctaggttttaattcgtagtcaacgcaacgtattacttaactttcctttacgtcctacttttcgggacggtaacgggtaaccgaaggttgaggaacttaccgaaacgtaacgtggtagcgttaggaccgacctagtctaggtccttacgtacg

SEQ ID NO: 65254 - DNA, 565 bp, Homo sapiens
  misc_feature: GYAE6OF02HPQ23.31.78.H01.1.454.CMB.1.raw
  modified_base (315)..(315): a, c, t, g, unknown or other
  misc_feature (315)..(315): n is a, c, g, or t
  modified_base (435)..(435): a, c, t, g, unknown or other
  misc_feature (435)..(435): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagaggccaccatcaactgcaagtccagccagagtgttttattcggccccacaataacaactacttagcttggtaccagcaagaaagtaggacagcctactaaactcctagactttacgngggtcttccgtacccgggcacgttccggggttacctaaccgtattcagttggcacggcgggtctcgggacctatttcgactctcacctatcacgcacgccgtcgacacggctagaaacgngttgtacggacgtagtttaacttacgtgtacagactaacgtattacttacttctttacgtctacgtttcggcggtacggacaggtgagtatacgaaacgactgtgctgacactacttctcgttctctacg

SEQ ID NO: 65255 - DNA, 541 bp, Homo sapiens
  misc_feature: GYAE6OF02HHK6D.31.78.H01.1.454.CMB.1.raw
  modified_base (348)..(348): a, c, t, g, unknown or other
  misc_feature (348)..(348): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctacctaaactcctagatttactgggcttctacccgggcatccggggttcctaaccgnttcattggcagcgggtctgggaccgatttcactctcaccatcagcagcctgcaggctgaagatgtgctaggtttattactgtcagcaactattattactttctttcgtctacgtttcggacggaggacctaagggtcgagataccgtaaacgaacttggtaggtctgaccaccattctacgttcttactaccg

SEQ ID NO: 65256 - DNA, 691 bp, Homo sapiens
  misc_feature: GYAE6OF02I13EM.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacaactacttagcttggtaccagcagaaagtaggacagcctacctaaactcctgtactttactgggcttaccgtaccccgggctacgttcccggggttacctaaccgtatttaccagtttcggctaagggtccggggttcgtacggggtacccgtaattttccaaccgttccttaccaaccctaattaccaaggccaacggtccctggaccgacgggtcctaggaaacgtagttacggtcgggtcttaaggttttaacttacgttagtaccaacgtacctaaacttaatttaacttacccgttttcgttttaccgtccttaccggtttaccgggcggggtaacggtaacccgtaagggtacgagtaactaacgtaaaacggtaacgttggtacggtacgtacgacctaccgtacttcccttaggttcccttacgtaccg

SEQ ID NO: 65257 - DNA, 616 bp, Homo sapiens
  misc_feature: GYAE6OF02HCBYG.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggccccacaataacaactacttagcttggtaccagcagaaagtaggacagcctacctaaactcctagatttacgtgggtccttccgacccggggcacgttcccggggttacctaaccgattcagttcggcaggtcgggtcgtgggacctatttcactctcaccatcagcacgcctgcaggctagaagatggtagctagttttacttacgtcgtacacgtactaactattaacttactttacgttttcgtaccttacgtttccgggacggtacgggtaaccgtaagggttcggaacgtacgtaaccgtaaaaccggtaacgttgggtacggtactacggacctaaccgtagttccgttacggttccttactacccg

SEQ ID NO: 65258 - DNA, 680 bp, Homo sapiens
  misc_feature: GYAE6OF02J3BMG.31.78.H01.1.454.CMB.1.raw
  modified_base (376)..(376): a, c, t, g, unknown or other
  misc_feature (376)..(376): n is a, c, g, or t
  modified_base (621)..(621): a, c, t, g, unknown or other
  misc_feature (621)..(621): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagcctagtttccagacctccctggctgtgtctcgtgggcagaggccaccatcaactgcaagtccagccagtagttgttttattcggacccccaacaataacactactagcttggaccagcaagaaagtggaccagccctacctaactcctagtactttacgcgggtcttccgaccccggggtctaaccgggttcccgggttaccctaaaccggttnttacgtacgttcggaccgtcggggtccgggtacggtacggggtaaccttacgtttccactccgtaccaactactcgaagcctacgcctgacgacgacgtagaagcgttggtcgtacttagtttctacgtgtacctaagacctaacttatttacctttaccgtttcgtttacgtaccggtttacggttaccggggaccggtaacggaacgtaggggttacgtacaacgtaaccgaaaaccgggttntacgggtagtacccgtacgaccgttaccgagtttccgttaccggttcctaccttacccg

SEQ ID NO: 65259 - DNA, 609 bp, Homo sapiens
  misc_feature: GYAE6OF02G3ODS.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagtgttttattcggccccacaataacaactacttagcttggtaccagcaagaaagtaggacagccctacctaaactcctagtactttactgggtccttccgtacccgggctacgttcccggggttacctaaccgattcagttcggctaggcgggtctgggaccgtatttcactctacaccatcagcagcctgcgagctagaagtagtgtgctagtttactactgtacagactaactattacttacctttcgtttacgtccttacgtttcgggacggtaacggaaccgtaagggtcgtaagtactaaccgaaaacggtaccgttgggtacggtccgttacggaccctaaccgtagttaccgtacgtttaccttactacccg

SEQ ID NO: 65260 - DNA, 562 bp, Homo sapiens
  misc_feature: GYAE6OF02FZBV2.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagaggccaccatcaactgcaagtccagccagagtgttttattggccccacaataacaactacttagcttggtaccagcagaaagtaggacagcctcctaaactcctgatttactgggcttctacccgggcatccggggttcctaaccgattcattggcagcgggtctgggaccatttcactctcaccatccagtagcctgcaggctagaagatgtggctagtttattactgtcagcaaactattaactactttctttcgtactactttcaacgtcggagggaacctaagggtggaagtagtaaccgaaaacgtaaccgttggtacggtacgtacggacctaaccgacttcgtgttccttactaccg

SEQ ID NO: 65261 - DNA, 809 bp, Homo sapiens
  misc_feature: GYAE6OF02JUGJZ.31.78.H01.1.454.CMB.1.raw
tcagcagtagacgtcacgaccggtgctcgatttagtgtgagtagtttgggtttgggggtaggcgtacaacaggcaggcaggggcgagcaagatggtgttgcagacccaggtcttcatttctctgttgctctggatctctggtgcctacgggacatcgtgatgagccagtttccagactccctggctgtgtctctgggcgagagggccaccatcaactgcaagtccagccagagttgttttattcggcccctaacaataacctaactaacttagacttcggtaaccagcaagaaagtaggacaagtcctacccgtaaactcctagtactttacgcgggtcctttaccgtaccccgggactaggttccccgggggtttaaccctaacgtattccgtacgtttggaccaggtccgggttaccgtcgggggaacccttacgtttttccaacctttccgttaaccaacccggtacttacgacgtaccgtacgtcccgttagaccgtaacgggtcgttaaggtaaacgtagttcggttacgtaacgttacgttttaacgtttaccttacgtttaccgaacgtaccctaaacgtttaactttaacgtttacccttttacgttttaacccgttaccgtttaacccggtttttaccgggaccggggttaaaccgggtaaccccggttaaagggttaccggggtaacgttaacgttaacccggtaaaaccggttaaaccgttcggtacgggttacctacgggtaccccttaaccggttacgttacccgttaccggtttaccgtttaccgttaaacccgg

SEQ ID NO: 65262 - DNA, 572 bp, Homo sapiens
  misc_feature: GYAE6OF02IQB73.31.78.H01.1.454.CMB.1.raw
  modified_base (408)..(408): a, c, t, g, unknown or other
  misc_feature (408)..(408): n is a, c, g, or t
  modified_base (432)..(432): a, c, t, g, unknown or other
  misc_feature (432)..(432): n is a, c, g, or t
tcagcagtagacgtcacgaccggtgctcgatttagtgtgagtagtttgggtttggggggagctacaacaggcaggcaggggcagcaagatggtgttgcagacccaggtcttcatttctctgttgctctggatctctggtgcctacggggacatcgtgatgagccagtttccagactccctggctgtgtctctgggcgaggagggccaccatcaactgcaagtccagccagagttgttttattcggccccaccaataacaactacttagcttggtaccagcagaaagtaggacagcctacctaaactcctagtatttacgtgggtccttccgtacccgggctacgttcccggggttacctaaccgattccattcggcagcgggtctggggacctatttcactctcaccntcagcagctgcagcagagatgtgntagttatactgtacagacaacttattattacctttctttaccgttactaccgtttccgggacgggtaggaccgaagggttcggagtactacgaaacgtaccgtggtcgtactacgtacaccgtatcgtcgttcttctccg

SEQ ID NO: 65263 - DNA, 700 bp, Homo sapiens
  misc_feature: GYAE6OF02IGCRO.31.78.H01.1.454.CMB.1.raw
  modified_base (581)..(581): a, c, t, g, unknown or other
  misc_feature (581)..(581): n is a, c, g, or t
tcagcagtagacgtcacgaccggtgctcgatttagtgtgagtagtttgggtttgggggagctacgaacaggcaggtcaggggcagctaaggtagtgggtagttgcagaccctagggtccttcagtttacctctggttagcctcgtggatctcttggtgtcccttacggggacatcgtgatgacgccagtttccagtaccgtaccctggcttgtgtctcgtgggccgagacgggcccactattcaactcgacgaaagtccacgccctagtacgttgttttacttcgggcccccaacaataacaacttacttagcttcggtaccagccaaggtaaacgtaggacaacgtcctaccctaaaacgtcccttacggtaacttttaccgtgggtaccttttccgtacccggggactacggtcccggggtttacctaaaccggtaagtttccgaagtttcggcctagggtccgggttacgtcggggaccgtgtttccgacgtcgtaccacgtatacagtcctacgtccctgaccgtaggtctaggaaagtctggtcggctagtttattacgttgtctagtctaaactnttactactttcttacgtactacgtttcgggcggtacggtaccgtagggtggacgtacgtaccggaacggtacgtggtacggtactacggacctacgtagtccgttgttccttactaccg

SEQ ID NO: 65264 - DNA, 617 bp, Homo sapiens
  misc_feature: GYAE6OF02GT6WJ.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagtgtttattcggccccacaataacaactactagctggtaccagcaagaaagtaggacagcctacctaaactcctagtactttacgtgggtccttaccgtaccccgggctacgttcccgggggttaccctaaaccggtacttccgtaagtttcggcctaaggccggggttccgtcggggaacccgtagtttccgaacttcctaccgaaccacgtcacgtcacgccctgaccgaggctaggaaagagtgtggactagtttactacgtgtcagacaactattacttacttcgtttcgtactacgtttcggccggtaaggaccgtaagggtggagactaacgaaacggtactggtcgtactgaccactacgttcgtacttcgttactaccg

SEQ ID NO: 65265 - DNA, 602 bp, Homo sapiens
  misc_feature: GYAE6OF02F22WZ.31.78.H01.1.454.CMB.1.raw
  modified_base (318)..(318): a, c, t, g, unknown or other
  misc_feature (318)..(318): n is a, c, g, or t
  modified_base (339)..(339): a, c, t, g, unknown or other
  misc_feature (339)..(339): n is a, c, g, or t
  modified_base (441)..(441): a, c, t, g, unknown or other
  misc_feature (441)..(441): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagctagagttgttttattcggccccaacaataacactacttagcttggtaccagcagaagtaggacagccctaccaaactcctagtactttacgngggcctttccgtaccccgggntacggttcccggggttacctaaccgtattcgagttcggacaggtcgggtctaggggaccctatttcactctacaccatccagcacgcctgcaggctagaagngtggtcgtactaagtttactacgtgtacagccaagtattattaccttctttacgaccttacgttccgggacggtacggtaaccgtaaggtcggagaactacgaaacgtacgtggtacggtcttacggacctaccgtacttccgtacgttccttacctaccg

SEQ ID NO: 65266 - DNA, 553 bp, Homo sapiens
  misc_feature: GYAE6OF02I1OJU.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattggccccacaataacaactacttagcttggtaccagcaagaaagtaggacagcctacctaaactcctgatttactgggccttcgtacccgggcacgtccggggttacctaaccgattcattggcaggcgggtctgggaccatttcactctacaccatcagcagcctgcaggctagaagatgtggctagtttattactgtacagcaactattaatacttctttcgtctacgtttcgggacggtacggtaccgaaggtggagtactacgaaacgtaacgtggtacggctgacacctactcgtagttccttactacg

SEQ ID NO: 65267 - DNA, 586 bp, Homo sapiens
  misc_feature: GYAE6OF02JZJU8.31.78.H01.1.454.CMB.1.raw
  modified_base (201)..(201): a, c, t, g, unknown or other
  misc_feature (201)..(201): n is a, c, g, or t
  modified_base (308)..(308): a, c, t, g, unknown or other
  misc_feature (308)..(308): n is a, c, g, or t
  modified_base (430)..(430): a, c, t, g, unknown or other
  misc_feature (430)..(430): n is a, c, g, or t
tcagcagtagacgtcacgaccggtgctcgatttagtgtgagtagtttgggtttggggtaggcgtacaacaggcaggcgaggggcgagcaagatggtgttgcgagaccaggtcttcatttctctgttgctctggatctctggtgcctacggggacatcgtgatgagccagttccagctccctggctgtgtctctgggcgagngggccaccatcaactgcaagtccagccagagtgttttattggccccacaataacaactacttagcttggtaccagcagaaagtggacagcctcaactcctgattacnggcttctacccggcatccggggttcctacgattcaattggcagcgggtccttggggacccgattttccgacttcgtcacccaatccgagtcacgtcctggctacgggctaggaagattcggnggacgtagttttagttaccgtgtaccagaccaaactattactacgtttcctttgtacctacgtttggccggtaggacccgtaagggtggagtacttacgaaaccgtaacttgggacggtctaggaccttaccgattccgtggttaccttacgttac

SEQ ID NO: 65268 - DNA, 598 bp, Homo sapiens
  misc_feature: GYAE6OF02JHTQO.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacaactacttagcttggtaccagcagaaagtaggacagcctcctaaaactcctagatttacgtgggctttaccgtacccggggcacgttcccgggggtttaccctaaaccggtatttcctaagtttcggaccaggtccggggttccttagggggacccgtattttcaccttctaccaaccatcagcacgccctgcaggctagaacgatgtggctagtttattactgtcagtacaactattattactttcttacgtctacgtttcgggcggtaggaccgaaggtcggagtacgtacgaaacggtactggtaggtcctagacctacctattccgtgttccttcgtacg

SEQ ID NO: 65269 - DNA, 766 bp, Homo sapiens
  misc_feature: GYAE6OF02HC2SQ.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagtgttttattcggccccacaataacaactacttagcttaggtaccagcaagaaagtaggacacgacctacctaaactcctagtactttacgtgggtaccttccgtacccgggctacgttcccggggttacctaaccggtattccgagtttcggcgtacggtccggggtcgtcggggaacccgtagttttccaacttccgtaccaaccgtaacttccgaacggacctacggtcccgttaggaccgtaacgggtaccgttaaggaaacggtaagttcgggtacgggtacctttaaggtttttaactttacgttcgttaacgaacggtaacctaaacgttaactttaacgtttaaccttttaccgttttaccgttaccgttaccggtttttaccggggaccggggtaaacgggtaaccccgtaagggggttacgggtaacggtaacgttaacccggaaaacggttaaccgttagggtaccggtacgttacggtacccgtaacgttaccgttccgttacgtttaccttaccgttaacccg

SEQ ID NO: 65270 - DNA, 567 bp, Homo sapiens
  misc_feature: GYAE6OF02GP852.31.78.H01.1.454.CMB.1.raw
  modified_base (317)..(317): a, c, t, g, unknown or other
  misc_feature (317)..(317): n is a, c, g, or t
  modified_base (425)..(425): a, c, t, g, unknown or other
  misc_feature (425)..(425): n is a, c, g, or t
  modified_base (563)..(563): a, c, t, g, unknown or other
  misc_feature (563)..(563): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagttgttttattcggccccacaataacaactacttagcttggtaccagcaagaaagtaggacagcctacctaaactcctgatttacgngggcctttctacccgggcacgttcccggggttcctaaccgattcattggcaggcgggtctgggacccgtatttcactctacaccatcagcagcctgcaggctagaagntgtggctagtttattactgtcagacaactattactactttctttcgtctacgtttcgggacggacgggtaacctagggtacggtagaacgtacgaaaacggtaactggtacggtctacgacaccgtatctagttcctntacc

SEQ ID NO: 65271 - DNA, 660 bp, Homo sapiens
  misc_feature: GYAE6OF02H7IG7.31.78.H01.1.454.CMB.1.raw
  modified_base (390)..(390): a, c, t, g, unknown or other
  misc_feature (390)..(390): n is a, c, g, or t
tcagcagtagacgtcacgaccggtgctcgatttagtgtgagtagtttgggtttggggggagctacaacaggcaggcaggggcagcaagatggtgttgcagacccaggtcttcatttctctgttgctctggatctctggtgcctacggggacatcgtgatgagccagtttccagacctccctggctgtgtctcgtgggcgagacgggccaccatcaactgcaagtccagccagagttgttttattcggccccacaataacaactactagcttggtaccagcaagaagtaggacagcctacctaaacctccttgtactttacgtgggccttccgtacccgggcaaccgttccggggttacctaaccgtattcagttcggactaggccgggtntcgggacccgtatttcgaccttcgtaccacctactcgacgtcacgtacccgtcgacgaggccgtaggaaacgtagttcggtacgggtaccgttaagttttaacttacggttcgttaccaacggtactaaacgttactttaaacttaccttttcctttacgtccgtttacgtttaccgggacgggtacggaaccgtaaggggtcgtagaacgtaacgaaacgtaacgtggtaaccgcgtacgaccaacgtatccgttctcctttagtaccc

SEQ ID NO: 65272 - DNA, 532 bp, Homo sapiens
  misc_feature: GYAE6OF02IGTGV.31.78.H01.1.454.CMB.1.raw
  modified_base (355)..(355): a, c, t, g, unknown or other
  misc_feature (355)..(355): n is a, c, g, or t
  modified_base (447)..(447): a, c, t, g, unknown or other
  misc_feature (447)..(447): n is a, c, g, or t
  modified_base (486)..(486): a, c, t, g, unknown or other
  misc_feature (486)..(486): n is a, c, g, or t
tcagcagtagacgtcacgaccggtgctcgatttagtgtgagtagtttgggtttgggggagctacaacaggcaggcagggcagcaagatggtgttgcagacccaggtcttcatttcttctgttgctctggatctctggtgcctacggggacatcgtgatgagccagtttccagactccctggctgtgtctctgggcgagagggccaccatcaactgcaacgtccagccagagttgttttattcggccccacaataacaactacttagcttacggtaccagcaagaaagtaggacagcctacctaaactcctgtatttacgtgggcttcctacccgggcagtccggggttccaacgnttcagttggcagcgggtctgggacctatttcactctcaccatcagcacgcctgcaggctagaagatgtgctagtttatactgtcagcaaatnttatacttcttctctacgttcggcgaggaccaggtgganatacgaaacgtactggtcggctagctaccattcgtcgttactctac

SEQ ID NO: 65273 - DNA, 722 bp, Homo sapiens
  misc_feature: GYAE6OF02GZ6J5.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctcgtgggcgagagggccaccatcaactgacaagtccagccagagtgttttattcggccccacaataacaactacttagcttggtaccagcagaaagtaggacagcctacctaaactcctagtactttacgtgggtcctttccgtacccgggtctacgttcccgggggttaccctaaaccggtattaccgtagtttcgggaccaacgggtccggggttactacggggtacccgtattttccgaccgttcctaccaaccactccgaacgccacggccctcggaccgagggtcttaggaagagtcggtcggtacgttaagttttacgttaacgttcgttacacgtacctaacgtaactttaacttacctttcgttttaccgtaccgttaccgttttcgggaccgggtaacgggtaacccgaaggggttacggacggtaacgttaaccggaaaaccggttaaccgttacgggttacgggtaccgtacggtacccgtaaccgtacgtttcccggttacgtttccgtttaccgtacccg

SEQ ID NO: 65274 - DNA, 658 bp, Homo sapiens
  misc_feature: GYAE6OF02IWMY0.31.78.H01.1.454.CMB.1.raw
  modified_base (326)..(326): a, c, t, g, unknown or other
  misc_feature (326)..(326): n is a, c, g, or t
tcagcagtagacgtcacgaccggtgctcgatttagtgtgagtagtttgggtttgggggagctacaacaggcaggcagggcagcaagatggtgttgcagacccaggtcttcatttctctgttgctctggatctctggtgcctacggggacagtcgtgattgagccagtttccagactccctggctgtgtctcgtgggcgagagggccaccatcaaactggccgaagtccagccagagttgttttatcggcccccacaataactaactacttagcttaggtaccagcaagaagtacggacagcctacctaaactcctagactttacgnggtccttcgtaacccgggcaacgttccggggttacctaaacccggattaccgagtttacggctaaggccgggttactaggggaccctattttccacgttctccgacctacgtcaacgtcaacgaccctgacgacggactaggaaacggattacggtacgaccgttaagtttaattacgtgttaaccagtacaaacgtattaactacctttctttacgttcctacgtttacggaccggtaagggtacctaaggttacgggactaacgtaaccgaaacggttaacctgggttacgaccgttgacctaactataccgtcgttacctgttaacccg

SEQ ID NO: 65275 - DNA, 714 bp, Homo sapiens
  misc_feature: GYAE6OF02HPJDR.31.78.H01.1.454.CMB.1.raw
tcagcagtagacgtcacgaccggtgctcgatttagtgtgagtagtttgggtttgggggtaggctacaacaggcaggccaggggcagcaagatgggtgttgcaggacccagggtcttcatttctctgttgctctggatctctggtgcctacggggacagtcgtgatgagccagtttccagacctccctggctgtgtctcgtgggcgagaggccaccatcaactgacaagtccagccagagttgttttacttggcccccacaataacaactacttagcttggtaccagacaagaaagtaggacagtccctacctaaactcctagtatttacgtggtccttaccgtacccgggtctacgttcccgggggttacctaaaccggtattaccagttcggacctaaggccgggtcgttcggggacccttagtttccaaccgttctaccaccctataccgagtacctacgcccttacgaccgtaggaccgttaggaacgtacgtcgggtaggtaccgttaacgtttacgtttacgtagttaccgacgtaacctaacttaacgtttacttaccgttttaccgtttccgttaccgttaaccggtttcggaccgggtacggtaacccgtaagggtacggacgtaacgtaacgtaaacggtaaccttgggtaccggtacgtaccgtaccgtaacctacgttacgtttacgttaccttccgtaaccg

SEQ ID NO: 65276 - DNA, 719 bp, Homo sapiens
  misc_feature: GYAE6OF02GYRK9.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactcctggctgtgtctctgggcgagagggccaccatcaactgacaagtccagccagagttgttttattcggccccaacaataacaactacttagcttggtaccagacagaaagtggacagacctacctaaactcctagtatttactgggtccttccgtacccgggctacgttcccggggttaccctaaaccggtactttacgagtttcggacctagggtccgggttcgtacggggtacccgtattttccgacctcctaccaacctaacttccgaacgtccgtaacgtcccttacggacccaagggtccgtaggaaaacgtacgttcggtacggtacttaacgttttaacgtttacgttcgttaccgtaagtaccgaaacttaacgtttaactttaaccttttccgttttacgttacttaaccgtttttaccgggaccgggtaaacgggtaaccgtaaggggttacggtacgtaacgtaaccgaaacggtaacgttcgggtacggtcgtacgacctaaccgtagttaccgtacggttccttacgtacc

SEQ ID NO: 65277 - DNA, 582 bp, Homo sapiens
  misc_feature: GYAE6OF02IDOKZ.31.78.H01.1.454.CMB.1.raw
  modified_base (359)..(359): a, c, t, g, unknown or other
  misc_feature (359)..(359): n is a, c, g, or t
  modified_base (401)..(401): a, c, t, g, unknown or other
  misc_feature (401)..(401): n is a, c, g, or t
tcagcagtagacgtcacgaccggtgctcgatttagtgtgagtagtttgggtttgggggagctacaacaggcaggcaggggcagcaagatggtgttgcagacccaggtcttcattttctctgttgctctggatctctggtgcctacggggacatcgtgatgagccagtttccagacctccctggctgtgtctcgtgggcgagagggcccaccatcaactgcaagtccagccagagttgttttattcggccccaacaataacaactattagcttggtaccagcaagaaagtaggacacgcctacctaaactcctgtattacgtggtcttcgtacccggcagtcccgggttacctaaccgtnttccagttcggacaggccgggtcgtcgggaccctatttaccncttactccaaccatcgacgcacgccgtgcgacggctagaacgtagtggtaggtacttagtttacttactgtactagactaactattacttacctttcttccgtctacgtttacgcggacggtacgaggtacgatacgtacgaaacgtactggtcgtctcgacacgtattcgtctctcgtac

SEQ ID NO: 65278 - DNA, 635 bp, Homo sapiens
  misc_feature: GYAE6OF02GW9BG.31.78.H01.1.454.CMB.1.raw
  modified_base (211)..(211): a, c, t, g, unknown or other
  misc_feature (211)..(211): n is a, c, g, or t
  modified_base (234)..(234): a, c, t, g, unknown or other
  misc_feature (234)..(234): n is a, c, g, or t
  modified_base (285)..(285): a, c, t, g, unknown or other
  misc_feature (285)..(285): n is a, c, g, or t
  modified_base (298)..(298): a, c, t, g, unknown or other
  misc_feature (298)..(298): n is a, c, g, or t
  modified_base (326)..(326): a, c, t, g, unknown or other
  misc_feature (326)..(326): n is a, c, g, or t
tcagcagtagacgtcacgaccggtgctcgatttagtgtgagtagtttgggtttgggggtaggcgtacaacaggcaggcaggggcgagcaagatggtgttgcagacccaggtcttcatttctctgttgctctggatctctggtgcctacgggacatcgtgatgagccagtttccagactccctggctgtgtctctgggcgagagggccaccntcaactgcaagtccagcagagtntttattcggcccacaatacactactagctgtaaccagcagaaagtaggacngacctccgtaaancctgatttactaggtcttcgtacccggntactcccggggttcctaacgacgtttcatttcggcacgtccgggtcttacgggggaccctaacgttttcaaccttcgttacaacccagtttaccaaggtccgaacggtccctacggcacgggcttacggaaacggagttacggtgggtaccgaaggtttttacttaacgtttacgtccgtaacgactaaccattttaacgtaccttacttttcgacttacgtttcgaccggtacggaccgtagggacggtatacgtacgtaaacgtaatcggtagcgttagccgtaccgaattcggtacttcctactac

SEQ ID NO: 65279 - DNA, 530 bp, Homo sapiens
  misc_feature: GYAE6OF02GVJ3H.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtggacagcctactaaactcctgatttacgtggcttcgtacccgggcacgtcccggggttcctaaccgattcattggcagcgggtctgggaccgtatttcactctcaccatcagcagcctgcaggctagaagatggtggctagtttatactgtcagcaatattatactttctttcgtctacgtttcgggcggtacggacctagggtggacgatacgaaacgactggtagctgctacatctcgtcttctac

SEQ ID NO: 65280 - DNA, 675 bp, Homo sapiens
  misc_feature: GYAE6OF02HKK6J.31.78.H01.1.454.CMB.1.raw
tcagcagtagacgtcacgaccggtgctcgatttagtgtgagtagtttgggtttgggggggagctacaaccaggcaggcaggggcagctaagatggtgttgcagacccaggtcttacatttctctgttgcctctgggattcgtctggtagccgttacggggactatcgtgtaatggagcccagtttccagactcctggctgtgtctcgtgggcggagagggccaccatcaagtgccaagtccagccagagttgttttattcggcccccactaataacaactacttagtcttaggtaccagcagaaagtaggacagcctacctaactcctgtacttacgtcgggcttccgtacccggggctacggtcccgggggttacctaaccggttattaccgtagttcggacgtaggtcgggttcgtacggggtacccgtagtttccgacttctacctacccgtagtacgacgcgacgcctgcacggctagaacgtattcggaggtcgttaagtttacttacgttcgtacgaagactaaactattacgttactttcgtttcgtaccgttacggtttcggacggtaggtaccgtagggtaggacgtaagtaccggtaaacgacgttaggtacggtacgtacgtaccgtaccgtacgttacgttacggttacgttaccgttaaccg

SEQ ID NO: 65281 - DNA, 698 bp, Homo sapiens
  misc_feature: GYAE6OF02FSB63.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataaccaactacttagcttggtaccagacagaaaacgtaggacacgccctacctaaaactcctgtactttaactggggtcctttacgtaccccggggcacgttcccggggtttaccctaaacccggtatttcatttcggaccgaggtccggggttctggggaacccgtatttccgactcctcaacccatccagccacgccctagcgaggcctaggaagacgtggtaggtactaagttttattaccttcgtacaagacctaaactaactttaacttaccttttccgttttaccgttaccttaccgttttaccggggaccgggtaacgggtaacccgtaaggggttacgggtaacgtaacgtaaccgtaaaaaccggtaaccgttcgggtacggtccgttacggaccctaaccgtaacctttccggttacgttacccgtttacgtaacccg

SEQ ID NO: 65282 - DNA, 533 bp, Homo sapiens
  misc_feature: GYAE6OF02H5GVD.31.78.H01.1.454.CMB.1.raw
  modified_base (407)..(407): a, c, t, g, unknown or other
  misc_feature (407)..(407): n is a, c, g, or t
  modified_base (410)..(410): a, c, t, g, unknown or other
  misc_feature (410)..(410): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactactagcttggtaccagcagaaagtaggacagcctcctaaaactcctgtatttactgggcttctacccgggcagtccgggttctaaccgattcattggcagcgggtctgggaccatttcactctcaccatcagcagcctgcaggctgaagntgnggctagtttattactgtcagcaactattaattacttctttcgtctacgtttcggcggaacggaccaagggtgagtacgtacgaaaacggaactggtagctcgacaccgatcttcgtcttctac

SEQ ID NO: 65283 - DNA, 538 bp, Homo sapiens
  misc_feature: GYAE6OF02FS9OW.31.78.H01.1.454.CMB.1.raw
  modified_base (525)..(525): a, c, t, g, unknown or other
  misc_feature (525)..(525): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacaactacttagcttggtaccagcagaaagtaggacagcctacctaaactcctgatttactgggcttctacccggggcacgttcccggggttcctaaccgattccattggcaggtcgggtctgggaccgtatttcactctcaccatccagcagcctgcaggctagaagatggtgctagtttatactgtcagactaactattattactttctttcgtctacgtttcgggcggtacggaccagggtgagactacgaaacgactgtgctgcacctntctgttactctac

SEQ ID NO: 65284 - DNA, 586 bp, Homo sapiens
  misc_feature: GYAE6OF02FWFKO.31.78.H01.1.454.CMB.1.raw
  modified_base (315)..(315): a, c, t, g, unknown or other
  misc_feature (315)..(315): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggccccaccaataacaactacttagcttggtaccagcagaaagtaggacagcctacctaaactcctgatttacngggcttcgtacccgggcacgttcccggggttacctaaccgtattcagttggcagcgggtctgggaccgtattcactctcaccatcagcacgcctgcgaggtctaggaagtagtggtggtacttagttttactacttgtcagtacaactattatactttctttcgtactacgtttcggacggtacggacctaagggtcggagtactaccgtaaacgtactaggtcgacgttcggacctaaccttagttccgttcgttaccttacgttacccg

SEQ ID NO: 65285 - DNA, 574 bp, Homo sapiens
  misc_feature: GYAE6OF02HM93E.31.78.H01.1.454.CMB.1.raw
  modified_base (317)..(317): a, c, t, g, unknown or other
  misc_feature (317)..(317): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggccccacaataacaactacttagcttggtaccagcaagaaagtaggacagccctactaaactcctagatttacgngggcttcacccgggcagttccgggttacctaacgattcattggcagcgggtctgggacctattcactctcaccatcagcacgcctgcaggctgaagagtgtggactagtttaattactgtacagactaactattacttactttctttacgtctacgttttcggacgggtacggtaaccgaagggtggacgtagtaccgtaaaacggtacgttaggtacggtacgtacgacaacctacgttctacgttccttacgtac

SEQ ID NO: 65286 - DNA, 764 bp, Homo sapiens
  misc_feature: GYAE6OF02J2P7I.31.78.H01.1.454.CMB.1.raw
  modified_base (321)..(321): a, c, t, g, unknown or other
  misc_feature (321)..(321): n is a, c, g, or t
tcagcagtagacgtcacgaccggtgctcgatttagtgtgagtagtttgggtttgggggtaggcgtacaacaggcaggcagggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagttgttttactcggccccaacaataacaactacttagcttggtaccagcaagaaagtggacagcctacctaaactcctgtaatttacgngggtcctttcgtaaccccggggctacgttaccccggggtttccctaaacgtatttccgtaagttccgggactaacgggtccggggttaccgttacgggggaaccccgttaatttttccgaacctttcccgtaccaaaccccgtaagttccgaacgcccgaacgtcccgtacggaccgtagggaccctttaggaaaaccggtattcgggttggacctaggtttttaactaccgttgtacaagtcctaaacttattaactttacccgttttcgtttttaccgtacgttaaccggttttccggggaaccgggtttaacgggaacccgtaaaggggttcgggtaagaaccgtttaaaccggaaaaacggttccgtagggttacccggtaccgttaacggaccccttaaccgaactttaccgtttcggttaccctttccgttaacccg

SEQ ID NO: 65287 - DNA, 567 bp, Homo sapiens
  misc_feature: GYAE6OF02I55L3.31.78.H01.1.454.CMB.1.raw
  modified_base (431)..(431): a, c, t, g, unknown or other
  misc_feature (431)..(431): n is a, c, g, or t
  modified_base (451)..(451): a, c, t, g, unknown or other
  misc_feature (451)..(451): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacaactacttagcttggtaccagcagaaagtaggacagcctacctaaactcctgtatttacgtgggtcttccgtacccgggctacgttcccggggtttacctaaccgtatttccagtttcggcaggtcgggtctggggaccgtatttcactctcaccatcagcagcctgcagctgaagntgtgctagtttatctgtcancaactattactcttctttcgtctacgtttcggacggtacggtaccgaagggtggagtacgtacgaaacgtaactggtacgacgtcgacctacctatccgttacgttccttctaccg

SEQ ID NO: 65288 - DNA, 563 bp, Homo sapiens
  misc_feature: GYAE6OF02JMSTS.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagattgttttattcggcccacaataacactactagcttggtaccagcagaaagtaggacagcctcctaaactcctagactttacgtgggtccttcgtacccgggcagttcccggggttcctaaccgattcattcggcctagcgggtctcgggacgtatttcactctcaccatcacgcacgcctgcaggctagaagatgcgctagtttatagtgtaccagctaactattactactttcttcgtctacgtttcggcgtaaggaccaaggttcgacgtagttaacgaaacgtacgttggtacgacgttagacctaccgtattcgtacgtacttccgtaac

SEQ ID NO: 65289 - DNA, 864 bp, Homo sapiens
  misc_feature: GYAE6OF02FGOCJ.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctcgtgggcgaggacgggccaccatcaactgcaagtccagccagtagttgttttattcggaccccaacaataaccaactactagcttggaccagacaagaaagtacgacacgccctacctaaactcctagtactttacgcgggtcctttaccgtacccgggtctacggttccccggggttacctaaccggtattaccgtagttcggacgtacggggtccgggtccggttacgggggaacccgttacgttttaccaacccgtttcccttacccgaaaccctacgttaccgaacgggtaccctaaccggtccccgtacgggaccggaaccggggtaccgttaaacgggaaacggttaacggttacggggttacgggtaaccgtttaacgggtttttaactttaacccgtttacggttaccgaaacgtaacccgtaaaactttaacgttttaacctttaaccgtttttccgtttttacccgtttacccgtttaaccgggtttttacccgggggaacccggggttaaaccggggtaacccgggttaaagggggttaccgggtaaacggtaaccgttaaaccgggtaaaaaccgggtaaccggttacgggttaccgggtaccgttaccgtaacccgtaaccgtaccgtttaccgtccgtttacccgtttaccgttaacccg

SEQ ID NO: 65290 - DNA, 580 bp, Homo sapiens
  misc_feature: GYAE6OF02HC8YV.31.78.H01.1.454.CMB.1.raw
  modified_base (317)..(317): a, c, t, g, unknown or other
  misc_feature (317)..(317): n is a, c, g, or t
  modified_base (429)..(429): a, c, t, g, unknown or other
  misc_feature (429)..(429): n is a, c, g, or t
  modified_base (470)..(470): a, c, t, g, unknown or other
  misc_feature (470)..(470): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgaggaggccaccatcaactgcaagtccagccagagttgttttattcggccccacaataacaactactagcttgtaccagcagaaagtaggacacgcctacctaaactcctagtactttacngggtccttccgtacccgggcacgttcccggggttacctaaccgacttcattcggacgtaggcgggttcgtacgggaccgtatttcaccttctccaaccatccagccacgccngcgaggctagaagactgtggactaagtttatacgtgtacanacaatattatactttctttcgtacttacgttcggacgacggacgaaggtcgaagtactaacgaaacgtacgttggtacgtactacgacaccgtatctcgttactacctac

SEQ ID NO: 65291 - DNA, 630 bp, Homo sapiens
  misc_feature: GYAE6OF02I4K6D.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgacgccagtttccagactccctggctgtgtctctgggcgagagggccaccatcaactgacaacgtccagccagagttgttttattcggaccccaccaaataaacaactacttagcttcggtaccagcaagaaagtaggacagcctacctaaactcctagtactttacgtggcttcgtaccggcacgttccgggttacctaacgtattcagttcggcaggcgggtcgtgggaccgtatttcactctaccacatcacgcacgccgtgacgacggctagaagtagtcggtcggtactagtttacttacgtgtacacgacctaaactaatttacttacttttccgtttaccgttacgtacgtttcggggacgggtaacggtaaccggtaaggggttaggagtaacgttaacgaaaacggtaacgtggtaccggtacgtacgtaccgaccgttatccgttacgttacctttctaccg

SEQ ID NO: 65292 - DNA, 528 bp, Homo sapiens
  misc_feature: GYAE6OF02IX5VU.31.78.H01.1.454.CMB.1.raw
  modified_base (231)..(231): a, c, t, g, unknown or other
  misc_feature (231)..(231): n is a, c, g, or t
  modified_base (310)..(310): a, c, t, g, unknown or other
  misc_feature (310)..(310): n is a, c, g, or t
  modified_base (362)..(362): a, c, t, g, unknown or other
  misc_feature (362)..(362): n is a, c, g, or t
  modified_base (370)..(370): a, c, t, g, unknown or other
  misc_feature (370)..(370): n is a, c, g, or t
  modified_base (515)..(515): a, c, t, g, unknown or other
  misc_feature (515)..(515): n is a, c, g, or t
  modified_base (524)..(524): a, c, t, g, unknown or other
  misc_feature (524)..(524): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccacatcaatgcaagtccagccagagttnttttattggccccacaataacaactacttagcttggtaccagcagaaagtaggacagcctacctaaactctgatttacngggtcttctacccggcagtccgggttcctaaccgattcattggcagcggtcngggacctntttcactctcaccatcagcacgcctcgcaggctagaagtatggtggactagtttatcttgtacacgacaactattatactttctttcgtcttacgttcggcggaacggtacaagggtgagtatacgaaagtactgtgctgcaccnttctgtctntacg

SEQ ID NO: 65293 - DNA, 630 bp, Homo sapiens
  misc_feature: GYAE6OF02HHNQZ.31.78.H01.1.454.CMB.1.raw
  modified_base (309)..(309): a, c, t, g, unknown or other
  misc_feature (309)..(309): n is a, c, g, or t
  modified_base (388)..(388): a, c, t, g, unknown or other
  misc_feature (388)..(388): n is a, c, g, or t
  modified_base (392)..(392): a, c, t, g, unknown or other
  misc_feature (392)..(392): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagtttccagactccctggctgtgtctctgggcgagagggccaccatcaactgcaagtccagccagagtgttttattggccccacaataacaactacttagcttggtaccagcagaaagtgacagcctaccaaatcctgatttacngggcttccgacccgggcagtcccgggttactaaccgattcattggcaggtcggtctgggaccatttcactctcacctanccancacgccctgcagcgtagaacgagtgtaggactaggttttactacgtgttccagtacaaaccgtatttaacttacctttactttccggtaccttacggtttaccgggaccgggtaaacgggaaccctaaagggtcgggtaagaaagttacccggtaaaaaccggaacgttcgggtaaaccgggtcgttaccgtaccggaacccttacggttcgtttaccggtttaccttacctaacccg

SEQ ID NO: 65294 - DNA, 602 bp, Homo sapiens
  misc_feature: GYAE6OF02HAWT2.31.78.H01.1.454.CMB.1.raw
  modified_base (379)..(379): a, c, t, g, unknown or other
  misc_feature (379)..(379): n is a, c, g, or t
  modified_base (597)..(597): a, c, t, g, unknown or other
  misc_feature (597)..(597): n is a, c, g, or t
tcagcagtagacgtcacgaccggtgctcgatttagtgtgagtagtttgggtttgggggagctacaacaggcaggcaggggcagcaagatggtgttgcagacccgaggtcttcatttctctgttgctctggatctctcggtgcctacggggacatcgtgatgagccagtttccagactccctggctgtgtctcgtgggcgagagggccaccgatccaactgcaagtccagccagagttgttttattcggaccccaacaataaccaacttacttagcttcggtaccagcagaaagtaggacagcctacctaaactcctagtactttacgtgggcctttaccgaacccgggctacgttcccggggtttaccctaaaccggtntttccagtttcggactaggtcgggtctggggacctatttcactctacaccatcagcacgcctgcgaggctagaagtgtggtggtactaggtttacttacgtgtacacgactaactattacttactttcgtttcgtctacgtttcggacggtacggacgtaggtgagtagtacgaaacgtacgtggtcgtcgtagacctacgtagtccgttcgttcttntaccg

SEQ ID NO: 65295 - DNA, 545 bp, Homo sapiens
  misc_feature: GYAE6OF02FNNSZ.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctacctaaactcctagtactttactgggcttcgtacccgggcacgttcccggggttcctaaccgtattcatttcgcagcggtctgggaccgtatttcactctcaccatcagcagcctgcaggctgaagatgtgctagtttattactgtcagacaatattatactttcttacgtctacgtttcggcggaggtaccaaggtgagtactacgaaacgtactggtacggctgacacctacttcgtcgttcttactaccg

SEQ ID NO: 65296 - DNA, 709 bp, Homo sapiens
  misc_feature: GYAE6OF02H0REW.31.78.H01.1.454.CMB.1.raw
  modified_base (291)..(291): a, c, t, g, unknown or other
  misc_feature (291)..(291): n is a, c, g, or t
  modified_base (310)..(310): a, c, t, g, unknown or other
  misc_feature (310)..(310): n is a, c, g, or t
  modified_base (376)..(376): a, c, t, g, unknown or other
  misc_feature (376)..(376): n is a, c, g, or t
  modified_base (428)..(428): a, c, t, g, unknown or other
  misc_feature (428)..(428): n is a, c, g, or t
  modified_base (436)..(436): a, c, t, g, unknown or other
  misc_feature (436)..(436): n is a, c, g, or t
tcagcagtagacgtcacgaccggtgctcgatttagtgtgagtagtttgggtttgggggaggctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaaccatccaaatgacaagtccagccaagagtgtttttacttggcccccaacaaataacaaactaccgttaactgttacgaccaganaaagtaaaaggaccggaanacgtacctaacctaacgtctatattacgtgtacctccgtaccggataccggtccggtaactaactntacagtcgcgtacggtcggtcgtacggtaacgtacttactactcaccactanacacgacncgtccgtgacgtacgcgtaaggtaaacgtgttacgtcggtaactttaagttttaaacgtcgtacgtacgaacgactaactaaacttaactttaacctttaccgtttaccgtttaccgttaccgtttaccggttaccgggtaaccggtaaaccggtaaacgggtaacggtaacgggtaacgtaaacggtaaaacgtaaaccgttaacggtaacggttacgtaccggtaccgtaaccgtaaccgttaaccgttaccgtttaccttaccgttaccg

SEQ ID NO: 65297 - DNA, 624 bp, Homo sapiens
  misc_feature: GYAE6OF02H0V8H.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgaggaggccaccatcaactgcaagtccagccagagttgttttattcggcccaacaataacaactactagcttggtaccagacaagaaagtagacagacctactaaactcctagtatttacgtggtcttccgtacccggctacgtccgggttacctaaccgtacttcagttcggacgacggtcgggtcgtcggggtaccgtatttccaccttctaccacctactcgacgcacgcctgacgaggtctaggaagtgtggtaggcttaagtttactacgtagtcaagtaccaattattacttacttttccttcgttacctacggtttccgggacggtaaccggtaacgtaaggtcggtaacgacgttacggaaaacgtaccggttggtacggtactcggaccaccgttacttccgtacttcgttctaacccg

SEQ ID NO: 65298 - DNA, 593 bp, Homo sapiens
  misc_feature: GYAE6OF02FSRVL.31.78.H01.1.454.CMB.1.raw
  modified_base (456)..(456): a, c, t, g, unknown or other
  misc_feature (456)..(456): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcagagggccaccatcaactgcaagtccagccagagtgttttattggccccacaataacaactacttagcttggaccagcagaaataggacagcctacctaaactcctgatttactgggtcttctacccgggcagttcccggggttcctaaaccgtattccagttcggacaggtccgggtctgggacccgtatttccactctcaccatcagcagcctgcaggctagaagtatgtggctagtttactactgtcagtacaaactnttaattacctttctttcgtccgtaaccgttttccgggacggtaacgggtaaccctaagggtggagaacgtaccaaaacggtacttggtacggtcctaggaccctaaccgtagttccgtcgttacctttccgtaaccg

SEQ ID NO: 65299 - DNA, 664 bp, Homo sapiens
  misc_feature: GYAE6OF02IGJWZ.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctcgtgggcgagacggccaccatcaactgacaagtccagccagtagttgttttacttcggaccccaccaataaccaacttacttacgcttaggtaaccagacaagaaagtaggacagcctacctaaactcctagtacttacgtggcttccgaccggcacgtccgggttacctaacgattcagttcggctaggcgggtcgtcgggacgtactttcgactctcaaccatcacgcagccctagcaggtctaggtaaagacgttggtcggtacttagtttacttacgtcgtacacgtactaaacgtatttaacttaccttttcctttaccgttaccgttacggttttaccgggacgggtaacggggtaacccgaaggggttaccgggagttaacgtaaccggaaaccgtaaccggttagggtaccgacgttaccgacccgtaaccgtaacgttccgttacggtttaccttacgttacccg

SEQ ID NO: 65300 - DNA, 778 bp, Homo sapiens
  misc_feature: GYAE6OF02JPO9L.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagtgttttatcggccccacaataacaactacttagcttggtaccagcaagaaagtaggacacgcctacctaaactcctagtactttacgtgggcctttaccgtacccggggctaacgttcccggggtttaccctaaaccggtattccaagtttcgggacctaacgggtccggggttccgtacgggggtaacccgtatttttccgaaccgttccttacccgaaacccgtattacccgaacggtacccgtaacggtaccccgttacggacccgtaacgggtacccgtttagggaaaacggtaacggtttccgggttacgggtaacccgttaaggtttttaacgtttaaaccttcgggttaccaacggtacctaaacgttaacgttttaacttaccgttttaccttttcgttaaccttaccggttttaccgggaccgggtacgggtaacccgtaagggttaccggagtacgttaaccgaaacggtaaccttgggtaccggtaccgttaggtacctaacccgtacttaccgtacggttaccttacgttacccg

SEQ ID NO: 65301 - DNA, 634 bp, Homo sapiens
  misc_feature: GYAE6OF02IKEYR.31.78.H01.1.454.CMB.1.raw
  modified_base (203)..(203): a, c, t, g, unknown or other
  misc_feature (203)..(203): n is a, c, g, or t
  modified_base (234)..(234): a, c, t, g, unknown or other
  misc_feature (234)..(234): n is a, c, g, or t
  modified_base (372)..(372): a, c, t, g, unknown or other
  misc_feature (372)..(372): n is a, c, g, or t
tcagcagtagacgtcacgaccggtgctcgatttagtgtgagtagtttgggtttgggggagctacaacaggcaggcacggggcagcaagatggtgttgcagacccaggtcttcatttctcttgttgctcgtggatctctggtgcctacggggacatcgtgatgagccagtttccagactccctggctgtgtctcgtgggcgagngggccaccatcaactgcaagtccaggccagngttgtttatcggacccctacaataacaactacttagcgttggtaccagcagaaagtaggacagcctacctaaacgtccgtgtactttacgtcgggtcctttccgtacccgggctacgtcccggggttacctaaccgtnttccatttaggcaggcggtctgggaccgtatttcgacgtctaccaccatccgaagcacgtcctgcaggtctaggaagtatcggtaggcttagtttacgttactgtaccagacctaaactatttacttactttcgtttcgtacgttacgtttacgggcggtaaacggtaaccgtagggtacggtagtaacgttacgtaaaacggttacgttggtaccggcgttaccgaccgtaccgtacgttcgttacggttccttctaaccg

SEQ ID NO: 65302 - DNA, 553 bp, Homo sapiens
  misc_feature: GYAE6OF02GMESR.31.78.H01.1.454.CMB.1.raw
  modified_base (313)..(313): a, c, t, g, unknown or other
  misc_feature (313)..(313): n is a, c, g, or t
  modified_base (329)..(329): a, c, t, g, unknown or other
  misc_feature (329)..(329): n is a, c, g, or t
  modified_base (412)..(412): a, c, t, g, unknown or other
  misc_feature (412)..(412): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcaagaaagtaggacagcctacctaaactcctgatttacngggcttctacccgggnacgtccggggttcctaaccgattcattggcagcgggtctgggaccgatttcactctcaccatcagcagcctgcagctagaagntggtgctagtttatacgtgtcagcaactattatactttctttcgtcttacgtttcggacggtaggaccgtaaggtgagtataccgaaaacggacttggtcggtctacggactacccgtattaccgtcgttaccttctaccg

SEQ ID NO: 65303 - DNA, 532 bp, Homo sapiens
  misc_feature: GYAE6OF02HADB8.31.78.H01.1.454.CMB.1.raw
  modified_base (312)..(312): a, c, t, g, unknown or other
  misc_feature (312)..(312): n is a, c, g, or t
  modified_base (329)..(329): a, c, t, g, unknown or other
  misc_feature (329)..(329): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactactagcttggtaccagcagaaagtaggacagcctacctaaactcctgatttacgngggtcttctacccgggnacgtccggggttcctaaccgattcattggcagcgggtctggggaccatttcactctcaccatcagcagcctgcaggctagaagagtgtggactagtttatacttgtcagacaatattattactttctttcgtctacgtttcggcggtacggaccgtaggtggagtatacgaaacgtacgtgtgctgccactatctgtctctac

SEQ ID NO: 65304 - DNA, 532 bp, Homo sapiens
  misc_feature: GYAE6OF02FRSXO.31.78.H01.1.454.CMB.1.raw
  modified_base (529)..(529): a, c, t, g, unknown or other
  misc_feature (529)..(529): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccaccaataacaactacttagcttggtaccagcagaaagtaggacagcctcctaaactcctgatttactgggcttctacccgggcatccggggttcctaaccgattcattggcagcgggtctgggaccgatttcactctcaccatcagcacgcctgcaggctgaagatgtggctagtttatactgtcagcaactattaatactttctttcgtctacgttttcgggcggtaaggaccaagggtgagatacgaaacggactggtagctggacaccgattctgttcttntac

SEQ ID NO: 65305 - DNA, 571 bp, Homo sapiens
  misc_feature: GYAE6OF02IWO6H.31.78.H01.1.454.CMB.1.raw
  modified_base (417)..(417): a, c, t, g, unknown or other
  misc_feature (417)..(417): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacaactacttagcttggtaccagcagaaagtagacagcctacctaaactcctgatttactgggcttcgtacccgggcacgtccggggttcctaaccgattcattggcagtcgggtctgggacctatttcactctcaccatcagccagcctagcaggctagaagtntggtggctagtttattactgtcagctaactattactacctttctttcgtctacgtttccgggcggtacgggtaaccgaagggtgaggtaacttacgaaacgtaacgtggtaggtcgtaggacctaccgtatccgtacggtttccttacgtaccg

SEQ ID NO: 65306 - DNA, 527 bp, Homo sapiens
  misc_feature: GYAE6OF02FIJZD.31.78.H01.1.454.CMB.1.raw
  modified_base (311)..(311): a, c, t, g, unknown or other
  misc_feature (311)..(311): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttacngggctttctacccgggcatcccggggttcctaaccgattcattggcagcgggtctgggaccgatttcactctcaccatcagcagcctgcaggctgaagatgtggctagtttattactgtcagcaactattatactttctttcgtctacgtttcggcggtaggacctaaggtggagatacgaaaacgacgtaggtgctgcaccattctgtcttctac

SEQ ID NO: 65307 - DNA, 754 bp, Homo sapiens
  misc_feature: GYAE6OF02GJNBY.31.78.H01.1.454.CMB.1.raw
  modified_base (279)..(279): a, c, t, g, unknown or other
  misc_feature (279)..(279): n is a, c, g, or t
  modified_base (321)..(321): a, c, t, g, unknown or other
  misc_feature (321)..(321): n is a, c, g, or t
  modified_base (343)..(343): a, c, t, g, unknown or other
  misc_feature (343)..(343): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccacatcaaactgcaagtccagccagtagtgttttattcggccccaacaataaacaactacttagcttggtaaccngacaagaaagtaggacagcctactaaactcctagtatttacngggtcctttacgtaccccgggntaacgttcccgggggttaccctaaaccggatttccgaaagtttcgggacctaacgggtcggggttacctacggggggtacccctaagtttttacccaaccgtttcgttacccaaaccccgttaagttacccgaaggtcccgtaacgggtcccttacggccgtaaacgggtcgtagggtaaacgacgttacgggtacgggtacccgttaaggtttaaacgtttaacgtcgggttacctaacggtacctaaacgtaaacgtttattaaccgtttcttttaccgttactaccgttttacggggcccggtaaagggtacccgtaaagggtcggtaagacgtaaccgtaaaacggacgttacggtacggtactacggacctaccgtaaccgtacttcggttacccttacgttaccg

SEQ ID NO: 65308 - DNA, 680 bp, Homo sapiens
  misc_feature: GYAE6OF02JI28P.31.78.H01.1.454.CMB.1.raw
  modified_base (312)..(312): a, c, t, g, unknown or other
  misc_feature (312)..(312): n is a, c, g, or t
  modified_base (326)..(326): a, c, t, g, unknown or other
  misc_feature (326)..(326): n is a, c, g, or t
  modified_base (346)..(346): a, c, t, g, unknown or other
  misc_feature (346)..(346): n is a, c, g, or t
tcagcagtagacgtcacgaccggtgctcgatttagtgtgagtagtttgggtttgggggtaggcgtacaacaggcaggcaggggcgagcaagatggtgttgcagacccaggtcttcatttctctgttgctctggatctctggtgccgtacggggacatcgtgatgagccagtttccagactccctggctgtgtctctagggcgagagggcccaccgatcaactgcaagtccagccagacgttgttttattcggccccacaataacactacttgcttggtaccagcagaaagtaggacagtccctactaaaccncttcgaatttacgngggtccttccgtacccgggntacgttcccggggttacctaaccgagttcagtttcggctacggacggttctcggggaaccgtactttcacttcgtaccgacctaatcaacgtcacgtccctggaccaggtccctaggaaacgagttcggtacggtccgttaagtttaacgttaccgttaggtacctacgaaccgtaaacgtaatttacgttacccttttacgtttccgttaccgtaccgtttacgggccgggttaacggaaccgtaaggttgggacgtaagttacccgaaaacggttaacgtcggtacggttcctacggaccgtaacctgttacctccggtttacttactaccg

SEQ ID NO: 65309 - DNA, 658 bp, Homo sapiens
  misc_feature: GYAE6OF02JTU36.31.78.H01.1.454.CMB.1.raw
  modified_base (213)..(213): a, c, t, g, unknown or other
  misc_feature (213)..(213): n is a, c, g, or t
  modified_base (270)..(270): a, c, t, g, unknown or other
  misc_feature (270)..(270): n is a, c, g, or t
  modified_base (357)..(357): a, c, t, g, unknown or other
  misc_feature (357)..(357): n is a, c, g, or t
  modified_base (415)..(415): a, c, t, g, unknown or other
  misc_feature (415)..(415): n is a, c, g, or t
  modified_base (588)..(588): a, c, t, g, unknown or other
  misc_feature (588)..(588): n is a, c, g, or t
  modified_base (593)..(593): a, c, t, g, unknown or other
  misc_feature (593)..(593): n is a, c, g, or t
tcagcagtagacgtcacgaccggtgctcgatttagtgtgagtagtttgggtttgggggtaggcgtacaacaggcaggcgaggggcgagcaagatggtgttgcagaccaggtcttcatttctctgttgctctggatctctggtgcctacggggacatcgtgatgagccagtttccagactccctggctgtgtctcgtgggcgagacgggccacntcaactgcaacgtccaagccagagtgttttatcggccccactaataacactacgtancttggtaccaggccaggaaaagtgggacagtccctacctaaactccctaggtatttaccgtggggtacctttaccgaccccggggtntacgttccccgggggttacctaaaccgagttcctagttacgggctaacgggccgggtnttaccgggggtaccctaattttccacctccgtaccaacccgttatactaagccgtaacgtccctaggaccgtacggccgtaagacgtagtggtccggacttaggttttaactcgtgtaccgatcaacgtattacttacttctttcacttcgtttcggccggtaggtactaggnggtanagtacccgaaaggtacctggtacgcgttaaccgactaccgtattccggtagttaccttacgtccg

SEQ ID NO: 65310 - DNA, 576 bp, Homo sapiens
  misc_feature: GYAE6OF02HN4AW.31.78.H01.1.454.CMB.1.raw
  modified_base (236)..(236): a, c, t, g, unknown or other
  misc_feature (236)..(236): n is a, c, g, or t
  modified_base (448)..(448): a, c, t, g, unknown or other
  misc_feature (448)..(448): n is a, c, g, or t
  modified_base (452)..(452): a, c, t, g, unknown or other
  misc_feature (452)..(452): n is a, c, g, or t
  modified_base (469)..(469): a, c, t, g, unknown or other
  misc_feature (469)..(469): n is a, c, g, or t
  modified_base (538)..(538): a, c, t, g, unknown or other
  misc_feature (538)..(538): n is a, c, g, or t
  modified_base (561)..(561): a, c, t, g, unknown or other
  misc_feature (561)..(561): n is a, c, g, or t
  modified_base (571)..(571): a, c, t, g, unknown or other
  misc_feature (571)..(571): n is a, c, g, or t
tcagcagtagacgtcacgaccggtgctcgatttagtgtgagtagtttgggtttgggggtaggcgtacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagcctagagtnttttattggccccacaataacaacgtacttagcttggtacagcaagaaagtggaacagaccctcctaaaactcctgtaatttactgggccttactaccccggggcaagttcccggggtttaccaaccgattccagttggcctagcgggtctcgggggaaccctgttttaccagtccctacacccgtagtccagccagccctgcagctagaanaagngtgacgtagtttaactntagtcagtcaactattattaccgttacttcgtacctacgttcgtcgggaaggaccaagggttgacgtanacgaaacgaatgaggctggcacntctacgtctntaccg

SEQ ID NO: 65311 - DNA, 724 bp, Homo sapiens
  misc_feature: GYAE6OF02F46ZH.31.78.H01.1.454.CMB.1.raw
tcagcagtagacgtcacgaccggtgctcgatttagtgtgagtagtttgggtttgggggagcgtacaacaggcaggcaggggcagcaagatggtgttgcagacccaggtcttcatttctctgttgctctggatctctggtgcctacggggacatcgtgatgagccagtttccagactccctggctgtgtctctgggcgagaggccacatcaactgcaagtccagccagagttgttttattcggccccacaataacaactacttagcttggaccagcagaaagtaggacacgcctacctaaactcctgtatttacgtgggtactttcgtacccgggctacgttcccggggttacctaaccgattccagtttcggctagggtccgggtacgtcgggtaacccgtattttccgaccttccgtaccaacccgtatccgaagccagtccctaggcgacgggtcctaggaaacgtacgtggtacggtacgttaagttttaacgttacgttagtaccgtaagtacctaaacttaacttttaacgttaaccgttttaccgtttttaccgttaccgttaaccggtttttaccgggaaccggggtacgggtaaacccggtaaagggttacggggtaacgtaacgttaacccgtaaaaccgggttaacgttcgggtaacggtaccgttacgacccgtaaccgtaccgttacccgtaggtttaccccttattacccg

SEQ ID NO: 65312 - DNA, 560 bp, Homo sapiens
  misc_feature: GYAE6OF02HROS5.31.78.H01.1.454.CMB.1.raw
  modified_base (403)..(403): a, c, t, g, unknown or other
  misc_feature (403)..(403): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctacctaaactcctgatttactggcttctaccgggcagtccgggttcctaacgattcattggcagcggtctgggaccatttcactctcacatcagcagcctgcaggctgaagntgtgctagtttacttactgttcagcaaactatttaactacctttctttacgtctacgtttccgggacggaggtaccgaagggtggagaactaccgaaacggtaacttcggtacgggtactggtaccaacctagttaccgttcgttacctttctaccg

SEQ ID NO: 65313 - DNA, 599 bp, Homo sapiens
  misc_feature: GYAE6OF02FWBG6.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagttgttttattcggccccacaataacaactactagcttaggtaccagcaagaaagtaggacagccctacctaaactcctgtaactttacgtgggtcctttccgtaccccgggcacgttccccggggttacctaaccgatttccattcggaccaggtccgggtctacggggaccctatttccactcctacaaccatccagcacgcctgcaggctagaagagtggtggcttagtttactactgtcaagccaactattaacttactttctttacgtctacgtttcggcggtaacgggtaccgaagggtcgagtacgtacgaaacggtacttacggtacggtcgtcgacgtacctatcgtcgttcttctaccg

SEQ ID NO: 65314 - DNA, 624 bp, Homo sapiens
  misc_feature: GYAE6OF02G4WQZ.31.78.H01.1.454.CMB.1.raw
  modified_base (324)..(324): a, c, t, g, unknown or other
  misc_feature (324)..(324): n is a, c, g, or t
  modified_base (422)..(422): a, c, t, g, unknown or other
  misc_feature (422)..(422): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctcgtgggcgaggcggccaccagtcaactgacaagtccagccagagttgttttattcggccccaacaataacaactacttagcttggaccagcaagaaagtggacagacctacctaaacgtcctagtactttacgngggtccttacgtacccgggctacgttcccggggttaccctaaccggattccagttcggcgtaggtccgggtctacggggacctatttcactctccacntccagccagcctgacgaggctagaacgatggtcggtactagtttacgttactgtacacgtacctaacgtattacttactttctttcgtacttaccgtttcgggacggtaacggaaccgtagggtaggacgtacgtaacgaaaccgtaacgttgggtacggtcctaggaccctacctacgttacctcggttaccttactaccg

SEQ ID NO: 65315 - DNA, 792 bp, Homo sapiens
  misc_feature: GYAE6OF02JUJIT.31.78.H01.1.454.CMB.1.raw
  modified_base (314)..(314): a, c, t, g, unknown or other
  misc_feature (314)..(314): n is a, c, g, or t
  modified_base (383)..(383): a, c, t, g, unknown or other
  misc_feature (383)..(383): n is a, c, g, or t
tcagcagtagacgtcacgaccggtgctcgatttagtgtgagtagtttgggtttgggggtaggcgtacaacaggcaggcaggggcagcaagatggtgttgcagacccaggtcttcatttctctgttgctctggatctctggtgccgtacggggacatcgtgatgagccagtttccagctccctggctgtgtctcgtgggcgaggagggccaccagtcaactgcaagtccacgccagagttgttttacttcggcccctaacaataacaactacttagcttaggaccagcaggaaagtggacacgcctacctaaacncctagactttacgtcggtccttacgtaccccgggataccgttacccgggggttccctaaaaccccggtnttttaccgtacgttacggcgtaacggtcggggttccgttcgggggtaacccgtattttccgaaccgtccttacctaacccgtacgtaccaggtcccaacggtcccctaggaccgaacgggtcttaaccgggaaagtaaacggttcgggtcgggtaacctttaacggttttacgttttaaaccgtgttacccgtaagaaccgtaaaccgttagttttaaaccgttttaccttttaccgtttttaccgggttaacctttaaccgggtttccggggttaaaccggggaaacggttaacccgtaaggggttacgggtacgttaaagttacccgaaaacggttaaacccggttggttaaccgggttcgtaaccgtaccttaaccggaagttccgttacgttaccgttctaccgg

SEQ ID NO: 65316 - DNA, 612 bp, Homo sapiens
  misc_feature: GYAE6OF02GEF5V.31.78.H01.1.454.CMB.1.raw
  modified_base (234)..(234): a, c, t, g, unknown or other
  misc_feature (234)..(234): n is a, c, g, or t
tcagcagtagacgtcacgaccggtgctcgatttagtgtgagtagtttgggtttgggggagctacaacaggcaggcaggggcagcaagattggtgttgcagtacccaggtcttcatttctctgttgctctggatctcgtggtgcctacgggacatcgtgatgagccagtttccagactccctggctgtgtctctggcagacggccacatcaacgtgcaagtccagccagtaggtnttttaattcgggccccacaataacaactacttagcttggtaccagcagaaagtaggacagcctacctaaaactccgtgagtttacctgggtcttccgtaaccccgggcaacgttcccggggttacctaaaccggtatttccgaagtttacggccctaaggtccgggttactcggggaaccctagttttccactctcgaaccatcagcagcctgcaggctagacgatggtggactagtttatactgtccagctaactatttagactttctttacgtcacgtttcgggacgtacggtacgaagggtcgagacgttaccgaaaacgtaccttggacggtaccgtggacctaccgttacgtccgttcgttccgttactaccg

SEQ ID NO: 65317 - DNA, 528 bp, Homo sapiens
  misc_feature: GYAE6OF02ITGF5.31.78.H01.1.454.CMB.1.raw
  modified_base (525)..(525): a, c, t, g, unknown or other
  misc_feature (525)..(525): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttactgggcttctacccgggctacgtcccggggttacctaaccgattcatttggcagcgggtctgggaccgatttcactctcaccatcagcagcctgcaggctgaagatgtgctagtttatactgtcagcaactattatacttctttcgtctactttcgggcggacggtacaagggtgagatacgaaacgtaactgtagctgacactatcgtcgttctntac

SEQ ID NO: 65318 - DNA, 508 bp, Homo sapiens
  misc_feature: GYAE6OF02FGTLU.31.78.H01.1.454.CMB.1.raw
  modified_base (308)..(308): a, c, t, g, unknown or other
  misc_feature (308)..(308): n is a, c, g, or t
  modified_base (324)..(324): a, c, t, g, unknown or other
  misc_feature (324)..(324): n is a, c, g, or t
  modified_base (342)..(342): a, c, t, g, unknown or other
  misc_feature (342)..(342): n is a, c, g, or t
  modified_base (505)..(505): a, c, t, g, unknown or other
  misc_feature (505)..(505): n is a, c, g, or t
tcagcagtagacgtcacgaccggtgctcgatttagtgtgagtagtttgggtttgggggagctacaacaggcaggcagggcagcaagatggtgttgcagacccaggtcttcatttctctgttgctctggatctctggtgcctacggggacatcgtgatgagccagtttccagactccctggctgtgtctctgggcagaggccaccatcaactgcaagtccagccagagtgttttattcggccccacaataacaactacttagcttggtaccagcagaaagtaggacagcctctaaactcctgatttacngggcttctacccgggnatccgggttcctaaccgnttcattggcagcggtctgggaccgatttcactctcaccatcagcagcctgcaggctgaagatgtgctagtttatactgtcagcaactattatactttctttcgtctacgtttcggcgaggaccaaggtgagatcgaaacgactggtgctgcacatctgtcttntac

SEQ ID NO: 65319 - DNA, 632 bp, Homo sapiens
  misc_feature: GYAE6OF02GRL2O.31.78.H01.1.454.CMB.1.raw
  modified_base (322)..(322): a, c, t, g, unknown or other
  misc_feature (322)..(322): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctcgtgggcgaggacgggccaccatcaactgcaagtccagccagtagttgttttattcggccccaacaaataacaactacttagcttggtaccagcaagaaagtaggacacgcccctaaatcctagtattacgngggtccttccgtacccgggcacggttcccggggttacctaaccggtattccagttcgggcagggtcgggtcgtcgggacccgtatttcactctacaccatcagcacgcctgacgacggtcgtaggaagtagtggtggtacttagttttaacgttactggtacagtactaactatttacttactttctttcgtacttacgtttccgggacgggtaacggtaccgtaagggtacgaacgtactaaccgaaacgtaacgttggtacggcttacggacctacgtaccttcgttcgttaccttcgtacttccccg

SEQ ID NO: 65320 - DNA, 579 bp, Homo sapiens
  misc_feature: GYAE6OF02H3P3Z.31.78.H01.1.454.CMB.1.raw
  modified_base (233)..(233): a, c, t, g, unknown or other
  misc_feature (233)..(233): n is a, c, g, or t
  modified_base (312)..(312): a, c, t, g, unknown or other
  misc_feature (312)..(312): n is a, c, g, or t
  modified_base (329)..(329): a, c, t, g, unknown or other
  misc_feature (329)..(329): n is a, c, g, or t
  modified_base (353)..(353): a, c, t, g, unknown or other
  misc_feature (353)..(353): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgaggagggccaccatcaactgcaagtccagccagagtnttttattggcccccacaataacaactacttagcttggtaccagcaagaaagtaggacagcctcctaaactcctgattcngggcttcgtacccgggntacgtcccgggttacctaaccgtnttcagttggaccagcgggtcgtcgggaaccctatttccaactcctacacctatcgaagcacgcctgcaggctagaagtatggtcgtactaaggtttattactgtacagacaactatttaactacctttctttacgtctaccgtttcgggcggaaggtaccaagggtcgagtacgtaacgaaacgtaccgtggtacgctacgaccacctagtcctagttcctatacc

SEQ ID NO: 65321 - DNA, 548 bp, Homo sapiens
  misc_feature: GYAE6OF02I0DZD.31.78.H01.1.454.CMB.1.raw
  modified_base (532)..(532): a, c, t, g, unknown or other
  misc_feature (532)..(532): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggaccccaaccaataacaactacttagcttgtaccagcagaaagtaggacagcctacctaaactcctgatttactgggtcttccgtacccgggcacgttcccggggttcctaaccgattcattggcagcgggtctgggaccgtatttcactctcaccatcagcagcctgcaggctagaagatggtcggactagtttatactgtcagtaccaacgtattaactactttacctttcgtctacgtttcggcggacggtacaaggtggagataacgaaagtaatggtgcgtgacnctatcgtctcttctac

SEQ ID NO: 65322 - DNA, 772 bp, Homo sapiens
  misc_feature: GYAE6OF02JFAEN.31.78.H01.1.454.CMB.1.raw
  modified_base (314)..(314): a, c, t, g, unknown or other
  misc_feature (314)..(314): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacaactacttagcttggtaccagcagaaagtaggacagcctacctaaactcctagatttacngggtccttaccgtacccgggcaacgttcccggggtttcctaaaccggtatttccaagtttcggcctaacggtccgggttaccgtaggggaccccgtagttttccgaacgttccgttaccaaccctacgttaccgaacgtaccaacggtcccgtacggaccgaacgggtaccttaggtaaacttagttcgggttacgggacctttaaaggttttaactttaccgttagttacccaacggtacccgtaaaaccttaacgttttaaccttaaccctttttaccgttttaccggttacccgttaaccgtttttccggggaaccgggtaaaccggggaacccgttaaaggggttcggtaacgtaacgttaacccggtaaaaacggtaccgtttagggtaacgggtacccttaacggacccgtaaccgtacgttaccgttacggttaccctttaccgtaacccg

SEQ ID NO: 65323 - DNA, 606 bp, Homo sapiens
  misc_feature: GYAE6OF02IKI3F.31.78.H01.1.454.CMB.1.raw
  modified_base (318)..(318): a, c, t, g, unknown or other
  misc_feature (318)..(318): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctctgggcagaggccaccatcaactgcaagtccagccagagttgttttattcggccccacaataacaactacttagcttaggtaccagcaagaaagtaggacagcctacctaaactcctagtatttacgnggtccttcgtacccgggctacgttcccggggttaccctaacgcttacgagttcggcaggtcgggtctcgggactattcactctacacatcagcagtcctgacgaggctgaagtatggtcggacttagtttacttactcgtacgacgactaacttattaacttactttccgtttacgtaccttaccgtttcgggaccgggtaacgggtaacccgtaagggtacgagtaacgtacgaaaccggtaactggtacggtcgtcgacaccgtattcgtacgttcttacgtaccg

SEQ ID NO: 65324 - DNA, 561 bp, Homo sapiens
  misc_feature: GYAE6OF02HN708.31.78.H01.1.454.CMB.1.raw
  modified_base (352)..(352): a, c, t, g, unknown or other
  misc_feature (352)..(352): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagactccctggctgtgtctctgggcgagagggccaccatcaactgcaagtccagccagagttgttttattcggccccacaataacaactacttagcttggtaccagcaagaaagtaggacagcctctaaactcctagtattacgtggacttcgtactcgggcatccggggttcctaacgtnttcattggcaggcgggtctgggaccgtatttcactctcacctatccgagacacgcctaggtaggctagaagagtgtggctagtttattactgtcagacaactatttacttactttctttcgtacttacgtttcgggcggtaacggacctaagggtgagtatacgaaacgacgtgtcggactagccaaccgtattcgtcgttctacgtac

SEQ ID NO: 65325 - DNA, 832 bp, Homo sapiens
  misc_feature: GYAE6OF02HR1XO.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagtttccagacctccctggctgtgtctcgtgggcgagacgggccacatcaactgacaagtccagccagagttgttttattcggccccacaataacaactacttagcttggtaccagacaagaaacgtaggaacacgccttacctaaactcctagtatttacgtcgggtcttccgtacccggggactacggttccccggggttacctaaaccggtacttcctaagtttcgggacccgttaaggtcccgggggttacgtacgggggtaacccgttattttccgaaccttcctaccaaccccgtaacttccgaacggtcccgtaacggtacccgttcggtaccgtaagggtaccgttaacgggaaaacggttaacgttacggggttacggggtaacccgtttaagggtttttaaccttttaaccggttcgggttaacccgtaacgtaaccgtaaaaccgttacgtttttaaaactttaccgttttacccgttttacccgggttacccgtttaaccggtttttacccggggaccgggggttaaacgggtaacccgtaaagggggttacgggtaacggttaacgtaaacccgtaaaacggtaaccgttagggtaccgggttacgtacgtaccgtaaccgtactttaccggttacgtttaccttacgttaaccg

SEQ ID NO: 65326 - DNA, 718 bp, Homo sapiens
  misc_feature: GYAE6OF02IDH0E.31.78.H01.1.454.CMB.1.raw
tcagcagtagacgtcacgaccggtgctcgatttagtgtgagtagttgggtttgggggtaggcgtacaacaggcaggcaggggcgagcaagatggtgttgcagaccaggtcttcatttctctgttgctctggatctctggtgcctacggggacatcgtgatgagccagtttccagacctccctggctggtgtctctgggcgagagggccaccatcaactgcaagtccagccagagttgttttagttcggcccccaactaataacaactacttaagctttggtaccagcaagtaaaggtagacagcctacctaaactcctagtattacgtcgggtaccttacgtaccccggggcaacgttccccgggggtttacctaaaccggtaactttcctagtttcggccgaaggtcccggggttactcggggggaacccttacgtttttccgaacctccgttaacccgacctacgtaccgtacggacctacggcccgttaggacccgtacggccgttaagggaaaccggtgttaccggtagggtaccttaaggtttacgtttacgtgttaccgagtaccacttaattacttacgtttctttacgacctttacggttccgggtacgggtacgaaccgtagggttcgaagtacttaaccggtaaacgtaagtcggtaacggtccgtacggtaccaccgttacttacgtcgtttccgttacttaacccg

SEQ ID NO: 65327 - DNA, 564 bp, Homo sapiens
  misc_feature: GYAE6OF02H2FIC.31.78.H01.1.454.CMB.1.raw
  modified_base (384)..(384): a, c, t, g, unknown or other
  misc_feature (384)..(384): n is a, c, g, or t
  modified_base (510)..(510): a, c, t, g, unknown or other
  misc_feature (510)..(510): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccctaacaataacaactacttagcttggtaccagcaagaaaagtaggacaagccctacctaaaactcctagatttaactgggctttccgtacccgggcagttccggggttccctaaaccgattcaattcggcagccgggtntgggaccgtatttcgactctcacatcagcagcctgcgagctgaaagataggtggctaagtttattactgtacaagcaactaattacttacttctttcgtctacgtttcgcgggaggaacctagggngagtactacgaaaacgtactgtaggtctcgactaccattacgtgttcttctacc

SEQ ID NO: 65328 - DNA, 606 bp, Homo sapiens
  misc_feature: GYAE6OF02HDX9W.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggccccacaataacaactacttagcttggtaccagcagaaagtaggacagcctacctaaactcctagtactttacgtgggtccttccgtacccgggctacgttcccggggttacctaaacccggtatttccaagtttcggacctaggtccgggttcgtcggggaccctattttccgacttcctaccacctatccagcacgcctgcaggctagaagatgtgctagtttattactgtcagtacaactattactactttcgtttcgtccttacgtttcggacggtacggaaccgtaagggtcggacgtactaaccgaaacgtactagggtcggtactacgacctacctatccgtacgttcctactacg

SEQ ID NO: 65329 - DNA, 620 bp, Homo sapiens
  misc_feature: GYAE6OF02H0FOP.31.78.H01.1.454.CMB.1.raw
  modified_base (354)..(354): a, c, t, g, unknown or other
  misc_feature (354)..(354): n is a, c, g, or t
  modified_base (438)..(438): a, c, t, g, unknown or other
  misc_feature (438)..(438): n is a, c, g, or t
  modified_base (442)..(442): a, c, t, g, unknown or other
  misc_feature (442)..(442): n is a, c, g, or t
  modified_base (465)..(465): a, c, t, g, unknown or other
  misc_feature (465)..(465): n is a, c, g, or t
tcagcagtagacgtcacgaccggtgctcgatttagtgtgagtagttgggttgggggagctaacgaaccaaggcacggcaggggcagccaagatggtgttgcagacccaggtcttcgagtttcctcgtgttgctcttggatctctggtgccgtacggggacagtcgtcgatcgagtccagtttccagacctccctggctgtgtctcgtgggcgaggagggccaccagtccaactgacaagtccagccagagttgttttattcggccccctaagtaataacctaacttacttacgcgttaggtaccagtctaaggaaagtaggacacggcctaccgtaaactcctaggatttacgngggtccttacgacccgggtcacgttcccggggttaccaaccgtattcgagttcggcaggcgggtctgggacgtatttcgactcncacntcagcagcctgcaggctagaagntggtcgtacgtagtttacgtacgtgtcagtacaactattactacttcgttacgtctacgtttcggcggtacggaccgtaagggtggagtagtacgaaacgtacgttcggtcggtacctggacctaccgtacttccgttacgttccgtactacccg

SEQ ID NO: 65330 - DNA, 542 bp, Homo sapiens
  misc_feature: GYAE6OF02FRHW7.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacaactacttagcttggaccagcagaaagtaggacagcctacctaaactcctgatttactgggcttctacccgggcagtcccggggttcctaaccgattcattggcagcgggtctgggaccgatttcactctcaccatcagcagcctgcaggctgaagatgtggctagtttatactgtcagcaactattatacttcctttgtcctacgtttcggacggtacggaccgaagggtggagagtacgaaacggaacttggtcggtctaggactaccgatcgtcgttcttctacg

SEQ ID NO: 65331 - DNA, 633 bp, Homo sapiens
  misc_feature: GYAE6OF02HO684.31.78.H01.1.454.CMB.1.raw
  modified_base (384)..(384): a, c, t, g, unknown or other
  misc_feature (384)..(384): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgaggacggccaccatcaactgacaagtccagccagtagttgttttattcggccccaacaaataactaactacttacgtcttacggtaaccagacaagtaaagtacgacacgccctaccctaaactccgtagtactttacgtcgggtccttccgtacccgggctacggttcccggggttacctaaccgtnttactagttcggcagggtccgggtcgtacggggaaccctatttccactctaccaacctatcgacgcacgcctcgcgacggtcgtagaagtagtggtggacttagtttattactcgtacagtactaactattacttacctttctttcgtacttacgtttcggacgggtacggaaccgtagggtcggagtactaacgaaacgtacgtaggtcggtacgtagacctaccgtacttcgtacgttcctactacc

SEQ ID NO: 65332 - DNA, 774 bp, Homo sapiens
  misc_feature: GYAE6OF02JF1AX.31.78.H01.1.454.CMB.1.raw
  modified_base (322)..(322): a, c, t, g, unknown or other
  misc_feature (322)..(322): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagcctagtttccagactccctggctgtgtctcgtggcgagagggccaccatcaactgcaagtccagccagagttgttttatcggccccacaataacactacttagcttcggtaccagctaaggaaagtaggacacgcctaccgtaaactcctagactttacgngggtacttccgacccgggatacgttcccggggttacctaaaccgtgttacagttcggactagggtccgggttcgtacggggaacccgttattttccgaaccgttccgttacccaaacccgtattccgaacgaccgtacgcccgttacggaccgtaacggggaccttaggtaaacgtacggttacgggtagggtaccctttaaggttttaacctttacgttacggtaccgtaacggtaaccttaaacgttacttttaaacctttacccgttttaccgttttaccggttacctttaacggggttttccgggaaccgggttaaacgggtaaccgttaaacggggttcggaacggttaacgtaaccgtaaaccgggttaacttcgggtaaccgggtaccttacgggaacccttaccgtaccggtttacctttacgggttaccctttaggtaacccc

SEQ ID NO: 65333 - DNA, 735 bp, Homo sapiens
  misc_feature: GYAE6OF02H8Q88.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcagaggccacatcaactgcaagtccagccagagttgtttttattcggccccctaactaaataaccaactacttagctttggtaaccagtcaagtaaagtaggacacgtacctacctaaaactccgtagtaactttaacgtgggtcttaccgtacccggggactacgttcccggggtttaccctaaacccggtatttcccgaagtttccggacctaacggtcccgggggttctaccggggggtaacccttaacttttccggaaccttccgtacccaacccggtattccgaaggtccacggtacctcggacgtaacggtcgtacggaaagtcgtaggtcggacttagttttacttacgtggttaccaagtccaaacttagtttaccttaacgtttccgttttaccgtacgtaaccgttttccgggacggtaacgggtaacccgtaaagggtcggtaagtaaccgttaaccgtaaaacggtaactcgggtaacgtaccgtaggtacctaaccgtactttccgtacgtttcccttaacttcccgg

SEQ ID NO: 65334 - DNA, 577 bp, Homo sapiens
  misc_feature: GYAE6OF02IWXJC.31.78.H01.1.454.CMB.1.raw
  modified_base (313)..(313): a, c, t, g, unknown or other
  misc_feature (313)..(313): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctaaggggacatcgtgatgagccagtttccagactccctggctgtgtctctgggcgagagggccaccatcaactgcaagtccagccagagtgttttattggccccacaataacaactacttagcttggtaccagcagaaagtaggacagcctacctaaactcctagatttacngggcttccgtacccgggcacgttcccggggttacctaaccggtattccgagtttcggctaggccgggtctggggacccgtattttccacttctcacctatcaagcacgcctgcaggctagaagatgtggctagtttatactgtcagcaactattattactttctttacgtctacgtttcgggcggaggtaccgaagggtcggagtactacgaaaacgtaaccgttggtcggctagcctaccgtacttcgtcgttacttcctacg

SEQ ID NO: 65335 - DNA, 633 bp, Homo sapiens
  misc_feature: GYAE6OF02HWVQF.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagtgttttattggaccccacaataacaactacttagcttggtaccagcagaaagtaggacagcctacctaaacctcctagattttacgtgggtccttccgtaccccggggcacgttccccggggtttacctaaaccgtattccagtttcggctaggcggggttactggggtaccctattttccacgttccttacacccatccagccgacgtcctgacgacggtactaggaagtagtggtcggtacgttaagttttaacttactcgtacacgtaactaacgttattacttacctttcgttcgtacttacgttcgggacggaacggtaacgagggtagagtacgtaacgaaacggttacctggtcgtacgtagaccgtacctacttcgttacgttcctacttaccc

SEQ ID NO: 65336 - DNA, 561 bp, Homo sapiens
  misc_feature: GYAE6OF02JW226.31.78.H01.1.454.CMB.1.raw
  modified_base (309)..(309): a, c, t, g, unknown or other
  misc_feature (309)..(309): n is a, c, g, or t
  modified_base (402)..(402): a, c, t, g, unknown or other
  misc_feature (402)..(402): n is a, c, g, or t
  modified_base (434)..(434): a, c, t, g, unknown or other
  misc_feature (434)..(434): n is a, c, g, or t
tcagcagtagacgtcacgaccggtgctcgatttagtgtgagtagtttgggtttggggagctacaacaggcaggcaggggcagcaagatggtgttgcagacccaggtcttcatttctctgttgctctggatctctggtgcctacgggacatcgtgatgagccagtttccagactccctggctgtgtctcgtggcgagaggccaccatcaactgcaagtccagccagagttgttttattggccccacaataacaactactagcttaggtaccagcagaaagtaggacagcctaccaaatccctgatttacnggcttcgacccgggcatcccggggttacctaaccgattcattcggcaggtcggtctgggaccctatttccactctcaccatcagcagcctgcnggctagagatgtgactagtttactactgtacngacactattataacttcgtttcgtactacgttttcggacgacgggtaccaagggtgtagaagttaccgaaacgtacgtggtacggacttacgaccgtaccatttaccgtacggttccttacgtaccg

SEQ ID NO: 65337 - DNA, 815 bp, Homo sapiens
  misc_feature: GYAE6OF02ISG5W.31.78.H01.1.454.CMB.1.raw
tcagcagtagacgtcacgaccggtgctcgatttagtgtgagtagtttgggtttgggggaggctacgaacaggcaggcaggggcagcaagatggtgttgcagacccaggtcttcatttctctgttgctctggatctcgtggtgccgtacggggacatcgtgatgacgcctagtttccagacctcccgtggctgtgtctcgtgggcgaggacgggccaccatcgaactggacaacgtccagcccaggtgtttagttttacgttccggcccccaaactaaactaaacgtaaccttaacgttacgtccgttacggtaaccaagtacgaacgtaaaacggtagaaccgtagtacccttaaccgttaaaaccttccgttaggtactttaacggtcggggtacctttaccggaccgggtactacggtttacccggggtttaccctaaacgtcgtttacgacgtttcgggtaccagggttcccgggttacgtacggggtaacccgttagttttacccgaccgtaccttaccgaacccgtaatcccgtaaggtccgaacgtcccgttacggacggtacggtaccgtaaggaaacgtaggtacggtcggtacggtttaacgtttacgtttacgttacgtacgtaacgtaaccgtaaattaacttacgtttaacgtttccgttttacgtaccgttacggtttaccgggacggggtacggtaaaccgggtacgggtaggtacggtaacgttaacggaaaccggtaaccgttagggtcggtaccgtacgtaccgtaacgttaccgtccgtacgtttccgtctaacccg

SEQ ID NO: 65338 - DNA, 552 bp, Homo sapiens
  misc_feature: GYAE6OF02GJ9T6.31.78.H01.1.454.CMB.1.raw
  modified_base (419)..(419): a, c, t, g, unknown or other
  misc_feature (419)..(419): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacaactactagcttggtaccagcagaaagtaggacagcctacctaaactcctagtatttacgtgggcttctacccgggctacgttcccggggttcctaaccgattcattcggcagcgggtctgggacctatttcactctcaccatcagcagcctgcaggctgaacgntgtggctagtttactactgtacagcaactattactactttctttcgtctacgtttcggacggacggtaccgaaggtggagacgtacgaaacggtactggtacggtactgacctactagttctcgttcttctac

SEQ ID NO: 65339 - DNA, 571 bp, Homo sapiens
  misc_feature: GYAE6OF02FTK88.31.78.H01.1.454.CMB.1.raw
  modified_base (501)..(501): a, c, t, g, unknown or other
  misc_feature (501)..(501): n is a, c, g, or t
tcagcagtagacgtcacgaccggtgctcgatttagtgtgagtagtttgggtttgggggagctacaagaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggccccacaataacaactactagcttggtaccagcagaaagtaggacagcctacctaaactcctagtatttactgggctttcgtaccccgggctacgttcccgggggttacctaaccgtattcctaattcggctaggcgggttctaggggaccctatttccacttcctcacctatcacgcacgcctgcaggctagaagagtggtgctagtttactacttgtcagactaactatttatactttcttcgtctacgtttcggnggtacggacgaggtgagactacgaaacgtacgtggtacggctagaccacctagtctacgttcctactacc

SEQ ID NO: 65340 - DNA, 572 bp, Homo sapiens
  misc_feature: GYAE6OF02GCK82.31.78.H01.1.454.CMB.1.raw
  modified_base (329)..(329): a, c, t, g, unknown or other
  misc_feature (329)..(329): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttactgggtcttcgtacccgggnacgtccggggttacctaaccgattcattcggcaggcgggtctgggaccgtatttcactctcaccatcagcagcctgcaggctgaagagtgtgctagtttatactgtacagactaactattattactttcgtttcgtctacgtttccgggacggtacggaaccgtaagggtggagtacgtaaccgtaaacggtaacgttcggtaggtacctagtaccaccgtattcctcgttaccttcgtaccc

SEQ ID NO: 65341 - DNA, 715 bp, Homo sapiens
  misc_feature: GYAE6OF02HU44U.31.78.H01.1.454.CMB.1.raw
  modified_base (247)..(247): a, c, t, g, unknown or other
  misc_feature (247)..(247): n is a, c, g, or t
  modified_base (320)..(320): a, c, t, g, unknown or other
  misc_feature (320)..(320): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagctccctggctgtgtctctgggcgagagggccaccatcaactgacaagtccagccagagtgtttattggcccccanaataacaactactagcttggtaccagcaagaaagtaggacagccctacctaaaactcctagaacttttaccgnggggtacctttaccgtaccccgggggataaccggttccccgggggttttaaccctaaaccggtactttaccgtaagtttacggccaaagggtcccggggttacgtgggggtaacccctaaattttcccgacttcctccgaacctaacgtccaaggccaagcccgtagccgaaggtctagtaagagtaggtggcgtaaggtttaacttacgtagttaccaacgacaaacctattaacttaaccttccgtttcgttacctaaccgttttccgggaccgggtaacgggtaaaccgtaacgggttacgggaacggtaacgttaacgaaaaccgtaacgtcggttacggtaccgtaggtaccctacctaaacgttcgttacgttaccgttaccttaaccg

SEQ ID NO: 65342 - DNA, 873 bp, Homo sapiens
  misc_feature: GYAE6OF02GI4VU.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctcgtgggcgagaggccaccatcaactgcaagtccagccagtagttgttttattcggaccccaaccaataaccaactacttagcttggtaccagcaagaaagtagacagcctacctaaactcctgactttacgtgggtcttccgtacccgggctacgttcccggggttacctaaccggtattcctagtttcggacgtacgggtccggggttccgttacgggggacccgtaagtttttcccaacccgtttcccttacccgtaacccctaacgttacccgaacggtacccgaaccggtaccccgttacggaccggtaaccggggtaccgttaacgggtaaaacgggtaaggttacgggttacggggtaccgtttaaacggttttttaaacgtttaccggtttacggttaccgttaacggtaaccttaaaacccttaacgttttaaaccttttaacccgtttttaccgttttttaacccggtttacccgtttaacccgggttttttacccggggaacccggggttaaaccggggtaaacccgggtaaacgggggttacggggtaacggtaaccggttaaccggtaaaaaccggttaaccgttacggggttaccgggtaccgttaccgggtaacccgtaacccgtaaccggtttacccgttacggttttacccgttacccgttaacccg

SEQ ID NO: 65343 - DNA, 556 bp, Homo sapiens
  misc_feature: GYAE6OF02FUVBM.31.78.H01.1.454.CMB.1.raw
  modified_base (443)..(443): a, c, t, g, unknown or other
  misc_feature (443)..(443): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggccccacaataacaactacttagcttggtaccagcagaaagtaggacagcctacctaaactcctgtactttacgtgggtctttccgtaccccggggctacgttcccgggggttacctaaccggtatttccagtttcggcacggcgggtctcggggaccgtatttccactctcaccatcagcagcctgcaggctgaagatgngctagtttatactgtcagacaactattatactttctttcgtctacgtttcggcggtaggaccgtaggtgagactacgaaacgtactgtcgctgccactactctcgtcttatac

SEQ ID NO: 65344 - DNA, 656 bp, Homo sapiens
  misc_feature: GYAE6OF02IMJRH.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattggccccacaataacaactacttagcttggtaccagcaagaaagtaggacagacctcctaaactcctgtactttaacgtggtccttccgtaccccgggcaacgttcccgggggtttaccctaaaccggtatttccgaagttcggcctaacgggccgggttaccgtagggggaacccgtaacttttccaacttcgtaccaaccctatcacggccacgccctggaccgaacggcctaggaactagttggtcggactaaggttttattactgtacaagactaaacttagtttaactacttttccttcgttctaaccgttttcgggacggacggaacctaagggtaggtacgtaactaccgaaaacggtacttgggtcgtaccgttagacctaccgacttccgtacgtttctaccgtaccg

SEQ ID NO: 65345 - DNA, 549 bp, Homo sapiens
  misc_feature: GYAE6OF02GIH1W.31.78.H01.1.454.CMB.1.raw
  modified_base (199)..(199): a, c, t, g, unknown or other
  misc_feature (199)..(199): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagngggccaccatcaactgcaagtccagccagagtgttttattggccccacaataacaactacttagcttggtaccagcaagaaagtaggacagcctacctaaactcctgatttactgggcttactacccgggcatcccgggggttacctaaccggattcattggcaggcgggtctgggaccgatttcgactctcaccatcagcagcctgcaggctgaagatgtggctagtttactactgtcagacaacgtatttaactactttctttccgtctacgttttcgggcggtaggaacctaagggtgagatacgaaacgaactggtacgctagcgtaccattctgttccttctacc

SEQ ID NO: 65346 - DNA, 682 bp, Homo sapiens
  misc_feature: GYAE6OF02JV317.31.78.H01.1.454.CMB.1.raw
  modified_base (318)..(318): a, c, t, g, unknown or other
  misc_feature (318)..(318): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagttgttttattcggccccaacaataacaactacttagcttggtaccagcaagaaagtaggacagcctacctaactcctgactttacgnggccttcgacccgggctacgttcccgggttacctaaccggtattcgaagttcggactacggtccgggtcgtacggggtacctagtttccaccgtcctacaaccctaagttccgaagtcgacgccctagccgtacgggtactaggaagtacgttggtacggtacttaaggttttacttacgttacggtactacgtacctaaacttacgtttaacttacccgtttaccgtttacgttaccgttacggtttaccgggacgggtacgggtaaccgtaaggggtaggtaacgtacgttaaccgaaacgtaaccgttggtacggtccgtacgaccgtaactacgttaccgttcgtccgttacctaacccg

SEQ ID NO: 65347 - DNA, 654 bp, Homo sapiens
  misc_feature: GYAE6OF02J07VH.31.78.H01.1.454.CMB.1.raw
tcagcagtagacgtcacgaccggtgctcgatttagtgtgagtagtttgggtttgggggaggctacaacaggcaggcaggggcagcaagatggtgttgcagacccaggtcttcatttctctgttgctctggatctctggtgcctacggggacagtcgtgatgagccagtttccagactccctggctgtgtctctgggcgagagggccaccatcaactgcaagtccagccagagtgtttattcggccccacaataaccaactactagcttggtaccagtcaagaaagtagggacagcctacctaaactcctgtatttacgtcgggtccttccgtaccccggggctacggttcccgggggtttacctaaccggatttccgaagttcgggtaccctagggccggggttactacggggaccctagttttccaaccttctacccgactactcgaacgcacgcctcgcgtacggctagaagatcggtagcgtagtttacgttacgtcgtaccagtacaacttagttacttactttaccgttttcgtaccttacgtttacggacggtacggtaccgtaagggtacgacgtacgtaccgaaacgtaaccggtgtaacggtcgtaccggacgtacctacgttaccgtcggttacttaccgtacg

SEQ ID NO: 65348 - DNA, 690 bp, Homo sapiens
  misc_feature: GYAE6OF02H2HQ7.31.78.H01.1.454.CMB.1.raw
  modified_base (201)..(201): a, c, t, g, unknown or other
  misc_feature (201)..(201): n is a, c, g, or t
  modified_base (368)..(368): a, c, t, g, unknown or other
  misc_feature (368)..(368): n is a, c, g, or t
tcagcagtagacgtccacgaccggtgctcgatttagtgtgagtagtttgggtttgggggatctacaacaggcaggcaggggcagcaagatggtgttgcagacccaggtcttcatttctctgttgctctggatctctggtgcctacggggacatcgtgatgagccagtttccagactccctggctgtgtctcgtgggcgagngggcccaccatcaactgcaagtccagccagagttgttttattcggacccccacaataacaactacttagcttggtaccagcaagaaagtaggacagccctacctaaaactccgtagaatttacgtgggtcttccgtacccgggctacgttcccgggttacctaacgnttcagtttcggcaggtcgggtctgggaccctagtttccacctctaccacctatccgagcacgcctggcagggcctaggaagtagtggtcggacttaagttttaacgtttacttcggtacaacggtacaaaccttaagttttaactttaaccttttccgttttaccgttacgttaaccggttttccgggaccggggtaaacgggtaaccgtaaagggttacgggaatacggttaaccgaaaaccggtaaccggtttaggggtacggtaccgttacggaccctaaccgtacgtttaccgttacggtttcctttacgttaacccg

SEQ ID NO: 65349 - DNA, 581 bp, Homo sapiens
  misc_feature: GYAE6OF02IAYWD.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccacatcaactgcaagtccagccagagtgttttattggcccccacaataacaactacttagcttggtaccagcaagaaagtggacagcctcctaaactcctgatttacgtgggcttacgacccgggctacgtcccggggttacctaaccggattcagttggctagtccggggtctgggacccgtatttccgactctcaaccagtcagtcagcctgcaggctagaagatggtggctagtttattactgtcagacaatatttattacttctttacgtctacgtttcggcggtaaggtaccgtaagggtggacgtagtaacgaaaccggtaagtcggtacggtactagacctacctagttaccgtacgttccttacgtaccg

SEQ ID NO: 65350 - DNA, 823 bp, Homo sapiens
  misc_feature: GYAE6OF02JXWJF.31.78.H01.1.454.CMB.1.raw
  modified_base (333)..(333): a, c, t, g, unknown or other
  misc_feature (333)..(333): n is a, c, g, or t
  modified_base (383)..(383): a, c, t, g, unknown or other
  misc_feature (383)..(383): n is a, c, g, or t
tcagcagtagacgtcacgaccggtgctcgatttagtgtgagtagtttgggtttgggggtaggcgtacaacaggcaggcgaggggcgagcaagatggtgttgcagacccaggtcttcatttctctgttgctctggatctctggtgcctacggggacatcgtgatgagcctagtttccagactccctggctgtgtctcgtgggcgagagggcccaccgatcaactgcaacgtccagccagagttgttttattcggcccccaacaataacaacttactagcttaggtaccagcaagaaagtaggacagcccttaccaaactcctagtactttacgnggtccttcctacccggggccacgttccccggggtttaccctaaacccggntttaccgagttcggaccgtacgggtccgggttccgttacggggtaaccccctaagtttttcccgaaccttcccgttaccgaaaccccaagtttccaacggtccaacggtcccgtcgtaccgacggtacccgttaaggaaacgtacgttcgggtcggtaaccttaacggttttaacgtttacgttacgttaccgaaccgtaacctaaaccgttaattttaacctttaaaccgtttttcccgtttttacccggttactttaaacccgggttttcccgggggaaaccgggtaaaccgggtaacccggttaaacgggtaggggtaaccttacgtttaaacccgggaaaaccggtttaaccggttaacgggttccggtaacccgttacggtaacccctaaccgttaccggtttcccgttacggtttaccctttaccgttaacccg

SEQ ID NO: 65351 - DNA, 568 bp, Homo sapiens
  misc_feature: GYAE6OF02JMBI1.31.78.H01.1.454.CMB.1.raw
  modified_base (328)..(328): a, c, t, g, unknown or other
  misc_feature (328)..(328): n is a, c, g, or t
  modified_base (518)..(518): a, c, t, g, unknown or other
  misc_feature (518)..(518): n is a, c, g, or t
tcagcagtagacgtcacgaccggtgctcgatttagtgtgagtagtttgggtttgggggtaggctacaacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagacgttgttttattcggccccaaccaataaaccaactacttagcttaggtaaccagcagaaagtacggacagccctacctaaactcctgactttacgngggcttaccgacccgggcacgtccggggttaccaaccgtattcattggcaggtcgggtctcgggactatttcactctcaccatcacgcacgcctagcaggctgaagatggtagctagtttactacgtcgtcagacaactattattacttctttcgtcctacgtttcgggcggtaggaaccgtaaggtganactacgaaacggactggtcgacttagacctacattcgtcgttctactacg

SEQ ID NO: 65352 - DNA, 570 bp, Homo sapiens
  misc_feature: GYAE6OF02HN2XL.31.78.H01.1.454.CMB.1.raw
  modified_base (427)..(427): a, c, t, g, unknown or other
  misc_feature (427)..(427): n is a, c, g, or t
  modified_base (476)..(476): a, c, t, g, unknown or other
  misc_feature (476)..(476): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacaactacttagcttggtaccagcagaaagtaggacagccctacctaaactcctagactttactgggcttccgtacccgggctacgttcccggggttacctaaccgtattcaagttggcaggcgggtcgtgggaccgatttcactctcaccatcagcagcctgcgagctagaagntgtggctagtttattacgtgtcagctaactattattacttctttccgtntaccgtttcggcgggtaggaccgtaagggtgacgtataccgaaacgtacgttggtcggtcgtacgacctacctagtacttcgttactccttacg

SEQ ID NO: 65353 - DNA, 544 bp, Homo sapiens
  misc_feature: GYAE6OF02IREWB.31.78.H01.1.454.CMB.1.raw
  modified_base (318)..(318): a, c, t, g, unknown or other
  misc_feature (318)..(318): n is a, c, g, or t
  modified_base (355)..(355): a, c, t, g, unknown or other
  misc_feature (355)..(355): n is a, c, g, or t
  modified_base (527)..(527): a, c, t, g, unknown or other
  misc_feature (527)..(527): n is a, c, g, or t
tcagcagtagacgtcacgaccggtgctcgatttagtgtgagtagtttgggtttgggggaggctacaacaggcaggcaggggcagcaagatggtgttgcagacccaggtcttcatttctctgttgctctggatctctggtgcctacggggacatcgtgatgagccagtttccagactccctggctgtgtctctgggcgagcggccaccatcaactgcaagtccagccagagtgttttattggccccaccaataacaactacttagcttggtaaccagcagaaacgtaggacagcctacctaaacttcctagatttacgngggcttcctaccgggctacgtccgggttacctaacgnttcagttggcagtcgggtctgggaccgtatttcactctcaccatcagcagcctgcaggctgaagatgtgctagtttatacgtgtcagacaactattatacttctttcgtactacgtttcggacggtaggaacctagggtgagatacgaaagtaactgtagctagactaccgnttacgtgttcctatacg

SEQ ID NO: 65354 - DNA, 556 bp, Homo sapiens
  misc_feature: GYAE6OF02GYS4Z.31.78.H01.1.454.CMB.1.raw
  modified_base (200)..(200): a, c, t, g, unknown or other
  misc_feature (200)..(200): n is a, c, g, or t
  modified_base (334)..(334): a, c, t, g, unknown or other
  misc_feature (334)..(334): n is a, c, g, or t
  modified_base (465)..(465): a, c, t, g, unknown or other
  misc_feature (465)..(465): n is a, c, g, or t
  modified_base (541)..(541): a, c, t, g, unknown or other
  misc_feature (541)..(541): n is a, c, g, or t
  modified_base (551)..(551): a, c, t, g, unknown or other
  misc_feature (551)..(551): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccctacggggacatcgtgatgagccagtttccagactccctggctgtgtctctgggcgagnggccacatcaactgcaagtccagccagagtgttttattcggccccacaataacaactacttagcttaggtaccagcagaaagtaggacagcctacctaaactcctagatttacgtgggcctttcgtacccgggnacgtccggggtttcctaaccgattcgattcggctaggcggttcgtgggaccgtattttccacttcgtaccacctatcacgcagccctgcaggctagaagagtgtgctagtttattacgtgtcagtctaatnttacttactttctttcgtactacgtttcgggcgtaggacctaggtgagatacgaaagtctagtgctgacctacgtntctgttcttntaccg

SEQ ID NO: 65355 - DNA, 935 bp, Homo sapiens
  misc_feature: GYAE6OF02FT6EU.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgaccgtacggggacatcgtgatgacgcctagtttccagtcctccgtggtctgtgtctcgtgggcgaggacggaccaccatacacgtgacaacgtccagccagtagtttagttttacgttccggacccccaactaaactaaacctaacttacgttacgtcgttacggaaccagacgaaggtaaaggtacgaccacgtacccttaacctaacctcgtagttacgtttacgacgggtcctttaccggacccgggcttaccgggtttcccgggtaccctaaccggttacttacgtacgttcgggaccgtacggggtcccggggttacgtacgggggtaacccttacgtttacccgaaccgttacccttacccgaaacccgttacgttaacccgaaccggtaacccgtaaccggtacccggttaccgggaaccggtaaccgggtaccgttaacgggtaaacgttacgggttacggggttacgggttaaccgttttaacggttttttaacgtttaaccgtttacggttaccgtaaacggttaacccttaaacgtttaacttttaaaccttttaaccgtttttacccgtttttacccggttaccgtttaaccggggtttttaacccgggggaacggggttaaaccggggtaaaccgggttaaacggggttacgggtaaccgtaaccgtaaaccggtaaaaccggttaaccggttacgggttaacgggttaccgttaaccggtaacccgttacccgttaacggtttacccggtttaccgttttacccgttaccgtttaaccccgg

SEQ ID NO: 65356 - DNA, 687 bp, Homo sapiens
  misc_feature: GYAE6OF02G8FCZ.31.78.H01.1.454.CMB.1.raw
tcagcagtagacgtcacgaccggtgctcgatttagtgtgagtagtttgggtttggggggagctacaacaggcaggcaggggcagcaagatggtgttgcagacccaggtcttcatttctctgttgctctggatctctgggtgccgtacggggactatcggtgatgagcctagtttccagactccctgggctgtgtctcgtgggcgaggagggccacatcaactgacaacgtccagccagtagttgttttattcggccccaacaataacaactacttacgcttaggtaaccagacaagtaaagtacggaactacggaccctacctaaactcctagtaactttacgtgggtccttccgtacccgggctacgttcccggggttaccttaaccgtacttaccgagttcggacgacggtcggggtcgtcggggtaccgtagttttccacctctaccaacctatccgaagccacgccttaggaccgaagggtcctaaggaaagtagttacggtggtacttaaggttttaacttacttaggtacctaagtaccaaacttattacttaactttccgtttacgtacttaccggtttcgggacggtaacggaaccgtagggtagactaacgtaccgaaacggtacgttaggtccggacgtcgacctacgtacgtttccgtacgttaccttacgtaccg

SEQ ID NO: 65357 - DNA, 769 bp, Homo sapiens
  misc_feature: GYAE6OF02HNWTG.31.78.H01.1.454.CMB.1.raw
  modified_base (279)..(279): a, c, t, g, unknown or other
  misc_feature (279)..(279): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccaccaataacactaacttacgtcgtcgtacgacgnacgaaagtaagacgacgaccgtaccctaacctacctcgtagttacttacggtcgttaccttacccgggtaccgacgtacccgggttcccggttaacccgtaacgttctaacgttcggtcgacgtaccgggtccggtcgggtaccggtaacttttccgtaacctccgttcctacccaacgtactacgacgaacgtcccgtcgtaccgggacggacgttcgaaaaggaagttggttcgggaccgttaaacggttttaacgtttttaccacgggtttaccaacgaactaaaccttaaactttagttaacctttttaccgttttaccggtttaccgtacccggtttttaaccgggtaccggggggaaacccgggttaaccgggtaaagggtacgggtaacgggtaacgttaaccgtaaaaccggaaaccggtttggttacgggttaccgtacggtaccacccgtaaagtttcgttacggtttcttacgttaccg

SEQ ID NO: 65358 - DNA, 563 bp, Homo sapiens
  misc_feature: GYAE6OF02GIXTL.31.78.H01.1.454.CMB.1.raw
  modified_base (443)..(443): a, c, t, g, unknown or other
  misc_feature (443)..(443): n is a, c, g, or t
  modified_base (559)..(559): a, c, t, g, unknown or other
  misc_feature (559)..(559): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacaactacttagcttggtaccagcaagaaagtaggacagcctacctaaactcctgactttacgtcgggtcttcgtacccggggctaacgttcccgggggttacctaaaccggattcgagtttcggctaggtccgggttctacggggtacccgtattttccacgtctcaccatcagcagctgcagctgaagntgtgctagtttatactgacagcaactattactactttcttcgtctacgtttcggcggtacggaccgaaggtgacgagtacgaaacgtacgtcggtagctagcactactctgttctntacc

SEQ ID NO: 65359 - DNA, 696 bp, Homo sapiens
  misc_feature: GYAE6OF02FTH1S.31.78.H01.1.454.CMB.1.raw
  modified_base (366)..(366): a, c, t, g, unknown or other
  misc_feature (366)..(366): n is a, c, g, or t
tcagcagtagacgtcacgaccggtgctcgatttagtgtgagtagtttgggtttgggggagctacaacaggcaggcaggggcagcaagatgggtgttgcagacccaggtcttcatttctctgttgctctggatctctggtgcctacggggacatcgtgatgagccagtttccagactccctggctgtgtctcgtgggcgaggagggccaccatcaactgcaagtccagccagagttgttttattcggacccccaacaataaccaactacttagcttagtaccagcagaaagtaggacacgcctacctaactcctgtatttacgtgggcttaccgtacccgggctacgttccggggttcctaaccgtnttctagttcggcgtaggtccgggtcgtacggggaccgtagttttccaaccttccgtaccacctacgttaccgaacggtacctacggtccctcggaccgtacgggtacgttacggaaagtacgttcggtacgggtacgttaacggttttaactacgtttcgtacgaacgtactaacgttatttaacttaccttttcgtttaccgttccgttaacgtttccgggaacgggtacggtaaccgtaagggttacggacgtactaacggtaaacggtaacgtcggtacggtacgtacggacgtacccgttagttccgtacgttaccgttactaccg

SEQ ID NO: 65360 - DNA, 714 bp, Homo sapiens
  misc_feature: GYAE6OF02IY9WH.31.78.H01.1.454.CMB.1.raw
tcagcagtagacgtcacgaccggtgctcgatttagtgtgagtagtttgggtttgggggagctacaacaggcaggcaggggcagcaagatggtgtttcagacccaggtcttcatttctctgttgctctggatctctggtgcctacggggacatcgtgatgagccagtttccagactccctggctgtgtctctgggcaggaggccaccatcaactgacaagtccagccagagtgttttattggccccacaataacaactacttagcttggtaccagcagaaagtaggacagcctcctaaactcctagtatttaaccgtgggtcctttccgtaccccgggtacctacgttcccgggggttacccttaaaccggtatttcctaacgtttacgggctaacgggtcgggttaccgtgggaacccgtagttttccaacgttccgtacaaccctaactctaaccgactaacggtccgtacggacgtaacggtcgtacggaacgtacgtacgggtggtaccttaagtttacgttaacgttacggttactaacggtactaaacttagttaactttaaccgtttccgtttaccttcgttaaccggtttccgggtacgggtaacgggtaaccgtaagggttacggtacgtacgtaccgtaaacgtaaaccgtggttacggacgtcgaccgtaccctagtccgttacgttcttacgtaccttacccg

SEQ ID NO: 65361 - DNA, 609 bp, Homo sapiens
  misc_feature: GYAE6OF02GTFD2.31.78.H01.1.454.CMB.1.raw
  modified_base (436)..(436): a, c, t, g, unknown or other
  misc_feature (436)..(436): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcaggagggccaccatcaactgcaagtccagccagagttgttttattcggccccaacaataacaactacttagcttggtaccagcagaaagtagacagcctacctaaactcctgtacttacgtgggtcttccgtacccgggctacgtcccggggttacctaaccggattccagttcggcaggccgggttcgtcgggaccgtatttccgactctccaccatcagcacgcctgcaggctagaagntaggtgactagtttacttacgtgtacagtacaatactttacgttacctttctttccgtccttacgtttccgggacgggtaacgggaaccgtaagggtggaacgtacgtaaccgtaaacgtaaccgttaggtcggtacgtcgaccaccgtacgttccttacgttccttctaccg

SEQ ID NO: 65362 - DNA, 657 bp, Homo sapiens
  misc_feature: GYAE6OF02H18QV.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctcgtgggcgaggagggccaccatcaaatgcaagtccagccagagttgttttattggccccaacaataaacaactacttagcttggaccagacagaaagtaggacagcctacctaaaactcctaggtaactttagtcgggtctttaccgtacccgggctaacggttcccgggggttacctaaaccggtattccaagtttcggctacggcgggtctcggggacctagtttcacgtctcaccatcgagcacgcctgacaggctagaacgatgtggctaagtttactactgtacagtacaaactagtttaataactttcgtttaccgtacttacgttttaccgggacgggtaacgggtaaccgtaagggttcggtaacgtacgtaaccggtaaaaccggtaaacgttcgggtacgggttacctacggaccctaaccgtaacgttccgtttacgttacccgtttactaacccgg

SEQ ID NO: 65363 - DNA, 777 bp, Homo sapiens
  misc_feature: GYAE6OF02GFTKV.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctcgtgggcgaggacgggccaccatcaactgcaagtccagaccagtagttgttttattcggacccccaacaaataaccaactacttagcttggtaccagcaagaaagtaggacagcctacctaaactcctgtactttactgggtcttaccgtacccgggctaacggttcccggggtttacctaaccgtagttccgtaagtttcggacgacgggtccggggttcgtacggggtaacccgtacgttttaccaaccgtttccgttaccaacccgtattaccgaacgtccaacgtcccgtacggaccgacggtacgtacggaaacgtagttcgggtacggtaccgttaaggttttaacttaacgttcgttacgaacgtaccttaaacttaagttttaaccttaaccgttttcccgtttttaccggttaccgtttaccggtttttaccggggaaccggggtaacgggtaaacccgtaaggggttacggaaggtaactaaccggtaaaaccggttaacggttacgggttacgggtacgttaccggtaaccgacccgttaacgttccgtttacggtttacctttaccgttaacccg

SEQ ID NO: 65364 - DNA, 521 bp, Homo sapiens
  misc_feature: GYAE6OF02FTNKG.31.78.H01.1.454.CMB.1.raw
  modified_base (518)..(518): a, c, t, g, unknown or other
  misc_feature (518)..(518): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagcctcctaaactcctgatttactgggcttctacccgggcatccggggttcctaaccgattcattggcagcgggtctgggaccgatttcactctcaccatcagcagcctgcaggctgaaagatggtggctagtttattactgtcagcaactattatacttctttcgtctactttcggcggtagggaccaagggtgagatacgaaacgactggtgctgacaccatctgtctntac

SEQ ID NO: 65365 - DNA, 647 bp, Homo sapiens
  misc_feature: GYAE6OF02HVZQX.31.78.H01.1.454.CMB.1.raw
  modified_base (642)..(642): a, c, t, g, unknown or other
  misc_feature (642)..(642): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgagccagtttccagactccctggctgtgtctcgtgggcgagaggcccaccatcaactgcaagtccagccagagttgttttattcggccccacaataacaactacttagcttggtaccagcagaaagtgacagcctacctaaactcctgatttactgggtccttccgtaccccggggctaacgtcccgggggtttaccctaaaccggtactttaccagtttcgggcctaacggtccgggggttacgtcgggggtaaacccgtattttccacctttcctacccaacccgtacttaccacggccaacggccccgttggaccgtagggccttaggaaagtagttggcgggtactaaggttttacttacgtgttcagtaccaactatttatcctttctttcgtcttacgttcggacggaggtaccgaaggtcggagtacgtacgaaacggtaacctggtcggctgctaacctagttccttgttccgtntaccg

SEQ ID NO: 65366 - DNA, 561 bp, Homo sapiens
  misc_feature: GYAE6OF02G1DIW.31.78.H01.1.454.CMB.1.raw
  modified_base (434)..(434): a, c, t, g, unknown or other
  misc_feature (434)..(434): n is a, c, g, or t
  modified_base (539)..(539): a, c, t, g, unknown or other
  misc_feature (539)..(539): n is a, c, g, or t
  modified_base (547)..(547): a, c, t, g, unknown or other
  misc_feature (547)..(547): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacaactactagcttggtaccagcagaaagtaggacagccctacctaaactcctgtatttacgtgggccttccgtacccggggctacgtcccggggtttaccctaaccgattcagttcggcaggccggggtctggggacccgtattttccactctcaccatcagcagcctgcaggctagaagntggtggctagttttatactgtcagcaactatttatacctttctttacgtctacgtttcgggcggtacggaccagggtggagtataccgaaacgtacgtggtgtcngccacctntctcgttctctacg

SEQ ID NO: 65367 - DNA, 700 bp, Homo sapiens
  misc_feature: GYAE6OF02HPBY5.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttacttggccccaacaataacaactacttagcttggtaccagcaagaaagtaggacacgcctacctaaaacctccttagtaactttacgtcgggtccttaccgtacccgggctacgttcccgggggttaccctaaacccggtatttccacgtttcgggactaggtccggggttacgtggggaacccgtattttccgaacttcctaccaccctatcgaagtccacgtcccgtgaccgaggcttagaaacgtacgttggtacggactaggtttttaacttacgtcgttacacgtaacaaacgttatttaacgttaccctttcgttttaccgttaccttacggttttccgggcgggtaaacggtaaccgtaaagggttcggaacggtaacttaaccggtaaaacgtaccggttcggtacggtacgtacggaccctaccgtacgttaccgttacgttaccttactaaccg

SEQ ID NO: 65368 - DNA, 806 bp, Homo sapiens
  misc_feature: GYAE6OF02GVQBD.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacaactacttagcttggtaccagcagaaagtaggacagcctacctaaactcctagtatttacgtgggcctttccgtacccggggctaacgttcccgggggtttaccctaaaccggtactttccagtttcgggacctaacgggtccggggttacgttacgggggtaaccccgtagtttttccgaaccgttcctaccgaaccctaattcccgaacggtcccaacggtccccgttaggacccgtaacgggtaccgttaggaaacggtaacgttcgggttacgggtaccttaacggtttttaacgtttaaccgttacggttaccgtaacggtacctaaacgttaattttaacgttaacccttttaccgttttaccggttaccgttaaccggtttttccggggaaccggggttaaacggggtaaacccgtaaaggggttacgggtaacggtaacgttaaccggtaaaaaccggtaaaccgttacgggtaccgggtacccgttacggtacccgtaacccgtaagtttacccggttacggtttacccgttaccgttacccg

SEQ ID NO: 65369 - DNA, 629 bp, Homo sapiens
  misc_feature: GYAE6OF02FREDD.31.78.H01.1.454.CMB.1.raw
  modified_base (316)..(316): a, c, t, g, unknown or other
  misc_feature (316)..(316): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggccccacaataacaactacttagcttggtaccagcaagaaagtaggacagcctacctaactcctgtatttacgngggtccttccgtacccgggctacgttcccggggttacctaaccggtattcctattggcaggtccgggtcgtaggggtaccctatttccactctaccaccatcagcacgcctgcgaggctagaagtagtggtacggacttagtttactacgttgtacacgtactaaactatttaacttaccttttccgttttaccgttaccttaccgttttccgggacgggtaacgggtaaccgtaagggtcggtagaacgtaaccgaaacggtaacgtggtcggtacgtcgacctaccgtacttcgtacgttaccttctaccg

SEQ ID NO: 65370 - DNA, 757 bp, Homo sapiens
  misc_feature: GYAE6OF02IG0FU.31.78.H01.1.454.CMB.1.raw
  modified_base (252)..(252): a, c, t, g, unknown or other
  misc_feature (252)..(252): n is a, c, g, or t
  modified_base (345)..(345): a, c, t, g, unknown or other
  misc_feature (345)..(345): n is a, c, g, or t
tcagcagtagacgtcacgaccggtgctcgatttagtgtgagtagtttgggtttgggggaggctacaacaggcaggcaggggcagcaagatggtgttgcagacccaggtcttcatttctctgttgctctggatctctggtgcctacggggacatcgtgatgagccagtttccagactccctggctgtgtctgtgggcaggagggccacctagtcaatgcaagtccagccagagttgttttattcggccccaanaatacaactacttagcttggtaccatcaagaaagtacggcaggtccctactaaactcctagtactttactgggacctttacggaccccgggtnaacggtttccccggggttacccctaaaccggtagttcctaaggtttcggcctacggtcggggtcttacggggaacccgttattttcccgactttaccgtaccaaacccttgtaccgacggtacctacggtcccttacggccgtaacgggtccgttaggaaacgtacgttcgggtacggtacgttaaagttttacgttttacttacggttaccgaacggtacaaacccgttaagtttaaccttaaccgttttccgtttacccgttttaccgtaacgtttttccggggaccggggttaacgggaaacccgttaggtaccgggtacgtaacggtaccgtaaaacggttaactcgggtacggtaccgttacgtcctaaccggtacgttaccggttacggttaccttaccttaccgg

SEQ ID NO: 65371 - DNA, 607 bp, Homo sapiens
  misc_feature: GYAE6OF02GO7ZG.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagacctccctggctgtgtctctgggcgagagggccaccatcaactgcaagtccagccagagtgttttattcggccccacaataacaactacttagcttggtaccagcagaaagtagacagcctacctaaactcctagactttacgtgggctttccgtacccgggctacgttcccgggggttacccttaaaccggatttccgaagtttcggaccaggtccggggtcttacggggacccgtattttccgaaccttcgtaccaacccaatccaagccacgtcctcgaccacgggctaggaaagtagtaggtggctaaggttttattaccttgtacagacaaactattaactactttcgtttctctacgtttcggacgggaggaccgtaaggtgacaagtaccgaaacgactggtcgactgacacagtctcgttctctacg

SEQ ID NO: 65372 - DNA, 817 bp, Homo sapiens
  misc_feature: GYAE6OF02H9AJL.31.78.H01.1.454.CMB.1.raw
  modified_base (234)..(234): a, c, t, g, unknown or other
  misc_feature (234)..(234): n is a, c, g, or t
  modified_base (345)..(345): a, c, t, g, unknown or other
  misc_feature (345)..(345): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacattcgtgatgagccagtttccagactccctggctgtgtctcgtgggcgagagggccaccatcaactgcaagtccagcagagttnttttattgccccacaataacaactacttagcttggaccagcaagaaagtggacaagcctaccctaaactccctagtaactttacgtgggtcctttaccgtaccccggggtntaacggttccccggggtttaccctaaacccgtaattccgtaaagttcgggcccgaagggtcccggggttcgtacggggtaacccgtacttttacctaccgtccttacccgaacctacgtacgaacggaccgacgtacccgttcgaccggtaaccgggaccgtaggtaaacgtagtacgggttacgggtacgttaacgttttaacgttttaaccgttcggttaccgtaaacggtacctaaaaccttaagtttttaaacctttacccgtttttaccctttttacccggttaacccgtttaaccggttttttaccggggaccggggttaaaaccgggtaacccgttaaaccggggttagggtaaacccggttaagtaccccgtaaaaacggttaaacccgttgggttaacggtaccgttacgtaacccgtacccgttaccgtaccgtttacggtttacccgttacgttaaccccg

SEQ ID NO: 65373 - DNA, 542 bp, Homo sapiens
  misc_feature: GYAE6OF02HAG1Z.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacaactacttagcttggtaccagcaagaaagtaggacagcctacctaaactcctgtatttactgggcttccgtacccgggcacgtcccggggttcctaaccgattcattggcaggcggtctgggaccatttcactctcaccatcagcagcctgcaggctagaagatggtcggactagtttattacgtgtcagcaactattatacttctttcgtctacgtttcgggcggtacggaaccagggtggagtactacgaaacgactgagtctagaccactatctacgttctctac

SEQ ID NO: 65374 - DNA, 670 bp, Homo sapiens
  misc_feature: GYAE6OF02JYIPU.31.78.H01.1.454.CMB.1.raw
  modified_base (292)..(292): a, c, t, g, unknown or other
  misc_feature (292)..(292): n is a, c, g, or t
  modified_base (340)..(340): a, c, t, g, unknown or other
  misc_feature (340)..(340): n is a, c, g, or t
  modified_base (369)..(369): a, c, t, g, unknown or other
  misc_feature (369)..(369): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgacgccagtttccagactccctggctgtgtctctgggcgagagggccaccgatcaactgcaagtccagccagagttgttttacttcggccccacaataacaactacttagcttggaccagcaagaaagtggacngaccctctaaactcctagactttacgcgggtcttaccgtaacccgggntacgttcccgggggttacctaaaccggtnttacgaacgtttggacctagggccgggtctaggggaccctatttcacgtctcaaccctagtcaacgtcgacgtccgtacgccgaggccttaaggaaactgttaggtcgtacgtaaggttttaacttacgtcgtacaaggacaaacttactttaataacccgtttctttcgtaccgttacggtttaccgggacgtaaggggtaacccgtaaggtagggtactaacgttaaccggaaacgttaaccggtcggttacggaacttccggactaaccgtagttcgtaccgtttactcggttaaccc

SEQ ID NO: 65375 - DNA, 540 bp, Homo sapiens
  misc_feature: GYAE6OF02G1GQX.31.78.H01.1.454.CMB.1.raw
  modified_base (317)..(317): a, c, t, g, unknown or other
  misc_feature (317)..(317): n is a, c, g, or t
  modified_base (336)..(336): a, c, t, g, unknown or other
  misc_feature (336)..(336): n is a, c, g, or t
  modified_base (537)..(537): a, c, t, g, unknown or other
  misc_feature (537)..(537): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggccccacaataacaactacttagcttggtaccagcaagaaagtaggacagccctacctaaactcctagatttacngggtccttcgtacccgggnacgtcccggggttacctaacccggtattcattggcaggcgggtctggggaccgtatttcactctcaccatcagcacgcctgcgaggctggaagagtgtggctagtttattactgtcagacaactattatactttctttcgtctactttcggcggaggacaggtcgagatacgaaacgaactgtggctgcacatctgtcttntac

SEQ ID NO: 65376 - DNA, 776 bp, Homo sapiens
  misc_feature: GYAE6OF02GYRGI.31.78.H01.1.454.CMB.1.raw
tcagcagtagacgtcacgaccggtgctcgatttagtgtgagtagtttgggtttgggggtaggcctaacaacacggcaggcagggccagcaagatggtgttgcagacccaggtcttcgatttcgtctgttgccttctggagtccgtctggtgaccgtacggggacactcgtcgagttgacgcctagtttccagacctcccgtggctgtcgtctcgtgggccgaggacggccaccgagtccgaactgacaacgtccagtccaggtacgttgttttagttcggaccccctaactaagtaaacctaacttaccgttaaggccgtttacggtaccccaacggaccgtaacggtaaaaggtacggaacctacggtaccccttaacccgttaaaacgttcccgttaggtaacttttaaccggtcgggtccctttaccggtaccccgggtcttaaccggttaccccggggtttaccctaaaaccggtatttaccgagtttacggaccgtacggtccgggttacctacggggaccctagtttaccacctccgtaccaccagtaccgacgacaccgtcctagaccgtaacggtcgtaagaacgtagtggtacgacgttagtttatacgtcgtacgaacgtacctaaacttacgtttaacgtaccgttttccgttacgtacgttacgttttcgggacgggtaacggtaaccgaggggttcggtagtaacgtacggtaaacgtcgttagtcggactggacccacgtacgtcgttcgttactaccgtcg

SEQ ID NO: 65377 - DNA, 541 bp, Homo sapiens
  misc_feature: GYAE6OF02GSZGT.31.78.H01.1.454.CMB.1.raw
  modified_base (523)..(523): a, c, t, g, unknown or other
  misc_feature (523)..(523): n is a, c, g, or t
  modified_base (538)..(538): a, c, t, g, unknown or other
  misc_feature (538)..(538): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacaactacttagcttggtaccagcagaaagtaggacagcctacctaaactcctagatttactgggcctttccgtacccgggcacgttcccggggttacctaaccggattccattcggcaggcgggtctgggaccgtatttcactctcaccatcagcagccctgacgaggtctaggaagatggtggctagtttatctgtcagacaatattatacttctttcgctacgtttcggacggaggtacgaggtgagatacgaaacgtactgtcgtcngacactatctgtctntac

SEQ ID NO: 65378 - DNA, 553 bp, Homo sapiens
  misc_feature: GYAE6OF02FWFBL.31.78.H01.1.454.CMB.1.raw
  modified_base (416)..(416): a, c, t, g, unknown or other
  misc_feature (416)..(416): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagtagtgttttattcggaccccacaataacaactacttagcttggtaccagcagaaagtaggacagcctactaaactcctgatttactgggcttacgtacccgggctaacgtcccggggttacctaaccgtattcattggactaggtcgggtctgggaccgtatttcactctcaccatcagcagcctgcnggctgaagatgtgctagttacttactgtcagacaactattactactttcgtttctactacgtttcggacggtacggaaccgtaggtaggacgaatacgaaacgtactcggtcgtctagcaccatcgtgtcctatacc

SEQ ID NO: 65379 - DNA, 581 bp, Homo sapiens
  misc_feature: GYAE6OF02GHEJE.31.78.H01.1.454.CMB.1.raw
  modified_base (532)..(532): a, c, t, g, unknown or other
  misc_feature (532)..(532): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggccccacaataacaactacttagcttggtaccagcagaaagtaggacagccctacctaaactcctgtaactttacgtgggtcctttccgtaccccggggctacgttcccgggggttaccctaaaccggtattcagtttcggcaggtccggggtctacggggaccgtatttcactctaccaccactcagcacgcctgcaggctagaagtagtgtggctagtttactactgtcacgctaactatttactactttctttcgtctacgtttcggcggacggacgtagggtcganacgtacgaaacgtacgtggtacggtctgactacctatctctctctaccg

SEQ ID NO: 65380 - DNA, 848 bp, Homo sapiens
  misc_feature: GYAE6OF02HXWEC.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactcctggctgtgtctctgggcgagagggccaccatcaactgacaagtccagccagagtgttttattgaccccacaataacaactactagcttggtaccagcaagaaagtaggacagcctacctaaactcctgatttacgtggtccttaccgtacccgggctaacggttcccgggggtttaccctaaaacccggtatttccgaacgtttacgggccctaagggtcccggggttaccgttacgggggaacccccgttaatttttacccgaaccgttccctttaacccaaacccgtaaacttcccgaaacggtccctaaacggcccccgttacggaccgtaacgggtcccgtaaagggaaaagttacgtacggggttacggtacgtttaaacggtttttaacgttttaaccgtacggtttaaccgaacggtaacctaaaacctttaagtttttaaacctttacccgttttttaaccgtttttacccggtttaacccgttaaccgggtttttacccgggggaaccggggttaaacgggtaaacccggttaagggggttaacggaacggttaaactaaacccggtaaaaaccggttaaccggttagggtaccggttaccggtacggtaaccccgtaaccttaacgttcccggtttacggtttcccttaaccgtaccccgg

SEQ ID NO: 65381 - DNA, 570 bp, Homo sapiens
  misc_feature: GYAE6OF02FX9WZ.31.78.H01.1.454.CMB.1.raw
  modified_base (312)..(312): a, c, t, g, unknown or other
  misc_feature (312)..(312): n is a, c, g, or t
  modified_base (328)..(328): a, c, t, g, unknown or other
  misc_feature (328)..(328): n is a, c, g, or t
  modified_base (350)..(350): a, c, t, g, unknown or other
  misc_feature (350)..(350): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcagagggccaccatcaactgcaagtccagccagagttgttttattcggccccacaataacaactactagcttggtaccagcagaaagtaggacagcctacctaaactcctgatttacngggtcttcacccgggnagttcccggggttcctaaccgnttccattggctaggcggtctgggacctatttcactctcaccatcagcagcctgcaggctagaagtatgtgctagtttattactgtcagacaatattacttactttctttcgtctacgtttcgggacggtacggaaccgtaaggtcgggagaacgtacgaaaccggtaacttggtacggtaccgtggacccaaccgtacttacgtcgttccttactaaccg

SEQ ID NO: 65382 - DNA, 732 bp, Homo sapiens
  misc_feature: GYAE6OF02JRVHP.31.78.H01.1.454.CMB.1.raw
tcagcagtagacgtcacgaccggtgctcgatttagtgtgagtagtttgggtttgggggtaggcgtacaacaggcaggcaggggcgagcaagatggtgttgcagacccaggtcttcatttctctgttgtctctggatctctggtgccgtacgggacatcgtgatgagccagtttccagacctccctggctgtgtctcgtgggcaggagggcccaccatcaactgcaagtccaagccagagttgttttacttggccccacaatacaactactagcttggtaccagtcagaaagtaggacagtcctacctaaactcctagtattactggggactttcgtaaccccgggtctaacgttcccgggggttacctaaccggtacttccgtaaacgtttcgggccgtaacggtccggggttaccgttcgggggtaaccccgtaacgttttaccgaaccgtttcctacccgtaaacccgtacgttacccgaaacgtccgtaaacggtccccctaggtacccgtaacggggtacttaacgggaaaaccgttgttacgggttacgggtaccgttaagggttttaacctttaacgttcgttacgaacggtacaaacgttatttaactacctttcgttttaccgtacgttacgtttaccggacggtacggtaccgtaaggggtcgtagtacgtaacaaacggtaccttaggtcgacgtcgactacacttctgttacttcgtaacc

SEQ ID NO: 65383 - DNA, 880 bp, Homo sapiens
  misc_feature: GYAE6OF02I6S1G.31.78.H01.1.454.CMB.1.raw
  modified_base (221)..(221): a, c, t, g, unknown or other
  misc_feature (221)..(221): n is a, c, g, or t
tcagcagtagacgtcacgaccggtgctcgatttagtgtgagtagtttgggtttgggggtaggcgtacaacaggcaggcaggggcgagcaagatggtgttgcagacccaggtcttcatttctctgttgctctggatctctggtgcctacggggacatcgtgatgagccagtttccagactccctggctgtgtctcgtgggcgagacgggccaccatcaactncaagtccagccagtgttgttttattcggcccctaacaataacacttaacgtagtcgttcgtaccagacaagtaaaagtaggacacgacccttacctaaactccctgtaactttaccgtgggacctttcgtaaccccgggctaacgttcccgggggttacccctaaacgtacttccgtagttacgggacctaacgggttcccgggtcgtttacggggaaaccccttcgtttttaccgaaccgtttaccgttaccctaaaccccggacttttaccggtaacccgggaaccttacccggtacccgttaccggtaaccgggtaacgggttaaccgtaacgggtaaaaacgtaaccgggtttagggttttaccgggaaaccgtttagggttttttaaaccctttaaacccggtttgtaaccgttaaacgtaacccgtaaaaccttttaacgtttaaaccgttttaccctttttaaccgttttttccggtacccgtttaaccgtttttcccggggtaaacggggttaaacccgggtaacccgtaaaggggttttccggaaacggttaaccgttaacccggtaaaaacggttccgtttaacgggtccggtaccctaggttacccgtacgttacccttagtttccggtttacccttaccgtttaccg

SEQ ID NO: 65384 - DNA, 540 bp, Homo sapiens
  misc_feature: GYAE6OF02JGEUE.31.78.H01.1.454.CMB.1.raw
  modified_base (311)..(311): a, c, t, g, unknown or other
  misc_feature (311)..(311): n is a, c, g, or t
  modified_base (325)..(325): a, c, t, g, unknown or other
  misc_feature (325)..(325): n is a, c, g, or t
  modified_base (341)..(341): a, c, t, g, unknown or other
  misc_feature (341)..(341): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattggccccacaataaccaactacttagcttggtaccagcagaaagtaggacagcctctaaactcctgatttacngggcttcacccggnatccgggtctaaccgntcattggcagcggtctgggaccatttcactctcaccatcagcagcctgcaggctagaagatgtggctagtttatactgtcagacaactattagtactttctttcgtctacgtttcggacggaggtaccgaaggttggagtataccgaaacgtaacgttggtacgcgttcgacacctaattcctacggttcttactaccg

SEQ ID NO: 65385 - DNA, 640 bp, Homo sapiens
  misc_feature: GYAE6OF02IJ8RS.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggccccacaataaccaactacttagcttggtaccagcaagaaagtaggacagcctacctaaactcctagtactttacgtggtccttccgtacccgggcacgttccggggttcctaaccgatttcagttggcaggtcgggtctcgggacctatttccactctcaccatcagcacgcctgcaggctagaagagtgtgctagtttacttacgtgtacagacctaaactacttaacttaccgttttctttaccgttacgttaccgttttaccggggaccgggtaaacgggaaccgtaaaggggttggaacgtaacttaaccggaaaaccgttaacggttgggttaccgggtcgtacggtacctaacccgtacgtttccggtacgttaccctttacgtaacccg

SEQ ID NO: 65386 - DNA, 707 bp, Homo sapiens
  misc_feature: GYAE6OF02JO09J.31.78.H01.1.454.CMB.1.raw
  modified_base (323)..(323): a, c, t, g, unknown or other
  misc_feature (323)..(323): n is a, c, g, or t
  modified_base (340)..(340): a, c, t, g, unknown or other
  misc_feature (340)..(340): n is a, c, g, or t
  modified_base (363)..(363): a, c, t, g, unknown or other
  misc_feature (363)..(363): n is a, c, g, or t
tcagcagtagacgtcacgaccggtgctcgatttagtgtgagtagtttgggtttgggggtaggcgtacaacaggcaggcgaggggcgagcaagatggtgttgcagaccaggtcttcatttctctgttgctctggatctctggtgcctacggggacatcgtgatgagccagtttccagactccctggctgtgtctcgtgggcgagacgggccaccatcaactgcaagtccagccagacgtgttttacttggccccacgaataaccaacttacttagcttaggtaccagcagaaagtaggacagcctaccaaactcctgatttacnggtcttaccgtccgggnacgttccgggttacctaaccggnttcattggcacggtcgggtctgggacccgtatttcaacctctacgtaccaactccgtaaggcctacggaccctggaccgtacgggcttaacggaagtaacgtcgggttacgggaccttaaggttttacgtttaacgttcgacgttaacgactaaccttaagtttaactttaacctttttcgtttaccgttaccttaccggttttaccgggacgggtaaaccgggttaaccgtaagggttacggtagttaaccgtaacgtaaaaacccgggttacttacgggtaggtacccgttacggtaccaaccgttaacgttccgtttaacggtttcgttacccttaaccgg

SEQ ID NO: 65387 - DNA, 593 bp, Homo sapiens
  misc_feature: GYAE6OF02HRZ7R.31.78.H01.1.454.CMB.1.raw
  modified_base (588)..(588): a, c, t, g, unknown or other
  misc_feature (588)..(588): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacaactacttagcttggtaccagcaagaaagtaggacacgccctacctaaacctctagtatttacgtgggtccttccgtacccgggctacgttcccggggttaccctaaaccggtatttccgagtttcggcctaagggtccggggttcgtcgggggacccgtattttccacttcctcccaaccctatccacgccacgcccgtgccgaggctagaagatggtggctaagtttattactgtcagcaatattattacttctttcgtctacgtttcggcggacggacgaggtaggagatacgaaacgtactggtcgactgacctacgattctgttccttntaccg

SEQ ID NO: 65388 - DNA, 689 bp, Homo sapiens
  misc_feature: GYAE6OF02JZT1Z.31.78.H01.1.454.CMB.1.raw
  modified_base (651)..(651): a, c, t, g, unknown or other
  misc_feature (651)..(651): n is a, c, g, or t
tcagcagtagacgtcacgaccggtgctcgatttagtgtgagtagtttgggtttgggggaggctacaacaggcaggcaggggcagcaagatggtgttgcagacccaggtcttcatttctctgttgctctggatctctggtgcctacggggacatcgtgatgagccagtttccagacctccctggctgtgtctcgtgggcgagagggccaccatcaactgcaagtccagccagagttgttttattcggccccaacaataaccaactacttagcttggtaccagcaagaaagtggacagcctacctaaactcctagtaactttacgtgggtccttacgtaccccgggctaacgttcccggggtttacctaaacccggtatttccaaagtttcggacgtacggtccgggggttactacggggggtaacccctaatttttccaacttccgttacccaaccctagttccaacgccaacggtccctcggcgacgggtctacggtaaagtctaggtcggacttaagttttaacgtactggttaacacgtactaaacgtatttaccttaactttcgttttaccgcttaaccgtttaccggcgggtaaacggaccgtaaggggtacgagtaacgaccgaaacggtaaccgttggcgtaccnggtaaccaaccctgttacctcgttacttaccgttaccg

SEQ ID NO: 65389 - DNA, 589 bp, Homo sapiens
  misc_feature: GYAE6OF02I5Y0T.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggccccacaataacaactacttagcttggtaccagcagaaagtaggacagcctacctaaactcctgtactttactgggtcttaccgtacccggggctacgttcccggggtttacctaaccgatttccagttcggcaggcgggtctggggacctatttcactctcacctatcagcagcctgcaggctagaagatggtaggctagtttacttacgtgtacacgacaactattacttacctttctttaccgtctaccgtttcggacgggtacggaaccgaagggtcggagtactacgtaaacggtactggtacggtcgtcgactaccgtatccgttcgttccttctaaccg

SEQ ID NO: 65390 - DNA, 743 bp, Homo sapiens
  misc_feature: GYAE6OF02H20W6.31.78.H01.1.454.CMB.1.raw
  modified_base (410)..(410): a, c, t, g, unknown or other
  misc_feature (410)..(410): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgccgtacggggacatcgtgatgacgcctagtttccagacctccctggctgtgtctcgtgggcgaggacgggccaccatacaactgcaacgtccagccagtagttgttttattcggacccccaactaaataactaactacttagcgttaggtaaccagacaagaaagtagacagcctacctaaactctagtacttacgtggtccttaccgtacccgggctacggttcccgggtttacctaaccgtattcgtagttcggccaggtcgggtccgnggggtaccctagtttccactctaccacctataccacgtccacgtccgtcgcgaggtactaggaacgtagtcggtggtacgttacgtttaacgtttacgttcgtaccgaacgtaacctaaacttaattttaactttacccttttaccgttttaccgttaccgttaaccggttttaccggggaaccgggtaaacgggtaacccggttaaggggtacgggtaacggtaacgttaaaccgaaaaccggttaaaccggttcgggtaccggttaccgttacggtaacccgtaacccgtaccgtttacccggttacgttttacccgtttacgttaacccg

SEQ ID NO: 65391 - DNA, 796 bp, Homo sapiens
  misc_feature: GYAE6OF02IRUN2.31.78.H01.1.454.CMB.1.raw
tcagcagtagacgtcacgaccggtgctcgatttagtgtgagtagtttgggtttggggggagctacaacaggcaggcaggggcagcaagatggtgttgcagacccaggtcttcatttctctgttgctctggatctctggtgccgtacggggacatcgtgatggagcctagttccagacctcctggctgtgtctcgtgggcgaggacgggccaccatcaactgacaacgtccagccagtagttgttttattcggccccaacaataacaactacttagcgttaggtaccagacaagaaagtaggacacgacctacctaaactcctagtattacgtgggtccttccgtacccgggactaccggttccggggttaccctaaaccggtactttacgacggtttcggaccgtagggtccggggttcgtacggggtacccgtagtttttaccaaccgttcctaccgtaacccacgttaccgaacgccgtaacggccccgttacggaccgtaagggtacctaagggtaaacggtagttacggggtacggtacgtttaacggtttttaactttacgttcggtaacgtaacgaaccgttaaacttaacgtttaacgtttacccgtttttaccgttttacccggttaaccgtttaccgggttttaccgggggaaacggggtaaaccgggtaaaccggttaaggggttaacggtaacggtaacgttaaaccggaaaacgttaaacggtacggttacggtacgtacgacccgtaaccggttactcgttacgtttaccttacgttaccccg

SEQ ID NO: 65392 - DNA, 728 bp, Homo sapiens
  misc_feature: GYAE6OF02I8L3Q.31.78.H01.1.454.CMB.1.raw
  modified_base (321)..(321): a, c, t, g, unknown or other
  misc_feature (321)..(321): n is a, c, g, or t
tcagcagtagacgtcacgaccggtgctcgatttagtgtgagtagtttgggtttgggggagctacaacaggcaggaaggggcagcaagatggtgttgcagacccaggtcttcatttctctgttgctctggatctctggtgcctacggggacatcgtgatgagcctagtttccagactccctggctgtgtctcgtgggcgaggaggccaccatcaactgcaagtccagccagagttgtttattcggccccaacaataacaactacttagcttggtaccagcaagaaagtaggacagccctactaaactcctagtactttacgngggtcttaccgacccgggctacggtcccggggttacctaaccgtattcagttcggacgaggtcgggtctacggggtaccgtatttccacgtcctaccacctatccgaacgcacgccctgacgacggtctaggaagtagttcgggtacggtacgttaagttttaacgttaacgttcggtaccgtaacgtacctaaacttacgttttaaccttaccttttaccgttttaccggttaccttaccggtttttaccgggggaaccgggttaaccggggtaaccgttaaagggggtcggtaaacgtaccgttaaccggtaaaaccggttacgttcgggttaccggtacttaccggaacccgttacgtaacggtttccttaccggtttacctttacccgaaccgttttcccccg

SEQ ID NO: 65393 - DNA, 685 bp, Homo sapiens
  misc_feature: GYAE6OF02GREFB.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactcctggctgtgtctcgtgggcgagaggccaccatcaactgcaagtccagccagagttgttttattcggccccacaataacaactacttagcttggtaccagcaagaaagtaggacagccctacctaaactcctagtactttacgtgggtccttaccgtaccccgggctaacggttcccggggttaccctaaaccgtactttccgaacgtttcggactaacgggtccggggttcgtacgggggtaccctaagttttccaaccgttcctaccaaccgtactcacgccgacgtccgtcgcgaacggctaggaaagtgttggtacggtacgttaaggttttacttacgttcgttacgacgtactaaacttatttaacttaccttttcttttaccgttaccttaccgttttcgggaccgggtaacgggtaaccgtaagggtggacgtaacgtaacgaaacggtaacgtaggtacgtcgtacggactaccgtagttcccgtcgttccgttactaccg

SEQ ID NO: 65394 - DNA, 608 bp, Homo sapiens
  misc_feature: GYAE6OF02FHIT2.31.78.H01.1.454.CMB.1.raw
tcagcagtagacgtcacgaccggtgctcgatttagtgtgagtagtttgggtttgggggagctacaacaggcaggcaggggcagcaagatggtgttgccagacccaggtccttcatttctctgttcgcctctggatctctggtgcctacgggacatcgtgatgagccagtttccagactccctggctgtgtctctgggcgagagggccaccatcaactgcaagtccagccagagtgttttattggccccacaataacaactactagcttggaccagcagaaagtaggacagcctactaaactcctgtatttaactgggcttccgtaaccccggggcaacgttcccggggttacctaaacccggtattccgaatttcggacgaacggtcgggttctggggaacccgtattttccaacttcctaccaacccatccaacgccaacgccctgccgaaggcctagaaacgtattggcggtactagtttatacctgtacagtacaactattactactttcttacgttctacgtttcggacgtacggacctaaggtgagatacgaaaacggtactggtagtcgagccgacctacgttactcgttaccttgtacccg

SEQ ID NO: 65395 - DNA, 740 bp, Homo sapiens
  misc_feature: GYAE6OF02FUTV8.31.78.H01.1.454.CMB.1.raw
  modified_base (324)..(324): a, c, t, g, unknown or other
  misc_feature (324)..(324): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactcctggctgtgtctctgggcgagagggccacatcaactgcaagtccagccagagttgttttaattcggccctacgaataacaactacttagcttaggtaccagtcaggtaaagtaggacagcctacctaaactccgtagtactttaacgngggtcttcgtacccggcctacgttcccggggttacctaaccggtacttcgacgtttcggactacggtaccgggttctacggggtaacccgttacgttttaccgaacgttcgttaccgtaacccgtagttaccgtaacggaccgtaacggtacccgtacggtaccgaacgggtacctaacggtaaacggtacgttacggttaccgggacgtttaacggtttaacgttaccgttcggttaactaacgggtcctaaacgttacgtttacgttacgttttaccgtttacgttacttaccggttttacggaaccgggttacgggtaaccgtaagggttcggagttacgtaccggtaaacgtacgttacggtacggtaccgtagtaccgtaacgtacgttcgtacgttacgttccgtaaccg

SEQ ID NO: 65396 - DNA, 670 bp, Homo sapiens
  misc_feature: GYAE6OF02IYJ9L.31.78.H01.1.454.CMB.1.raw
  modified_base (624)..(624): a, c, t, g, unknown or other
  misc_feature (624)..(624): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacgggacatcgtgatgagccagtttccagactccctggctgtgtctctgggcgagagggccaccatcaactgcaagtccagccagagttgttttattcggccccaacaataacaactacttagcttggtaccagacagaaagtaggacagcctacctaaactctgtattactggtcttcgtacccggcacgttcccggggttacctaaccgtattaccgtatacggtccgaaggtccgggttcgtacggggtacccgtagttttacctaaccgttcctaccctaaccctacgttccgaacgaccaacgtcccgtgaccggaacgggtctaggaaacgtagttcggtacggtacgtaaggttttaactttaccgtagttaccgaagtacctaaacgtaatttaacttacctttcgtttaccgtccttaccgtttacggcgggtaaggtaaccgtaaggtaggacacgtaacgaaacgtaacgnggttacggacgtcgaccgtactaccgttacgtcgttccttactacg

SEQ ID NO: 65397 - DNA, 559 bp, Homo sapiens
  misc_feature: GYAE6OF02IST7Q.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggccccacaataacaactacttagcttggtaccagcaagaaagtaggacagcctacctaaactcctgatttacgtgggcttccgtacccgggcacgttccggggttacctaaccgattcattggcacggtcgggtctgggaccgtatttcactctcaccatcagcagcctgcaggctagaagatggtggactagtttaatcgtgtcagcaactattacttactttctttactctacgtttcgggacggacggtaccgaagggttggagtataccgaaacgtacgttggtagcgtagccacgtattctcgttctcgtac

SEQ ID NO: 65398 - DNA, 782 bp, Homo sapiens
  misc_feature: GYAE6OF02JKQ6Q.31.78.H01.1.454.CMB.1.raw
tcagcagtagacgtcacgaccggtgctcgatttagtgtgagtagtttgggtttgggggtaggcgtacaacaggcaggcgagggcgagcaagatggtgttgcagacccaggtcttcatttctctgttgctctggatctctggtgcctacggggacatcgtgatgagccagtttccagactccctggctgtgtctcgtgggcgagagggccaccagtcaactgcaagtccagccagagttgttttattcggccccacaataacaactacttagcttaggtaccagacagaaaagtaggacagtacctacctaaactcctagactttacgtagggtccttaccgtacccgggactacggttacccggggttacctaaaccggtactttacgaacgtttcggaccgaacgggtccggggtacccggggtaaccgtattttacccgaaccgtccttaccgaacccgtataccgacgtaccgtacgtccctcggacgagggtaccctaggaaacggtaagtcggtacgggtactaaggtttttaacttaccgttacggttaccgaacgtacctaaactacgttttaacgttaccgttttaccgttttacccgggttcttaaaccgggtttttaccggggaccggttaaacggggggtaaaccctaaagggggttacggttaacggtaacgttacccgaaaacggttaaacgttcgggttaacgggtccgttacggaccctaaccgttaaggttccgttaccggtttactttacctaccgtttaccccg

SEQ ID NO: 65399 - DNA, 554 bp, Homo sapiens
  misc_feature: GYAE6OF02F8YMN.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacactacttagcttggtaccagcagaaagtagacagcctacctaaactcctgatttactgggcttccgtacccgggcacgttcccggggttcctaaccgattcattcggcaggcgggtctgggactatttcactctcaccatcagcagcctgcagctagagatgtgctagttattactgtacagactaactattacttactttctttcgttctacgtttcgggacggtacggaaccgtaggtagagtactaccgaaacgtacgttggtacggtctacggcaccgtagtctgttccttctacc

SEQ ID NO: 65400 - DNA, 627 bp, Homo sapiens
  misc_feature: GYAE6OF02I8MNV.31.78.H01.1.454.CMB.1.raw
  modified_base (323)..(323): a, c, t, g, unknown or other
  misc_feature (323)..(323): n is a, c, g, or t
  modified_base (430)..(430): a, c, t, g, unknown or other
  misc_feature (430)..(430): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactcctggctgtgtctcgtgggcgaggacgggccaaccatccaactgcaacgtccagccagagttgttttattcggccccacaaataacaactacttagcttaggtaccagcaagaaagtaggacagcctactaaactcctgtatttacgngggcttcgtacccgggacacgttccggggttacctaaccgtattcagttcggcgacgtcgggtcctgggaccgtatttcactcctcacctatcgacgtacacgtccncgcgaggctagaacgtagtgtacggacttaagtttaatacttcgtacgaagtacaaacctagtttactacgttttcctttacgtaccttaacggttcgggtacggaacgggtaactaacgggtaggtaacaacgtaaccgaaacggtaagttacggtcggactacgacaacctattccgtacggttacctacgtacc

SEQ ID NO: 65401 - DNA, 598 bp, Homo sapiens
  misc_feature: GYAE6OF02FW7ZG.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacaactacttagcttggtaccagcaagaaagtaggacagcctacctaaactcctgtatttactgggcctttccgtacccgggctacgttcccgggggttaccctaaccgtattcagttcggctaggcgggtctcgggaccgtatttcactctcacctatcagcagcctgcaggctagaagagtgtggctagtttattactgtcagactaactattactactttctttcgttactacgtttacgggcggtaacgggtaccgtaagggtcggtacgtactaccgaaacggtacgttaggtacggtcgttacggacctaaccgtacgttcgtacgttccttacttaccg

SEQ ID NO: 65402 - DNA, 584 bp, Homo sapiens
  misc_feature: GYAE6OF02GVNKY.31.78.H01.1.454.CMB.1.raw
  modified_base (436)..(436): a, c, t, g, unknown or other
  misc_feature (436)..(436): n is a, c, g, or t
  modified_base (444)..(444): a, c, t, g, unknown or other
  misc_feature (444)..(444): n is a, c, g, or t
tcagcagtagacgtcacgaccggtgctcgatttagtgtgagtagtttgggtttgggggagctacaacaggcaggcaggggcagcaagatggtgttgcagacccaggtctccatttctctgttgctctggatctctggtgccgtacggggacatcgtgatgagccagtttccagacctccctggctgtgtctctgggcgagagggccaccatcaactgcaagtccagccagagttgttttattcggccccaacaataacaactacttagcttgtaccagcagaaagtaggacagcctacctaaactcctgatttacgtgggccttcgtacccgggcacgttccggggttaccctaaccggtattctagttcggcaggtcgggtcgtcggggaccgtatttccactcctacaccatcagcagcctgcaggctagaagntggtacgngtaagtttatacgtgtacagacctaatatttatacctttctttcgtacgttaccgttttcgggagggtacggaaccgtaagggtgagtactacgaaacgtaactggtcgccgtgacctacgtactcgtagttctcctacg

SEQ ID NO: 65403 - DNA, 551 bp, Homo sapiens
  misc_feature: GYAE6OF02GT47E.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacaactacttagcttggtaccagcagaaagtaggacagccctacctaaactcctgatttactgggcttctacccgggcagtccggggttacctaaccgattcattggcaggcgggtctgggacccgtatttcactctcaccatcagcagcctgcaggctagaagatgtggctagtttatactgtcagacaactatttactactttctttacgtctacgtttcgggcggtacggaccgtaagggtgagactacgaaacgtaacttggtcggtactgacaccgtattcgttgtccttctac

SEQ ID NO: 65404 - DNA, 559 bp, Homo sapiens
  misc_feature: GYAE6OF02FMKVF.31.78.H01.1.454.CMB.1.raw
  modified_base (314)..(314): a, c, t, g, unknown or other
  misc_feature (314)..(314): n is a, c, g, or t
  modified_base (398)..(398): a, c, t, g, unknown or other
  misc_feature (398)..(398): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgatgctctggatctctggtgcctacggggacatcgtgatgagccagtttccagactccctggctgtgtctctgggcgagagggccaccatcaactgcaagtccagccagagtgttttattggccccacaataacaactacttagcttggtaccagcagaaagtaggacagccctacctaaactcctgatttacgngggcttcacccgggcagtcccggggttcctaaccgattcattggcagcgggtctgggaccgtatttcactctcaccatcagcancctgcaggctagaagatggtggctagtttattatgtcagcaaactattacttctttaccttttcgtccttaacgtttcgggacggtagggaaccagggtggaagtaagtaccgaaacggtaacgtggttacggctagccaccgtatcgttcgttcttaccg

SEQ ID NO: 65405 - DNA, 621 bp, Homo sapiens
  misc_feature: GYAE6OF02H0STC.31.78.H01.1.454.CMB.1.raw
  modified_base (322)..(322): a, c, t, g, unknown or other
  misc_feature (322)..(322): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgaggacgggccaccatcaactgacaagtccagccagagttgttttattcggccccacaataacaactacttagcttggtaccagcaagaaagtaggacagccctacctaaactcctagtaatttacncgggtccttccgtacccgggctacggttcccgggttacctaaaccgtattcagttggccaggtcgggtctaggggaccctatttccactctacacctatcacgcacgcctgcaggctagaagtagtggtcggtacttagtttacttactgtacaagaccaactattactactttctttacgtccttacgtttccgggcgggtaacgggaccgtaagggtacggagtacgtaccgtaaaacggtacgttacggtaggtaccgtcggacctaacctacgttccgtagttccttactacccg

SEQ ID NO: 65406 - DNA, 770 bp, Homo sapiens
  misc_feature: GYAE6OF02JZ218.31.78.H01.1.454.CMB.1.raw
tcagcagtagacgtcacgaccggtgctcgatttagtgtgagtagtttgggtttggggagctacaacaggcaggcagggcagcaagatggtgttgcagacccaggtcttcatttctctgttgctctggatctctggtgcctacggggacatcgtgatgagccagtttccagactccctggctgtgtctcgtgggacagaggccaccatcaactgaccaagtccagccagacgttgttttacttcggacccctaccaaataaccaactacttagcgttacggtaaccagctaagaaaacgttagggacacgtacccttaccctaaaaccttccgtgtaactttaccgtggggtacctttccgaaccccgggctaaacgttcccggggtttacccaaacccggtattccgtaacgttcgggacctacggggtccgggtcccgtttaggggtaacccctaagtttttccgaaaccttccgttaccgtaacccgtaattccgaacggacccgtaacggcccgttaaccggtcgtaaaccgggtcgttaccgaaaagtcgttaacgggttccggtaactaagggttttaactttacgtacggttaccgacgttaccaaacgttaagtttacttaaccgtttaccgtttaccgttaccgtacggttttaccggacggtaacggtaccgtaaacggggttcggtaacgtactaaacccgaaacggtacgtagggttcgaccgtgacccttacaacgttcttcggttacttcgtaaccg

SEQ ID NO: 65407 - DNA, 541 bp, Homo sapiens
  misc_feature: GYAE6OF02JSU62.31.78.H01.1.454.CMB.1.raw
  modified_base (312)..(312): a, c, t, g, unknown or other
  misc_feature (312)..(312): n is a, c, g, or t
  modified_base (327)..(327): a, c, t, g, unknown or other
  misc_feature (327)..(327): n is a, c, g, or t
  modified_base (366)..(366): a, c, t, g, unknown or other
  misc_feature (366)..(366): n is a, c, g, or t
  modified_base (382)..(382): a, c, t, g, unknown or other
  misc_feature (382)..(382): n is a, c, g, or t
  modified_base (410)..(410): a, c, t, g, unknown or other
  misc_feature (410)..(410): n is a, c, g, or t
  modified_base (511)..(511): a, c, t, g, unknown or other
  misc_feature (511)..(511): n is a, c, g, or t
  modified_base (526)..(526): a, c, t, g, unknown or other
  misc_feature (526)..(526): n is a, c, g, or t
  modified_base (536)..(536): a, c, t, g, unknown or other
  misc_feature (536)..(536): n is a, c, g, or t
tcagcagtagacgtcacgaccggtgctcgatttagtgtgagtagtttgggtttgggggagctacaacaggcaggcaggggcagcgaagatggtgttgcagacccaggtcttcatttctctgttgctctggatctctggtgcctacggggacatcgtgatgagccagtttccagactcctggctgtgtctctgggcgagacgggccacgatcaactgcaagtccagccagagttgttttattggcccacaataaccactactagcttgtaccagcaagaaagtaggacagccctactaaatcctgaatttacnggacttcgacccggnacgtccgggttcctaacggattcagtcggcagcggtacngggaccatttcactcncacatcgagtcagcctgcaggctagaangtcgtgactagtttatacgtcgacagctaacctattactacctttcttacgtctcgtttacggcggacgtacaggtgagtctaacgaacgtaactgtacgngtagcaccgacgttntcgttacctntaccg

SEQ ID NO: 65408 - DNA, 589 bp, Homo sapiens
  misc_feature: GYAE6OF02HJKJM.31.78.H01.1.454.CMB.1.raw
  modified_base (316)..(316): a, c, t, g, unknown or other
  misc_feature (316)..(316): n is a, c, g, or t
  modified_base (336)..(336): a, c, t, g, unknown or other
  misc_feature (336)..(336): n is a, c, g, or t
  modified_base (358)..(358): a, c, t, g, unknown or other
  misc_feature (358)..(358): n is a, c, g, or t
  modified_base (400)..(400): a, c, t, g, unknown or other
  misc_feature (400)..(400): n is a, c, g, or t
  modified_base (421)..(421): a, c, t, g, unknown or other
  misc_feature (421)..(421): n is a, c, g, or t
  modified_base (427)..(427): a, c, t, g, unknown or other
  misc_feature (427)..(427): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagtgttttattcggccccacaataacaactacttagcttggtaccagcagaaagtaggacagccctacctaaactcctagactttacngggtccttccgtacccgggnacgtccggggttcctaaccgtnttcattcggcaggcgggtctgggacctatttcgactctcacntcagcagcctgcagctgaagngtgtgntagttactcgtgtcagacaacttattacttacctttacttccgtacttacgttccggacgggtaacggaaccgtaaggtcggagtaacgtaaccgtaaaccgtacgttagggtacgtaccgacgacctaccgtacttcgttacgttccttaccgttaacccg

SEQ ID NO: 65409 - DNA, 569 bp, Homo sapiens
  misc_feature: GYAE6OF02GG78Q.31.78.H01.1.454.CMB.1.raw
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattcggccccacaataacaactacttagcttaggtaccagcaagaaagtaggacagcctacctaaactcctgatttactgggcttcgtacccgggcacgttcccggggttacctaaccgattcattggcaggtcgggtctcgggacctatttcactctcacctatcagcagcctgcaggctgaagatgtgactagtttatactgtcagcaactattatactttctttcgtactacgtttcggacggtacggaaccgtaagggtgagtactaccgaaacggtaacttggtcggtactacggacctaccgtattcctcggtttccttactaccg

SEQ ID NO: 65410 - DNA, 808 bp, Homo sapiens
  misc_feature: GYAE6OF02JS6KL.31.78.H01.1.454.CMB.1.raw
  modified_base (240)..(240): a, c, t, g, unknown or other
  misc_feature (240)..(240): n is a, c, g, or t
  modified_base (285)..(285): a, c, t, g, unknown or other
  misc_feature (285)..(285): n is a, c, g, or t
tcagcagtagacgtcacgaccggtgctcgatttagtgtgagtagtttgggtttgggggtaggcgtacaacaggcaggcaggggcgagcaagatggtgttgcagacccaggtcgttcatttctctgttgctctggatctctggtgcctacggggacatcgtgatgagccagtttccagactccctggctgtgtctctgggcaggagggcccaccatcaactgcaagtcccagccagagttnttttatcggcccccaaccaataaccaactactagcttggtaccancaagaaagtggacagccctaccctaaactcctagatttacctggggccttcctacccggggcaacgtcccgggggttacctaaccgtagttctaagtttcggactacggccgggttctacggggtacccgtattttccacttccctaccgtaaccctagtaccctaaggcccacggtcccgtacggtccaacgggtccgttaacggaaaggtgttaaccggttgggacccgtttaagtttttaaacgttacccgttacggttaacccgtagggtaaaccctaaacttaacgttttaaactttacccgtttacgtttttaacccgggtccttaaacccggtttttcggggtaacccgggtaaaccgggggtaaaccgttaacggggttaccggggtaacggttaccgttaacccggaaaaaccggtttaacccggtttaagggtttaccgggacgtttacccggaaccctaacccggtttaaccgtttcccgttacggggtttaccccttttccggtaaacccg

SEQ ID NO: 65411 - DNA, 558 bp, Homo sapiens
  misc_feature: GYAE6OF02GWV4A.31.78.H01.1.454.CMB.1.raw
  modified_base (317)..(317): a, c, t, g, unknown or other
  misc_feature (317)..(317): n is a, c, g, or t
  modified_base (460)..(460): a, c, t, g, unknown or other
  misc_feature (460)..(460): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccacatcaactgacaagtccagccagagttgttttattcggccccaacaataacaactacttagcttggtaccagcaagaaagtaggacagcctacctaaactcctgactttacngggtcttaccgtacccgggcacgttcccggggttacctaaaccggtattcatttggctacggtcgggtcgtcgggaccgtactttcactctacaccactcagcagcctgcaggctagaagatggtcggctagtttatctgcanacaactattactactttctttcgtctacgttcggacggacggtacaggtggatacgtacgaaacgactggtgctacgcacgatctcgttcttctaccg

SEQ ID NO: 65412 - DNA, 580 bp, Homo sapiens
  misc_feature: GYAE6OF02IYGEG.31.78.H01.1.454.CMB.1.raw
  modified_base (391)..(391): a, c, t, g, unknown or other
  misc_feature (391)..(391): n is a, c, g, or t
tcagcagtagacgtcacgaccggtgctcgatttagtgtgagtagtttgggtttgggggagctacaacaggcaggcaggggcagcaagatggtgttgcagacccaggtcttcatttctctgttgctctggatctctggtgcctacggggacatcgtgatgagccagtttccagactccctggctgtgtctctgggcgagagggccacatcaactgcaagtccagccagagttgttttattcggccccacaataacaactacttagcttggtaccagcagaaagtaggacagcctacctaaaactcctgattttacgtgggcttcgtacccgggctacgtcccgggttcctaaccgattcattggcaggcgggtctcgggacgatttcactcncaccatcagcagcctgcagctgaagatggtggactgtttattactgtcagcaacgtattacttacttctttcgtactacgtttcgggacggtaacgggtaaaccgtagggtacggagtaactaaccgaaaacgtaacgttggtacggtcgtacggaccaccgttaacttcgtacgttcctttagtaccc
